United States Patent 8,809,059 (PLANTS WITH INCREASED YIELD) - sequence listing, part 3

SEQ ID NO: 5023 - protein, 413 aa, Brassica napus
MMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPQGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPALKGLWLKEVKVMADRIIGMRTALRESLEKLGSPLSWEHVTKQIGMFCYSGMTPEQVDRLTSEYHIYMTRNGRISMAGVTTGNVGYLANAIHEVTKSS

SEQ ID NO: 5024 - DNA, 1218 bp, Brassica napus
  CDS (1)..(1218)
atggagtccgtcttctcaaacgtcgttcgtgctcccgaagatcctattctcggtgtgacggttgcttacaataatgatccaagcccagctaagctcaatttgggtgtcggtgcctatcgaactgaggaagggaagccacttgttcttgacgtggtgcgaagggcggagcaacagcttgtgaacgatccgtcccgggtcaaggaatacattcctattgctggacttgctgattttaacaaacttagcgctaagctcatcttaggtgctgatagtcctgcaattcaagagagtagagttgctacaatccagtgcttgtctggtactgggtcattgagagttggggctgagtttctcaaaaaacactaccaccaaagtgtcattttcattccgaaaccaacttgggggaaccatcccaaagttttcaacctggctggcttgtctgtggagtactaccgttactatgatccctcgacccgtggacttgacttccaaggcttactcgaggatcttggtgctgcaccatctggagcgattgtcttacttcatgcatgtgctcacaatcccactggagttgacccaacctctgaacagtgggaacagattcggcaactaataagatctaaaagcttgttaccgttttttgatagtgcatatcagggttttgctagtggtagcctagacacagatgcacattcagtccgcacctttgttgctgatggcggtgaatgcttgatagctcaaagttatgccaaaaatatgggactctatggggagcgtgttggtgcccttagcattgtctgcaagtcatcagatgtggctagtaaggttgagagccaggtgaaacttgttgtgcgacccatgtactcgagcccacctattcatggagcatcaattgttgccaccattctgaaaagcagtgatatgtacaatgactggaccatcgagctgaaaggaatggctggccgcattattagcatgcgccaacacttatttgaagctctacaagctaaaggcacacctggtgattggagtcacattatcaaacagattgggatgttcacttttactggattgaacaaggagcaagttgccttcatgaccaaagagtttcacatttacatgacatctgacgggagaataagcatggcaggtctcagttcgaagacggtgcctcacctggttgaagctatacatgctgcagttacccgcgtcgcctaa

SEQ ID NO: 5025 - protein, 405 aa, Brassica napus
MESVFSNVVRAPEDPILGVTVAYNNDPSPAKLNLGVGAYRTEEGKPLVLDVVRRAEQQLVNDPSRVKEYIPIAGLADFNKLSAKLILGADSPAIQESRVATIQCLSGTGSLRVGAEFLKKHYHQSVIFIPKPTWGNHPKVFNLAGLSVEYYRYYDPSTRGLDFQGLLEDLGAAPSGAIVLLHACAHNPTGVDPTSEQWEQIRQLIRSKSLLPFFDSAYQGFASGSLDTDAHSVRTFVADGGECLIAQSYAKNMGLYGERVGALSIVCKSSDVASKVESQVKLVVRPMYSSPPIHGASIVATILKSSDMYNDWTIELKGMAGRIISMRQHLFEALQAKGTPGDWSHIIKQIGMFTFTGLNKEQVAFMTKEFHIYMTSDGRISMAGLSSKTVPHLVEAIHAAVTRVA

SEQ ID NO: 5026 - DNA, 1251 bp, Brassica napus
  CDS (1)..(1251)
atgagttccatcttgtcaaacgtccttcctgctccggaagatccttttctcagtgcttttaatcttctttgtatggtcacaaaacaggttatttttgcctgtagggatgatccttgtccagttaagttgaatttgagtgcgggtgcctatcgaaccgaggagggaaagcctcttgttcttgaggtggtgagaaaagcagagcaacagttagcgaatgacctatcttgtgacaagggttatctctcaattgatggacttgctgattttaacaaattgagcgccaagctgatcttaggtgatgatagtcatgcagtggatgagaatagagttgttactatccagtgtttgtctggtactggttctttgagagtcggagctgagtttctagcaaaacaccaccaacaacgagtcgttttcgttccaaatccaacttgggggaaccatccctttattttcacattggcgggtttaagtgtagagtatttccgttactatgatccgcaaacccgaggactcgacttcgaaggcatgctcgaggatcttggtgctgcaccgcctggagctattgtggtattgcaatcttgtgcgcataaccccacaggaattgacccaacactggaacaatgggaaaagattcgacaaattgtgaggtctaaaggtttattacccttctttgataatgcatatcagggttttgctagtgggaaccttgactcagatgcacaatcggtgcgtatgtttgttgctgatggaggtgaatgtttgatagctcaaagttttgccaaaaacatgggtctttatggtgagcgtattggtgctcttaccattgtatgcacctcacaagatgtggctaggaaaattcacagtcaagtgttacttgttgttagacctatgtatcttagcccaccaattcatggagcatccattgttaccacaattcttaaaaacagtgatatgtacaaggactggactatcgagctgaaaggcatggctgaccgcatcataagcatgcgccaacagttatatgaagctatacaagctagaggtacacccggtgattggagtcacattatcaaacagattgggatgttttcttttacaggactgaatgagaagcaagttcgttggatggccaaagaatatcacatttatattacttatgatgggaggataagcattgcaagtctaagttcaaagacagtgcctcaactcgctgatgctatacatgctgcagttacccgccttgcctaa

SEQ ID NO: 5027 - protein, 416 aa, Brassica napus
MSSILSNVLPAPEDPFLSAFNLLCMVTKQVIFACRDDPCPVKLNLSAGAYRTEEGKPLVLEVVRKAEQQLANDLSCDKGYLSIDGLADFNKLSAKLILGDDSHAVDENRVVTIQCLSGTGSLRVGAEFLAKHHQQRVVFVPNPTWGNHPFIFTLAGLSVEYFRYYDPQTRGLDFEGMLEDLGAAPPGAIVVLQSCAHNPTGIDPTLEQWEKIRQIVRSKGLLPFFDNAYQGFASGNLDSDAQSVRMFVADGGECLIAQSFAKNMGLYGERIGALTIVCTSQDVARKIHSQVLLVVRPMYLSPPIHGASIVTTILKNSDMYKDWTIELKGMADRIISMRQQLYEAIQARGTPGDWSHIIKQIGMFSFTGLNEKQVRWMAKEYHIYITYDGRISIASLSSKTVPQLADAIHAAVTRLA

SEQ ID NO: 5028 - DNA, 1284 bp, Glycine max
  CDS (1)..(1284)
atggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttcatgcttgtgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgttgctgacgctatccatgaggttacaaaatcattctag

SEQ ID NO: 5029 - protein, 427 aa, Glycine max
MAIRNSLTGQFLRRSSVAGARLMSSSSSWFRSIEPAPKDPILGVTEAFLADQSPNKVNVGVGAYRDDHGKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLHACAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVADAIHEVTKSF

SEQ ID NO: 5030 - DNA, 1374 bp, Brassica napus
  CDS (1)..(1374)
atgaaaactaacgacttctcttcttcatcttcgtcgtcgccaagcgatcgcaggatcggcgctctcctccgtcatctcaccgccgggacagatgcggatcgcgtgagctccgttttcgcttcgcctacgtcgggaggcgcgggaggttctgttttcgctcatctcgttcaagctcccgaggatgctattctcggggtgacaattgcatataacaaggaccccagcccaattaagcttaatttgggagttggtgcttaccgaactgaggaggggaaacctttggttcttaatgttgtgaggaaagctgagcagcagcttatcaatgacaggtcacggatcaaggactatcttcccattgttggattggttgagttcaacaagttaagcgctaagctcattttaggcgctgacagtcctgctattcgggagaatcgtgttacaaccgtggagtgtttgtctggtactggttccctgagagttggtggggaatttttggctaggcattatcatcagaaaacaatttatattcctcagccaacatggggaaaccatcccaaaattttcaccctcgctggcttgtcagtgaaaacttaccgctactatgatccatcaacacgtgggttgaactttcaaggtttattagaagaccttagtgctgccccacagggttcgatagtgcttctccatgcctgtgctcataacccaactggtgttgatccaacccttgaacaatgggagcaaatcaggaagttgatgcgttccaaaggattgatgccattctttgacagtgcttatcagggctttgcgagtggaagtctggatacagatgcgaaaccaattaggatgtttgttgctgatggaggagaattgctcgttgctcagagttatgcaaagaacatgggactctatggagaacgacttggagctctcagcattgtaagattcagcattgtatgcaaagcagcagatgtggcgggcagagttgaaagccagctgaaacttgtaataaggccaatgtactcaaaccctccgattcatggtgcatcgatcgtggctgtaatcctccgtgacaggaacttgttcaacgaatggactctggaactgaaagccatggccgatcgtatcatcagcatgaggaaacagcttttcgaggcattacgtgctcgaggcacgcctggagactggactcacatcatcaaacagatcggtatgtttaccttcacagggctaaacccagctcaagtctcctacatgactaaagagtaccacatctacatgacatccgacgggaggataagcatggctggtctgagctcgaagactgtaccgcaccttgcagacgctatccatgccgttgtcaccaaagccctctga

SEQ ID NO: 5031 - protein, 457 aa, Brassica napus
MKTNDFSSSSSSSPSDRRIGALLRHLTAGTDADRVSSVFASPTSGGAGGSVFAHLVQAPEDAILGVTIAYNKDPSPIKLNLGVGAYRTEEGKPLVLNVVRKAEQQLINDRSRIKDYLPIVGLVEFNKLSAKLILGADSPAIRENRVTTVECLSGTGSLRVGGEFLARHYHQKTIYIPQPTWGNHPKIFTLAGLSVKTYRYYDPSTRGLNFQGLLEDLSAAPQGSIVLLHACAHNPTGVDPTLEQWEQIRKLMRSKGLMPFFDSAYQGFASGSLDTDAKPIRMFVADGGELLVAQSYAKNMGLYGERLGALSIVRFSIVCKAADVAGRVESQLKLVIRPMYSNPPIHGASIVAVILRDRNLFNEWTLELKAMADRIISMRKQLFEALRARGTPGDWTHIIKQIGMFTFTGLNPAQVSYMTKEYHIYMTSDGRISMAGLSSKTVPHLADAIHAVVTKAL

SEQ ID NO: 5032 - DNA, 1362 bp, Brassica napus
  CDS (1)..(1362)
atggcttcatcaatgctgtctctcggttctacttctctgctacctcgcgtgattaacaaggataagctaaagcttggaacttccggttccaaccccttcctgaaagcaaagtcttttagcagggtgaccatgtcggttacagtcaagccttctcgctttgagggtatcactatggctccaccagaccctattcttggagtcagcgaagctttcaaagctgacactaacgagcttaagctcaatctcggtgttggtgcttatcgaactgaggaactccagccttatgtccttaatgttgttaaaaaggcggagaacctgatgttggagagaggagataacaaagagtatctcccaatcgaagggttggctgcattcaacaaggccactgctgagctgctgtttggagctggtcatcctgttattaaggaacaaaaggtggcaacaattcaaggtctttccggaacaggttcactgagactagcagcggctcttatcgagcgttattttcctggagctaaagtgcttatatctgcaccaacatggggtaaccacaagaacatcttcaacgacgccaaagttccctggtctgaataccgctactatgatcccaaaacaattggtttggactttgaagggatgatagcagatataaaggaagctccagaaggatcattcatactgctacacggatgtgctcacaacccaactggaatcgacccaacacctgaacagtgggtgaaaattgctgacgtcattcaagaaaagaaccacatcccatttttcgatgttgcataccagggctttgctagtggaagccttgacgaagacgcagcttccgtgagactatttgctgagcgtgggatggagtttttcgtcgctcagtcgtatagtaaaaacttgggtctttatgctgaaaggattggagctatcaacgtcgtctgctcatcagctgatgctgctacaagggtgaagagccagttgaaaaggatagctaggcctatgtactcgaacccaccggttcacggtgcgaggatcgtggctaatgtagtgggagatgcagctatgttcaacgagtggaaagcagagatggaaatgatggcggggaggattaagacggtgagacagcagctgtacgacagcctcgtttcgaaggataagagcggcaaagactggtcgtttattctgaagcagattggcatgttctcattcaccggtctcaacaaagctcagagtgataacatgacggacaagtggcatgtgtacatgactaaagacgggaggatatcgttggctggactgtctatggcgaaatgcgagtaccttgctgatgccatcatcgactcgtaccataacgtaagctga

SEQ ID NO: 5033 - protein, 453 aa, Brassica napus
MASSMLSLGSTSLLPRVINKDKLKLGTSGSNPFLKAKSFSRVTMSVTVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDAAMFNEWKAEMEMMAGRIKTVRQQLYDSLVSKDKSGKDWSFILKQIGMFSFTGLNKAQSDNMTDKWHVYMTKDGRISLAGLSMAKCEYLADAIIDSYHNVS

SEQ ID NO: 5034 - DNA, 1281 bp, Triticum aestivum
  CDS (1)..(1281)
atggcgatgtctcgcgccgcggcagcggtcgggcggcgccggtgcgggccgcgcctgcccgcggcgaggtccatggcgtcgtggttcggccacgtggagccggccgccaaggaccccatcctcggcgtcaccgaggccttcctcgccgacccctcgccggacaaagtgaacgtcggcgtcggtgcgtaccgggacgacgacgggaagcccgtggtgctcgagtgcgtgcgcgaggcggagcggcgcatcgccgggagcaccaacatggagtaccttccaatgggaggaagcgtgaagatgatcgaggagtcgctgaagctggcatacggggaggattctgagttcatcaaggacaagaggattgcggcagtgcaggctctttcagggactggtgcatgtcgcctctttgcagatttccagaaacgcttcttgccggattcacagatctacatacctacgcctacatggtcaaaccatcacaacatttggagggatgcccaggtaccacaaagaacatttgcctactaccacccggaatcaagaggactggactttgcaggcctaatggatgatatcaagaacgctccagagggttccttctttttgcttcatgcatgtgctcacaatcccactggggtcgatccttctgaggaacagtggagagagatatctcaacaattcaaggtgaagaaccatttcccatttttcgacatggcataccaaggatttgccagtggtgacccagagagagatgccaaggcaattcggatctttctcgaagatggacatcaaattggatgtgcacagtcatatgcaaaaaacatgggactttatggccaaagagcaggatgccttagtattctctgcgacgatgaaatacaagcagttgatgtgaagagccagttacaacagattgccagacctatgtacagcaacccaccccttcacggcgcactaattgtttccactatccttggtgatccagcactgaaaagcttatggctgaaagaggtcaagggtatggctgatcgcattattggaatgcgaaaagcacttaaggagagccttgaaaagttgggttcaccattatcatgggaacatattactaatcagattggcatgttttgctacagcgggatgacacctgaacaagttgatcgcttaacaaatgaatttcacatatacatgactcgtaatggcaggataagcatggctggtgtaacaacaggaaatgtcgcatatttggctaacgctattcatgaggtcactaagccaatttaa

SEQ ID NO: 5035 - protein, 426 aa, Triticum aestivum
MAMSRAAAAVGRRRCGPRLPAARSMASWFGHVEPAAKDPILGVTEAFLADPSPDKVNVGVGAYRDDDGKPVVLECVREAERRIAGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPESRGLDFAGLMDDIKNAPEGSFFLLHACAHNPTGVDPSEEQWREISQQFKVKNHFPFFDMAYQGFASGDPERDAKAIRIFLEDGHQIGCAQSYAKNMGLYGQRAGCLSILCDDEIQAVDVKSQLQQIARPMYSNPPLHGALIVSTILGDPALKSLWLKEVKGMADRIIGMRKALKESLEKLGSPLSWEHITNQIGMFCYSGMTPEQVDRLTNEFHIYMTRNGRISMAGVTTGNVAYLANAIHEVTKPI

SEQ ID NO: 5036 - DNA, 1386 bp, Zea mays
  CDS (1)..(1386)
atggcccctgctaacgtgcgcgcggcgcaggcgcaggcgcaggcccccagcgccgaccgcaggttaagtacgctagtggggcacctgctgccttcctccccacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccatgaaggtcaacctcggggttggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcatggaagacctcggttctgctccttcaggttcaattgtactgctgcatgcctgtgcccacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaactgctcatggctcagagctacgctaagaacatgggattgtatggagagcgtgttggcgctttgagcattgtatgtagaagtgccgatgtagctgttagggttgaaagtcaactcaaacttgtcatcaggcctatgtattcaaaccctcctcttcatggtgcctctattgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtggcattcatgaggcaggaataccacatttatatgacatctgatgggaggatcagcatggccggtttgagcatgaggactgtgccccatcttgcagatgccatacacgctgcagttactcaactgaaatga

SEQ ID NO: 5037 - protein, 461 aa, Zea mays
MAPANVRAAQAQAQAPSADRRLSTLVGHLLPSSPRRAAADTSATSTLESFPTMASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 5038 - DNA, 1383 bp, Zea mays
  CDS (1)..(1383)
atggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccatacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtacaggtactatgaccccaagactgttgggttggattttgagggaatgatagctgatattgaggctgctcctgaaggatcttttgttctgctacatggttgtgctcacaacccaactggaatagacccaactcctgaacagtgggagaaaattgcagatgtcattcaagagaaaaagcatatgccattctttgatgttgcatatcaaggttttgccagtggaagccttgatgaagatgcattttctgtcaggctttttgttaagcgtggcatggaagtgtttgttgcacaatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaagaatgtaagacagaagctctacgacagtttgtctgccaaggataagagcggcaaggactggtctttcattctgaggcagattggcatgttctcctacaccggcttgaacaaagcacagagtgacaacatgacggataaatggcatatttacatgaccaaggatgggcggatctccttagctgggctgtccctggctaagtgtgattatcttgccgacgccatcatcgattccttccataatgtgaactag

SEQ ID NO: 5039 - protein, 460 aa, Zea mays
MATAAAFSVSSPAASAVAARSKVFGGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPIMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 5040 - DNA, 1380 bp, Zea mays
  CDS (1)..(1380)
atggccaccgccgccgccttctctgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaggctgctcctgaaggttcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtttatattctgaaagggttggtgcaataaatgtcgtgtgctcagcaccagaagttgcagatagggtaaagagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactag

SEQ ID NO: 5041 - protein, 459 aa, Zea mays
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPTMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 5042 - DNA, 1230 bp, Zea mays
  CDS (1)..(1230)
atggcgtcgcagggatcctccgtcttcgccgcactcgagcaggccccggaggaccccatcctcggagtgaccgttgcctacaacaaggatcccagccccatgaaggtcaacctcggggttggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcatggaagacctcggttctgctccttcaggttcaattgtactgctgcatgcctgtgcccacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaactgctcatggctcagagctacgctaagaacatgggattgtatggagagcgtgttggcgctttgagcattgtatgtagaagtgccgatgtagctgttagggttgaaagtcaactcaaacttgtcatcaggcctatgtattcaaaccctcctcttcatggtgcctctattgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtggcattcatgaggcaggaataccacatttatatgacatctgatgggaggatcagcatggccggtttgagcatgaggactgtgccccatcttgcagatgccatacacgctgcagttactcaactgaaatga

SEQ ID NO: 5043 - protein, 409 aa, Zea mays
MASQGSSVFAALEQAPEDPILGVTVAYNKDPSPMKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLMEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCRSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 5044 - DNA, 1374 bp, Hordeum vulgare
  CDS (1)..(1374)
atggcctccgccctctccgcgccggcggcctccgccgtcgccgccgccgccgcccggcgcaaggtgttcggcggaggaaggaacgacgggagggccgggtgccgcgtcgggatcgcgaggaagaatactggccacatagcgatggcacttacagtacacgcttctcgctttgaaggagtgtcgatggcccctccagacccgatccttggggtctcggaagcgtttaaagcagatacaagtgatctgaagctcaaccttggtgttggcgcctacagaacggaagagctacagcccgcagtcctcaacgttgtcaagaaggctgaaaaacttatgctagagaaaggagaaaacaaagagtatctgcctattgaaggctttgctgcatttaacaaagcaactgcagatctattgcttggagctgacaatcctgtcatcaagcaaggacgggttgctactcttcagtctctctcagggactggatcattacgccttgctgcagcatttattcagagatacttccctgatgcaaaagtacttatatcatctcccacatggggaaaccacaaaaacatattcaatgatgctagggtgccatggtcagaataccggtattatgatcccaagactgttgggctggattttgaaggaatgatagctgacatacaggctgccccagaagggtcttttgttctgctacatggttgtgctcacaatccaactggaatagacccaactcctcaacagtgggagaaactggcagatctgattgaagagaaaaaacatatgcctttctttgatgttgcctatcaaggttttgccagtggaagccttgatgaagatgcatcctccgtcaggctttttgttaagcgtggcctggaagtgtttgttgcacagtcttacagcaagaaccttggtctatatgcagaaaggatcggtgcgataaatgtcatttgcacagcaccggaagttgcagatagggtgaagagccagttgaagcgattggcgcggcccatgtactcaaacccacctattcacggtgccaagatcgtcgccaacgttgttggagaccctaccatgttcggtgagtggaaagaagagatggaacaaatggcagggcggatcaagaatgttcggcagaagctttacgatagcttgactgcaaaggaccagtctggcaaggactggtctttcattcttagccagataggcatgttctccttcacgggcttgaacagaacccagagcgataacatgaccgataaatggcacatatatatgaccaaggacgggaggatttcgttggcagggctgaacctggcgaaatgcgagtaccttgctgatgccatcatcgactccttccacaatgtcaactag

SEQ ID NO: 5045 - protein, 457 aa, Hordeum vulgare
MASALSAPAASAVAAAAARRKVFGGGRNDGRAGCRVGIARKNTGHIAMALTVHASRFEGVSMAPPDPILGVSEAFKADTSDLKLNLGVGAYRTEELQPAVLNVVKKAEKLMLEKGENKEYLPIEGFAAFNKATADLLLGADNPVIKQGRVATLQSLSGTGSLRLAAAFIQRYFPDAKVLISSPTWGNHKNIFNDARVPWSEYRYYDPKTVGLDFEGMIADIQAAPEGSFVLLHGCAHNPTGIDPTPQQWEKLADLIEEKKHMPFFDVAYQGFASGSLDEDASSVRLFVKRGLEVFVAQSYSKNLGLYAERIGAINVICTAPEVADRVKSQLKRLARPMYSNPPIHGAKIVANVVGDPTMFGEWKEEMEQMAGRIKNVRQKLYDSLTAKDQSGKDWSFILSQIGMFSFTGLNRTQSDNMTDKWHIYMTKDGRISLAGLNLAKCEYLADAIIDSFHNVN

SEQ ID NO: 5046 - DNA, 1293 bp, Zea mays
  CDS (1)..(1293)
atggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcactgaagctggcgtacggagaagattctgacttcatcaaagataagaggatagcagcggtgcaggcgctttcaggcactggtgcctgccggctctttgctgatttccaaaagcgttttttgccggattcgcagatctacataccaacaccaacgtggtccaaccatcacaatatttggagggatgctcaagtgccacagaagacattcacatactaccatccagagtcaagagggcttgatttctcaggattgatgaatgaaatcaagaatgctccagatggttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggaggataagcatggctggtgttacgacaggaaatgttggttacctagcaaatgcaattcatgaggttaccaaaccaaattga

SEQ ID NO: 5047 - protein, 430 aa, Zea mays
MAMLSRAASSAARRPLLPPPRLLAVRAMASSLFGHVEPAPKDPILGVTEAFLADPSSDKVNVGVGAYRDDNGQPVVLSCVREAERRIAGNLNMEYLPMGGSVKMIEESLKLAYGEDSDFIKDKRIAAVQALSGTGACRLFADFQKRFLPDSQIYIPTPTWSNHHNIWRDAQVPQKTFTYYHPESRGLDFSGLMNEIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKSLWLKEVKGMADRIIGMRKALKENLEKLGSPLSWDHITNQIGMFCYSGMTPEQVDRLTNEYHIYMTRNGRISMAGVTTGNVGYLANAIHEVTKPN

SEQ ID NO: 5048 - DNA, 1359 bp, Brassica napus
  CDS (1)..(1359)
atgaaaactaacgacttctcttcttcatcttcgtcgtcgccaagcgatcgcaggatcggcgctctcctccgtcatctcaccgccgggacagatgcggatcgcgtgagctccgttttcgcctcgcctacgtcgggaggcgcgggaggttctgttttcgctcatctcgttcaagctcccgaggatgctattctcggggtgacaattgcatataacaaagaccccagcccaatcaagctgaatttgggagttggtgcttaccgaactgaggaggggaaacctttggttcttaatgttgtgaggaaagctgagcagcagcttatcaatgacaggtcacggatcaaggagtatcttcccattgttggattggttgagttcaacaagttaagcgctaagctcatattaggcgctgacagtcctgctattcgggagaatcgggttacaaccgtggagtgtttgtctggtactggttccctgagagttggaggggaatttttggccaggcattatcatcagaaaacaatttatattcctcagccaacatggggaaaccatcccaaaattttcaccctcgctggcttgtcagtgaaaacttaccgctactatgatccatcaacacgtgggttgaactttcaaggtttattagaagaccttagtgctgccccacagggttcgatagtgcttctccatgcctgtgctcataacccaactggtgttgatcaaacccttgaacaatgggagcaaatcaggaagttgatgcgttccaaaggattgatgccattctttgacagtgcttatcagggctttgcgagtggaagtctggatacagatgcgaaaccaattaggatgtttgttgctgatggaggagaattgctcgttgctcagagttatgcaaagaacatgggactctatggagaacgagttggagctctcagcattgtatgcaaagcagcagatgtggcgggcagagttgaaagccagctgaaacttgtaataaggccaatgtactcaaaccctccgattcatggtgcatcgatcgtggctgtaatcctccgtgacaggaacttgttcaacgaatggactctggaactgaaagccatggccgatcgtatcatcagcatgaggaaacagcttttcgaggcattacgtgctcgaggcacgcctggagactggactcacatcatcaaacagatcggtatgtttaccttcacagggctaaacccagctcaagtctcctacatgactaaagagtaccacatctacatgacatccgacgggaggataagcatggctggtctgagctcgaagactgtaccgcaccttgcagacgctatccatgccgttgtcaccaaagccctctga

SEQ ID NO: 5049 - protein, 452 aa, Brassica napus
MKTNDFSSSSSSSPSDRRIGALLRHLTAGTDADRVSSVFASPTSGGAGGSVFAHLVQAPEDAILGVTIAYNKDPSPIKLNLGVGAYRTEEGKPLVLNVVRKAEQQLINDRSRIKEYLPIVGLVEFNKLSAKLILGADSPAIRENRVTTVECLSGTGSLRVGGEFLARHYHQKTIYIPQPTWGNHPKIFTLAGLSVKTYRYYDPSTRGLNFQGLLEDLSAAPQGSIVLLHACAHNPTGVDQTLEQWEQIRKLMRSKGLMPFFDSAYQGFASGSLDTDAKPIRMFVADGGELLVAQSYAKNMGLYGERVGALSIVCKAADVAGRVESQLKLVIRPMYSNPPIHGASIVAVILRDRNLFNEWTLELKAMADRIISMRKQLFEALRARGTPGDWTHIIKQIGMFTFTGLNPAQVSYMTKEYHIYMTSDGRISMAGLSSKTVPHLADAIHAVVTKAL

SEQ ID NO: 5050 - DNA, 1218 bp, Brassica napus
  CDS (1)..(1218)
atggagtccgtcttctcaaacgtcgttcgtgctcccgaagatcctattctcggtgtgacggttgcttacaataatgatccaagcccagctaagctcaatttgggtgtcggtgcctatcgaactgaggaagggaagccacttgttcttgacgtggtgcgaagggcggagcaacagcttgtgaacgatccgtcccgggtcaaggaatacattcctattgctggacttgctgattttaacaaacttagcgctaagctcatcttaggtgctgatagtcctgcaattcaagagagtagagttgctacaatccagtgcttgtctggtactgggtcattgagagttggggctgagtttctcaaaaaacactaccaccaaagtgtcattttcattccgaaaccaacttgggggaaccatcccaaagttttcaacctggctggcttgtctgtggagtactaccgttactatgatccctcgacccgtggacttgacttccaaggcttactcgaggatcttggtgctgcaccatctggagcgattgtcttacttcatgcatgtgctcacaatcccactggagttgacccaacctctgaacagtgggaacagattcggcaactaataagatctaaaagcttgttaccgttttttgatagtgcatatcagggttttgctagtggtagcctagacacagatgcacattcagtccgcacctttgttgctgatggcggtgaatgcttgatagctcaaagttatgccaaaaatatgggactctatggagagcgtgttgcagcccttagcattgtctgcaagtcaacagatgtggctagtaaggttgagagccaggtgaaacttgttgtgcgtcccatgtattcgagcccacctattcatggagcatcaattgttgccaccattctcaaaagcagcgatatgtacaacgactggaccatcgagctgaaaggaatggctgaccgcataattagcatgcgccaacagttatttgaagctctacaagccaaaggaacacctggtgattggagtcacattatcaaacagattggcatgtttacttttaccggattgaacaaggagcaagttgccttcatgaccaaagagtatcacatttacatgacatctgacgggagaataagcatggcaggtctcagtacgaagacggtgcctcacctcgttgaagctatccatgctgcagttacccgcgtcgcctaa

SEQ ID NO: 5051 - protein, 405 aa, Brassica napus
MESVFSNVVRAPEDPILGVTVAYNNDPSPAKLNLGVGAYRTEEGKPLVLDVVRRAEQQLVNDPSRVKEYIPIAGLADFNKLSAKLILGADSPAIQESRVATIQCLSGTGSLRVGAEFLKKHYHQSVIFIPKPTWGNHPKVFNLAGLSVEYYRYYDPSTRGLDFQGLLEDLGAAPSGAIVLLHACAHNPTGVDPTSEQWEQIRQLIRSKSLLPFFDSAYQGFASGSLDTDAHSVRTFVADGGECLIAQSYAKNMGLYGERVAALSIVCKSTDVASKVESQVKLVVRPMYSSPPIHGASIVATILKSSDMYNDWTIELKGMADRIISMRQQLFEALQAKGTPGDWSHIIKQIGMFTFTGLNKEQVAFMTKEYHIYMTSDGRISMAGLSTKTVPHLVEAIHAAVTRVA

SEQ ID NO: 5052 - DNA, 1362 bp, Brassica napus
  CDS (1)..(1362)
atggcttcttcaatgctgtctctcggttctacttctctgctacctcgcgagattaacaaggataagctaaagcttggaacttccggttccaaccccttcctgaaagcaaagtcttttagcagggtgaccatgtcggttacagtcaagccttctcgctttgagggtatcactatggctccaccagaccctattcttggagtcagcgaagctttcaaagctgacactaacgagcttaagctcaatctcggtgttggtgcttatcgaactgaggaactccagccttatgtccttaatgttgttaaaaaggcggagaacctgatgttggagagaggagataataaagagtatctaccaatagaagggttggctgcattcaacaaggccactgctgagctgctgttcggagctggtcatcctgttattaaggaacaaaaagtggcaacaattcaaggtctttccggaacaggttcactgagactagcagcggctcttatcgagcgttacttccctggagcaaaagtgctgatatcagcaccaacatggggtaaccacaagaacatcttcaacgacgccaaagttccatggtctgaataccgctactatgatccaaaaacaattggtttggactttgaggggatgatacaagatattaaggaagctccagaaggatcattcattttgcttcatggatgtgctcacaacccaactgggattgacccaacaccagaacaatgggtgaaaatagctgatgtcattcaggagaagaaccatataccgtttttcgatgttgcataccagggatttgctagtggaagccttgatgaagatgcagcatctgtgagattatttgctgagcgtggaatggagttttttgttgctcagtcatatagtaaaaacttgggtctttatgctgaaagaattggagcaatcaacgtcgtctgctcatcagccgatgctgctacaagggtgaagagccagttgaaaaggatagctaggcctatgtactcgaacccaccggttcacggggcgaggatcgtggctaatgtggtgggagatgcaactatgtttggtgagtggaaagcagagatggaaatgatggcggggaggataaagactgtgagacaaaggttgtatgacagcctcgtttcaaaagacaagagtggtaaggactggtcgtttattctgaagcaaattggcatgttctcattcactggcctcaacaaagctcagagtgataacatgacgaacaagtggcatgtgtacatgactaaagacgggaggatatcgttggctggactgtctatggcgaaatgcgagtaccttgctgatgccatcatcgactcgtaccataacgtaagctga

SEQ ID NO: 5053 - protein, 453 aa, Brassica napus
MASSMLSLGSTSLLPREINKDKLKLGTSGSNPFLKAKSFSRVTMSVTVKPSRFEGITMAPPDPILGVSEAFKADTNELKLNLGVGAYRTEELQPYVLNVVKKAENLMLERGDNKEYLPIEGLAAFNKATAELLFGAGHPVIKEQKVATIQGLSGTGSLRLAAALIERYFPGAKVLISAPTWGNHKNIFNDAKVPWSEYRYYDPKTIGLDFEGMIQDIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDATMFGEWKAEMEMMAGRIKTVRQRLYDSLVSKDKSGKDWSFILKQIGMFSFTGLNKAQSDNMTNKWHVYMTKDGRISLAGLSMAKCEYLADAIIDSYHNVS

SEQ ID NO: 5054 - DNA, 1374 bp, Brassica napus
  CDS (1)..(1374)
atgaaaactaacgacttctcttcttcatcttcgtcgtcgccaagcgatcgcaggatcggcgctctcctccgtcatctcaccgccgggacagatgcggatcgcgtgagctccgttttcgcttcgcctacgtcgggaggcgcgggaggttctgttttcgctcatctcgttcaagctcccgaggatgctattctcggggtgacaattgcatataacaaggaccccagcccaattaagcttaatttgggagttggtgcttaccgaactgaggaggggaaacctttggttcttaatgttgtgaggaaagctgagcagcagcttatcaatgacaggtcacggatcaaggagtatcttcccattgttggattggttgagttcaacaagttaagcgctaagctcattttaggcgctgacagtcctgctattcgggagaatcgtgttacaaccgtggagtgtttgtctggtactggttccctgagagttggtggggaatttttggctaggcattatcatcagaaaacaatttatattcctcagccaacatggggaaaccatcccaaaattttcaccctcgctggcttgtcagtgaaaacttaccgctactatgatccatcaacacgtgggttgaactttcaaggtttattagaagaccttagtgctgccccacagggttcgatagtgcttctccatgcctgtgctcataacccaactggtgttgatccaacccttgaacaatgggagcaaatcaggaagttgatgcgttccaaaggattgatgccattctttgacagtgcttatcagggctttgcgagtggaagtctggatacagatgcgaaaccaattaggatgtttgttgctgatggaggagaattgctcgttgctcagagttatgcaaagaacatgggactctatggagaacgacttggagctctcagcattgtaagattcagcattgtatgcaaagcagcagatgtggcgggcagagttgaaagccagctgaaacttgtaataaggccaatgtactcaaaccctccgattcatggtgcatcgatcgtggctgtaatcctccgtgacaggaacttgttcaacgaatggactctggaactgaaagccatggccgatcgtatcatcagcatgaggaaacagcttttcgaggcattacgtgctcgaggcacgcctggagactggactcacatcatcaaacagatcggtatgtttaccttcacagggctaaacccagctcaagtctcctacatgactaaagagtaccacatctacatgacatccgacgggaggataagcatggctggtctgagctcgaagactgtaccgcaccttgcagacgctatccatgccgttgtcaccaaagccctctga

SEQ ID NO: 5055 - protein, 457 aa, Brassica napus
MKTNDFSSSSSSSPSDRRIGALLRHLTAGTDADRVSSVFASPTSGGAGGSVFAHLVQAPEDAILGVTIAYNKDPSPIKLNLGVGAYRTEEGKPLVLNVVRKAEQQLINDRSRIKEYLPIVGLVEFNKLSAKLILGADSPAIRENRVTTVECLSGTGSLRVGGEFLARHYHQKTIYIPQPTWGNHPKIFTLAGLSVKTYRYYDPSTRGLNFQGLLEDLSAAPQGSIVLLHACAHNPTGVDPTLEQWEQIRKLMRSKGLMPFFDSAYQGFASGSLDTDAKPIRMFVADGGELLVAQSYAKNMGLYGERLGALSIVRFSIVCKAADVAGRVESQLKLVIRPMYSNPPIHGASIVAVILRDRNLFNEWTLELKAMADRIISMRKQLFEALRARGTPGDWTHIIKQIGMFTFTGLNPAQVSYMTKEYHIYMTSDGRISMAGLSSKTVPHLADAIHAVVTKAL

SEQ ID NO: 5056 - DNA, 1392 bp, Glycine max
  CDS (1)..(1392)
atggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggtaaagagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcaggattgtcgttggctaaatgcgaataccttgcggatgctattattgattcatatcataatgtcagctga

SEQ ID NO: 5057 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARVKSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 5058 - DNA, 1383 bp, Zea mays
  CDS (1)..(1383)
atggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccatacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtacaggtactatgaccccaagactgttgggttggattttgagggaatgatagctgatattgaggctgctcctgaaggatcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtctatattctgaaagggttggtgcaataaatgtcgtgtgctcagcaccagaagttgcagatagggtaaagagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactag

SEQ ID NO: 5059 - protein, 460 aa, Zea mays
MATAAAFSVSSPAASAVAARSKVFGGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPTMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 5060 - DNA, 1380 bp, Zea mays
  CDS (1)..(1380)
atggccaccgccgccgccttctctgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaggctgctcctgaaggttcttttgttctgctacatggttgtgctcacaacccaactggaatagacccaactcctgaacagtgggagaaaattgcagatgtcattcaagagaaaaagcatatgccattctttgatgttgcatatcaaggttttgccagtggaagccttgatgaagatgcattttctgtcaggctttttgttaagcgtggcatggaagtgtttgttgcacaatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaagaatgtaagacagaagctctacgacagtttgtctgccaaggataagagcggcaaggactggtctttcattctgaggcagattggcatgttctcctacaccggcttgaacaaagcacagagtgacaacatgacggataaatggcatatttacatgaccaaggatgggcggatctccttagctgggctgtccctggctaagtgtgattatcttgccgacgccatcatcgattccttccataatgtgaactag

SEQ ID NO: 5061 - protein, 459 aa, Zea mays
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINQGLVATLQSLSGTGSLRLAAAFIQRYFPEAKVLISSPTWGNHKNIFNDARVPWSEYRYYDPKTVGLDFEGMIADIEAAPEGSFVLLHGCAHNPTGIDPTPEQWEKIADVIQEKKHMPFFDVAYQGFASGSLDEDAFSVRLFVKRGMEVFVAQSYSKNLGLYSERVGAINVVCSAPEVADRVKSQLKRLARPMYSNPPIHGAKIVANVVGDPIMFGEWKQEMELMAGRIKNVRQKLYDSLSAKDKSGKDWSFILRQIGMFSYTGLNKAQSDNMTDKWHIYMTKDGRISLAGLSLAKCDYLADAIIDSFHNVN

SEQ ID NO: 5062 - DNA, 26 bp, Artificial sequence
  primer
atgaacaaaagaacacaggaatacaa

SEQ ID NO: 5063 - DNA, 28 bp, Artificial sequence
  primer
ttacaatttagcttcaatagtatagaag

SEQ ID NO: 5064 - protein, 462 aa, Artificial sequence
  consensus sequence
  Variant (2)..(2): Xaa in position 2 is any amino acid
  Variant (4)..(4): Xaa in position 4 is any amino acid
  Variant (7)..(14): Xaa in position 7 to 14 is any amino acid
  Variant (15)..(25): Xaa in position 15 to 25 is any or no amino acid
  Variant (27)..(30): Xaa in position 27 to 30 is any amino acid
  Variant (32)..(33): Xaa in position 32 to 33 is any amino acid
  Variant (35)..(36): Xaa in position 35 to 36 is any amino acid
  Variant (38)..(38): Xaa in position 38 is any amino acid
  Variant (40)..(42): Xaa in position 40 to 42 is any amino acid
  Variant (43)..(43): Xaa in position 43 is any or no amino acid
  Variant (45)..(50): Xaa in position 45 to 50 is any amino acid
  Variant (51)..(51): Xaa in position 51 is any or no amino acid
  Variant (53)..(54): Xaa in position 53 to 54 is any amino acid
  Variant (57)..(66): Xaa in position 57 to 66 is any amino acid
  Variant (67)..(70): Xaa in position 67 to 70 is any or no amino acid
  Variant (72)..(75): Xaa in position 72 to 75 is any amino acid
  Variant (77)..(78): Xaa in position 77 to 78 is any amino acid
  Variant (79)..(86): Xaa in position 79 to 86 is any or no amino acid
  Variant (88)..(89): Xaa in position 88 to 89 is any amino acid
  Variant (91)..(95): Xaa in position 91 to 95 is any amino acid
  Variant (96)..(106): Xaa in position 96 to 106 is any or no amino acid
  Variant (108)..(111): Xaa in position 108 to 111 is any amino acid
  Variant (113)..(115): Xaa in position 113 to 115 is any amino acid
  Variant (117)..(117): Xaa in position 117 is any amino acid
  Variant (121)..(139): Xaa in position 121 to 139 is any amino acid
  Variant (140)..(168): Xaa in position 140 to 168 is any or no amino acid
  Variant (170)..(170): Xaa in position 170 is any amino acid
  Variant (172)..(172): Xaa in position 172 is any amino acid
  Variant (175)..(177): Xaa in position 175 to 177 is any amino acid
  Variant (179)..(181): Xaa in position 179 to 181 is any amino acid
  Variant (183)..(187): Xaa in position 183 to 187 is any amino acid
  Variant (188)..(194): Xaa in position 188 to 194 is any or no amino acid
  Variant (196)..(196): Xaa in position 196 is any amino acid
  Variant (198)..(222): Xaa in position 198 to 222 is any amino acid
  Variant (223)..(231): Xaa in position 223 to 231 is any or no amino acid
  Variant (234)..(234): Xaa in position 234 is any amino acid
  Variant (236)..(236): Xaa in position 236 is any amino acid
  Variant (242)..(242): Xaa in position 242 is any amino acid
  Variant (244)..(247): Xaa in position 244 to 247 is any amino acid
  Variant (250)..(262): Xaa in position 250 to 262 is any amino acid
  Variant (264)..(265): Xaa in position 264 to 265 is any amino acid
  Variant (267)..(267): Xaa in position 267 is any amino acid
  Variant (273)..(274): Xaa in position 273 to 274 is any amino acid
  Variant (276)..(278): Xaa in position 276 to 278 is any amino acid
  Variant (279)..(279): Xaa in position 279 is any or no amino acid
  Variant (282)..(284): Xaa in position 282 to 284 is any amino acid
  Variant (286)..(298): Xaa in position 286 to 298 is any amino acid
  Variant (299)..(304): Xaa in position 299 to 304 is any or no amino acid
  Variant (306)..(307): Xaa in position 306 to 307 is any amino acid
  Variant (309)..(311): Xaa in position 309 to 311 is any amino acid
  Variant (314)..(314): Xaa in position 314 is any amino acid
  Variant (317)..(317): Xaa in position 317 is any amino acid
  Variant (319)..(334): Xaa in position 319 to 334 is any amino acid
  Variant (335)..(348): Xaa in position 335 to 348 is any or no amino acid
  Variant (350)..(354): Xaa in position 350 to 354 is any amino acid
  Variant (356)..(357): Xaa in position 356 to 357 is any amino acid
  Variant (360)..(360): Xaa in position 360 is any amino acid
  Variant (363)..(363): Xaa in position 363 is any amino acid
  Variant (367)..(368): Xaa in position 367 to 368 is any amino acid
  Variant (370)..(372): Xaa in position 370 to 372 is any amino acid
  Variant (374)..(376): Xaa in position 374 to 376 is any amino acid
  Variant (377)..(378): Xaa in position 377 to 378 is any or no amino acid
  Variant (380)..(381): Xaa in position 380 to 381 is any amino acid
  Variant (382)..(382): Xaa in position 382 is any or no amino acid
  Variant (384)..(385): Xaa in position 384 to 385 is any amino acid
  Variant (387)..(389): Xaa in position 387 to 389 is any amino acid
  Variant (391)..(392): Xaa in position 391 to 392 is any amino acid
  Variant (395)..(397): Xaa in position 395 to 397 is any amino acid
  Variant (399)..(404): Xaa in position 399 to 404 is any amino acid
  Variant (406)..(414): Xaa in position 406 to 414 is any amino acid
  Variant (415)..(423): Xaa in position 415 to 423 is any or no amino acid
  Variant (425)..(425): Xaa in position 425 is any amino acid
  Variant (427)..(429): Xaa in position 427 to 429 is any amino acid
  Variant (432)..(434): Xaa in position 432 to 434 is any amino acid
  Variant (437)..(439): Xaa in position 437 to 439 is any amino acid
  Variant (442)..(443): Xaa in position 442 to 443 is any amino acid
  Variant (445)..(450): Xaa in position 445 to 450 is any amino acid
  Variant (452)..(455): Xaa in position 452 to 455 is any amino acid
  Variant (458)..(460): Xaa in position 458 to 460 is any amino acid
PXDXILXXXXXXXXXXXXXXXXXXXDXXXXKXXLXXGXYXXXXGXXXXXXXVXXAEXXXXXXXXXXXXXXYXXXXGXXXXXXXXXXLXXGXXXXXXXXXXXXXXXXRXXXXQXXXGXGALXXXXXXXXXXXXXXXXXXXXXXXXXXXXXXXXXXXXXXXXXXXXXXXXPXWXNHXXXFXXXGXXXXXXXXXXXXYXYXXXXXXXXXXXXXXXXXXXXXXXXXXXXXXXXXXLHXCXHNPTGXDXXXXQWXXXXXXXXXXXXXPXXDXAYQGFXXGXXXXDAXXXRXXXXXXXXXXXXXXXXXXXSXXKXXXLYXERXGXXXXXXXXXXXXXXXXXXXXXXXXXXXXXXQXXXXXRXXYSXPPXHGAXXVXXXLXXXXXLXXXWXXEXXXMXXRIXXXRXXXXXXLXXXXXXXXXXXXXXXXXXQXGXXXMFXXXGLXXXQVXXLXXXXXXYXXXXGRXXXAG

SEQ ID NO: 5065 - protein, 43 aa, Artificial sequence
  protein pattern
  Variant (2)..(2): Xaa in position 2 is any or no amino acid
  Variant (4)..(4): Xaa in position 4 is Ala, Gly, Pro or Ser
  Variant (6)..(6): Xaa in position 6 is Ala or Cys
  Variant (12)..(12): Xaa in position 12 is any amino acid
  Variant (14)..(14): Xaa in position 14 is any amino acid
  Variant (15)..(15): Xaa in position 15 is Ala, Asp, Glu, Gly, Asn, Gln, Ser or Thr
  Variant (16)..(18): Xaa in position 16 to 18 is any amino acid
  Variant (20)..(21): Xaa in position 20 to 21 is any amino acid
  Variant (22)..(22): Xaa in position 22 is Ile, Leu or Val
  Variant (23)..(32): Xaa in position 23 to 32 is any amino acid
  Variant (33)..(33): Xaa in position 33 is Ala, Ile, Pro or Val
  Variant (34)..(35): Xaa in position 34 to 35 is any amino acid
  Variant (37)..(37): Xaa in position 37 is any amino acid
  Variant (42)..(42): Xaa in position 42 is Phe, Leu or Met
  Variant (43)..(43): Xaa in position 43 is Ala, Asp, Glu, Gly, Asn or Ser
LXHXCXHNPTGXDXXXXXWXXXXXXXXXXXXXXXXDXAYQGXX

SEQ ID NO: 5066 - protein, 14 aa, Artificial sequence
  protein pattern
  Variant (2)..(2): Xaa in position 2 is any amino acid
  Variant (3)..(3): Xaa in position 3 is Ala or Ser
  Variant (5)..(5): Xaa in position 5 is Asn or Ser
  Variant (6)..(6): Xaa in position 6 is any amino acid
  Variant (7)..(7): Xaa in position 7 is Gly or Ser
  Variant (8)..(8): Xaa in position 8 is Phe, Ile, Leu, Met or Val
  Variant (10)..(10): Xaa in position 10 is any amino acid
  Variant (13)..(13): Xaa in position 13 is any amino acid
SXXKXXXXYXERXG

SEQ ID NO: 5067 - protein, 14 aa, Artificial sequence
  protein pattern
  Variant (2)..(2): Xaa in position 2 is any amino acid
  Variant (6)..(6): Xaa in position 6 is any amino acid
  Variant (7)..(7): Xaa in position 7 is Phe or Tyr
  Variant (8)..(8): Xaa in position 8 is any amino acid
  Variant (10)..(12): Xaa in position 10 to 12 is any amino acid
  Variant (13)..(13): Xaa in position 13 is any or no amino acid
QXGMFXXXGXXXXQ

SEQ ID NO: 5068 - protein, 24 aa, Artificial sequence
  protein pattern
  Variant (2)..(4): Xaa in position 2 to 4 is any amino acid
  Variant (5)..(7): Xaa in position 5 to 7 is any or no amino acid
  Variant (9)..(9): Xaa in position 9 is any amino acid
  Variant (12)..(12): Xaa in position 12 is any amino acid
  Variant (13)..(13): Xaa in position 13 is Phe, His or Tyr
  Variant (15)..(15): Xaa in position 15 is Ala, Gly or Ser
  Variant (16)..(16): Xaa in position 16 is any amino acid
  Variant (17)..(17): Xaa in position 17 is Ile, Leu or Val
  Variant (18)..(18): Xaa in position 18 is Ala, Ser or Val
  Variant (19)..(20): Xaa in position 19 to 20 is any amino acid
  Variant (21)..(21): Xaa in position 21 is Ile, Leu or Val
  Variant (22)..(22): Xaa in position 22 is Phe, Leu, Met or Val
  Variant (23)..(23): Xaa in position 23 is any amino acid
  Variant (24)..(24): Xaa in position 24 is Ala, Asp, Glu, Asn, Ser or Thr
RXXXXXXSXPPXXGXXXXXXXXXX

SEQ ID NO: 5069 - protein, 14 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is Ile, Leu or Val
  Variant (8)..(8): Xaa in position 8 is Asp or Asn
  Variant (10)..(10): Xaa in position 10 is Gly, Ser, Thr or Val
  Variant (11)..(11): Xaa in position 11 is Ala, Ile or Val
  Variant (13)..(13): Xaa in position 13 is any amino acid
DXXXXKXXLXXGXY

SEQ ID NO: 5070 - DNA, 606 bp, Saccharomyces cerevisiae
  CDS (1)..(606)
atgtcagccaatgtacaagaagctgcaaatgcagctatagagccggccagtttcgttaaagtcccaatgcctgagccaccaagtagtttgcaacaattgatcaatgattggcaattaatcaagcatagagaaggtgggtattttaaggaaacagataggtctccctacaccatggaagtagaaaaaccagtaaatggaggctcaggtaatactgaaatggtaacaagaaatcaatctacgttgatctattatctactaacccccgacagcccaattgggaaatttcataagaatattaacaggatcatacatatcttacaaagaggcaagggtcaatacgttctagtatatcctgatggtcaagtgaagtcatttaaagttggttttgactataagaatggagaagtctcgcaatgggttgtccccggaggtgtgtttaaggcaagtttccttctgccaaacgaagaatttgacaacggtttcttgattagtgaagtagtggtaccaggttttgactttgaggaccataccttcttgaagggtgaagatgaactgaaacatcttgtgggacctgaaaaggcagctgagttagcttttttagcttga

SEQ ID NO: 5071 - protein, 201 aa, Saccharomyces cerevisiae
MSANVQEAANAAIEPASFVKVPMPEPPSSLQQLINDWQLIKHREGGYFKETDRSPYTMEVEKPVNGGSGNTEMVTRNQSTLIYYLLTPDSPIGKFHKNINRIIHILQRGKGQYVLVYPDGQVKSFKVGFDYKNGEVSQWVVPGGVFKASFLLPNEEFDNGFLISEVVVPGFDFEDHTFLKGEDELKHLVGPEKAAELAFLA

SEQ ID NO: 5072 - DNA, 495 bp, Synechocystis sp. PCC 6803
  CDS (1)..(495): transl_table=11
atgaaaaaagaaattaattattgggtagaaaagttggagctactcccccatcctgaagggggattttataaggaaacctatcgatcgccagtagaggcaaattttgcaggatttgacggcagtagaaatgtagttaccggaatttattttttgatgaccaaggacaacttttccgctttccacaggattaaatccgatgaaatgtggcatttctatgccggtgatagcttggaaatttactggttttctccccagggagagctggaggtgatcagcctgggcttggatttggaaaaaggagaagtgccccaagcggtggttctcaaggatggttggtttgcttctcgggttaaaaacggcggagattatgccctagtgggttgcaccgttgcccctggattcgattttcaggattttgagttggccaatcgggaagatttgctcaagctctacccccgctccgccgagattattaaccagttaactaggcaatag

SEQ ID NO: 5073 - protein, 164 aa, Synechocystis sp. PCC 6803
MKKEINYWVEKLELLPHPEGGFYKETYRSPVEANFAGFDGSRNVVTGIYFLMTKDNFSAFHRIKSDEMWHFYAGDSLEIYWFSPQGELEVISLGLDLEKGEVPQAVVLKDGWFASRVKNGGDYALVGCTVAPGFDFQDFELANREDLLKLYPRSAEIINQLTRQ

SEQ ID NO: 5074 - DNA, 672 bp, Gibberella zeae PH-1
  CDS (1)..(672)
atgggtgactttatcgacagcaagctcgatttgagcactataaaaccttcattctcgacctcatccgaacctgagagtcctcgatccaagtctcttatcgaagcactttcactagagcttcacatcgaaggcggctacttccgccagacggatgcagaccctacgacaattccctcaacctactcatccaaacctctttcagatcaaacacttgctcttactgggggtactcgcgagggatacagtaccaatacacgacgtctctcaaccacgatattctaccttctcacaccacgtcaatcgaaggggaactttcatcgcaaccgcagccgagtcattcacactctgcatcgtggaaggggtcgttacgttctcctccaccctgacggtcgcatcgaatcatttgttgtcgggaacgcagttgagcgaggtgagcgcttgcaatggattgtcgagggtgacgtctggaaggcaagctatctgctacccagcgaatcgaacccaagtcatgaaacggatggaacagagaccgatggtcttctaatatcagaaacggtggtccccggctttgagtacgaagaccacgcatttctaacccaccaaggtatcaaggagttgttaaaggaggagcaagtccgcgaactcgagtggcttgtgagaaaatccgagtaa

SEQ ID NO: 5075 - protein, 223 aa, Gibberella zeae PH-1
MGDFIDSKLDLSTIKPSFSTSSEPESPRSKSLIEALSLELHIEGGYFRQTDADPTTIPSTYSSKPLSDQTLALTGGTREGYSTNTRRLSTTIFYLLTPRQSKGNFHRNRSRVIHTLHRGRGRYVLLHPDGRIESFVVGNAVERGERLQWIVEGDVWKASYLLPSESNPSHETDGTETDGLLISETVVPGFEYEDHAFLTHQGIKELLKEEQVRELEWLVRKSE

SEQ ID NO: 5076 - DNA, 633 bp, Kluyveromyces lactis NRRL Y-1140
  CDS (1)..(633)
atgtcttctgttgatttgaattttcagagtgttgactcatctgttgatgaacctgtgtcttgcacacattttattcagtttcctgcagcaagccctccggatgtccttaagaaaattattgaagcgcaagggttggttaatcacggaggtggtggttacttcaaagagacagataggtctcctctccaattcggaattggacctgaaggatccgttgaagcgatcgataacaattcaaatcccaattctgtaaggaacatatcgactatgatatctgtgatgtatacaccagatgcccctttaggcaagtttctaaaacttaaaagcagaagcttacatattctacagcaagggaaaggtcaagtggttttaatatatccagatggactaattaaatctttcaagataggtcatgactacaaaaaaggcgagatcagtcaatgggttgtccccagtggagtattcaaggcgtgttatttactcccaaatgaagagtaccacaatggtttactaatcagtgaggtggtagttcctggtttcgatttcaacgactgtgagctgctgtcaggtaaggatcaactgaccgacttggttgctgaagagaaggctgaggcgttgaaattcctactttag

SEQ ID NO: 5077 - protein, 210 aa, Kluyveromyces lactis NRRL Y-1140
MSSVDLNFQSVDSSVDEPVSCTHFIQFPAASPPDVLKKIIEAQGLVNHGGGGYFKETDRSPLQFGIGPEGSVEAIDNNSNPNSVRNISTMISVMYTPDAPLGKFLKLKSRSLHILQQGKGQVVLIYPDGLIKSFKIGHDYKKGEISQWVVPSGVFKACYLLPNEEYHNGLLISEVVVPGFDFNDCELLSGKDQLTDLVAEEKAEALKFLL

SEQ ID NO: 5078 - DNA, 477 bp, Staphylococcus epidermidis RP62A
  CDS (1)..(477): transl_table=11
atgatgactgctaatgattggatagaccggttggaattaatttcgcatcctgaaggcggatattttaaagaaacaatgagaggcgacggtaaaggaagagcgtcttttagcagtatttattttctattaacacagcgcgatatatcacattttcatagaatagatgcagatgaagtatggtattatcatgctggtcagacgttgaagattcatatgataacccctaaaggtgaatatcatactgttaaattaggtagagatatagattgtggtgagtgtttacaatattgtgtgccaaaagggacaatttttgcttctactttagatagtgcagagggatatagtctagttggatgtatgtgtcaacctggatttgaatacgagcattttgaacttttaacacaagaatatttgattcgtcaatatccacaatatgaaagcataataaaaagattagctatatctcaagaagattaa

SEQ ID NO: 5079 - protein, 158 aa, Staphylococcus epidermidis RP62A
MMTANDWIDRLELISHPEGGYFKETMRGDGKGRASFSSIYFLLTQRDISHFHRIDADEVWYYHAGQTLKIHMITPKGEYHTVKLGRDIDCGECLQYCVPKGTIFASTLDSAEGYSLVGCMCQPGFEYEHFELLTQEYLIRQYPQYESIIKRLAISQED

SEQ ID NO: 5080 - DNA, 516 bp, Pseudomonas fluorescens PfO-1
  CDS (1)..(516): transl_table=11
atgaatccgagtcagatcagtgcgtcgaacctgattgcatcactggaccttgaacctcatgttgagggcggctatttccgcaggacataccaggctgatcaccgggacatgcttgaaaccacgagcggctcacgctttctgatgacgtcgatttactacctgctgaccgaagattcaccggtcggccagtttcatttcaaccattcggacatcctgcattatttccatctgggcgatgccattgagtacagcttgatccttgaagacggttcactgcagacgttggtgatgggcagcgatgttctagccggacaacatttgcaattgcacgtaccgggcggaatctggaaagcctccagactgctgaatggcgagaacggatttggtttgatcagcgaagcggtttcaccaggattcgatttcgcggatatggaaatggggaaccggcagaaactcacagcgcggtatccgcagcatcgagcgctgattgaaaagctgacgcgtgccgaggattga

SEQ ID NO: 5081 - protein, 171 aa, Pseudomonas fluorescens PfO-1
MNPSQISASNLIASLDLEPHVEGGYFRRTYQADHRDMLETTSGSRFLMTSIYYLLTEDSPVGQFHFNHSDILHYFHLGDAIEYSLILEDGSLQTLVMGSDVLAGQHLQLHVPGGIWKASRLLNGENGFGLISEAVSPGFDFADMEMGNRQKLTARYPQHRALIEKLTRAED

SEQ ID NO: 5082 - DNA, 582 bp, Ralstonia metallidurans CH34
  CDS (1)..(582): transl_table=11
gtggcgtgtcagtcatccgatccacacaccagccccccgcagcccctgcagccccggaaacaagtcatgcctacgcgctcaccgcagcaacgcctgatcgacgaactgtccctggtcccgcacccggaaggcggctattaccgcgagacctaccgggaccccgcgcgtatcacacgcgtggccgacggagccgagcgctctgcatccacggccatctactacctgctgtgcgatggcgcctattcggcttggcaccgcatccagtccgacgaagcatggcacttttacgcaggcgatgtgctcaatgtccacgtgctggcacctgacggcgcgttcaccacgcaccggttgggtaatccgctgttccagccagggaccgtcttccaggcggtggtgccggccggctgctggtttgccgcggaacgcgtggtgggcgcggccggctatgccctggccggttgcacggtagcgccgggattcgagttcagcgagttcgagctggcggaccgcgatgaactggcgcggctggcgtcatcccatccacgtcacgccgcgttgattacccggctgggcaaggcatag

SEQ ID NO: 5083 - protein, 193 aa, Ralstonia metallidurans CH34
MACQSSDPHTSPPQPLQPRKQVMPTRSPQQRLIDELSLVPHPEGGYYRETYRDPARITRVADGAERSASTAIYYLLCDGAYSAWHRIQSDEAWHFYAGDVLNVHVLAPDGAFTTHRLGNPLFQPGTVFQAVVPAGCWFAAERVVGAAGYALAGCTVAPGFEFSEFELADRDELARLASSHPRHAALITRLGKA

SEQ ID NO: 5084 - DNA, 516 bp, Trichodesmium erythraeum IMS101
  CDS (1)..(516): transl_table=11
atgcccgaaaaaaatcaattgatacaaaatttattagaaaacttacaactattaccccatccaggaggtgggttttataaagaagtatatcgtagtcaagggatcattcctaaaacagcattaagccaaaaattttcaggcgatcgctcatattgtaccagtatttattctttattaacctcagaagacttttttggctttcataaagtcaagcaagatgagatataccatttttatggaggaagttcacttaccgttcatactatcagccaagaaggaaactatcttaagcgtaaacttggtatggatctagagaatggagaacaaccccaattagttattcctgccgaatgttggtttgcttctaacgtagaagcagaatattcctacgctttgataggttgtacagtagctccaggatttcattttgatgattttgagtcagcacaaagaaaaacactatcagagaaatatcctcaactgaaagatattatccataaatttactaaagaataa

SEQ ID NO: 5085 - protein, 171 aa, Trichodesmium erythraeum IMS101
MPEKNQLIQNLLENLQLLPHPGGGFYKEVYRSQGIIPKTALSQKFSGDRSYCTSIYSLLTSEDFFGFHKVKQDEIYHFYGGSSLTVHTISQEGNYLKRKLGMDLENGEQPQLVIPAECWFASNVEAEYSYALIGCTVAPGFHFDDFESAQRKTLSEKYPQLKDIIHKFTKE

SEQ ID NO: 5086 - DNA, 828 bp, Ostreococcus tauri
  CDS (1)..(828)
atgtcgcgctcggaggtctcggacttcgctcgcggcgtcgtcctcggcgcgtcgaccgcgctcgcgctcgtcgaggtgattcacaggattgagcgacgaggctggggcggtggcgtgacgaagctgttggcgaaaatcatgggcgcgtcgatcgcgtcgtccgcgcgtgaggacgcgcgcggagagaaggagtcgatgatcgcacgactagggttgatcccacaccccgagggtgggttcttcgtcgagacgtatcgaaccgggtgcgcgccgatgacaagtcgtgggaagacggcgttcgacagagagacgaagcgcgaagatggatgcgcaactagtcggcgaacagacgacgaggatcgagggacacggaatcacatgacgagcatttattacatgctcaccagagagagcgatcatcagtggtgggcgctgaatgagagcgatcatgtgcactatcatcacgcgggcggggcggttacatatcacctggcgcggtcggacgggacgtacgagcgacgcgttctcggacgagacgtcgaggcgggacagacgccgcagctcgtggtcaagggagggacgttcaaggcggccgtgctcgagcccgggacggagtacgcaatcatcggagaggcagtgagccctgggtttgatttccgagactttcgattcgtcactgcgggtgagctcgcagtgagaaacgccgcatgcttcgacgacagcagtcatcttatcaaaccagcgcctgaggatacgttcgatcactattacaccggggcgacgccaccgcagcattacttcacacccgaacgagccgaggagagttga

SEQ ID NO: 5087 - protein, 275 aa, Ostreococcus tauri
MSRSEVSDFARGVVLGASTALALVEVIHRIERRGWGGGVTKLLAKIMGASIASSAREDARGEKESMIARLGLIPHPEGGFFVETYRTGCAPMTSRGKTAFDRETKREDGCATSRRTDDEDRGTRNHMTSIYYMLTRESDHQWWALNESDHVHYHHAGGAVTYHLARSDGTYERRVLGRDVEAGQTPQLVVKGGTFKAAVLEPGTEYAIIGEAVSPGFDFRDFRFVTAGELAVRNAACFDDSSHLIKPAPEDTFDHYYTGATPPQHYFTPERAEES

SEQ ID NO: 5088 - DNA, 651 bp, Phaeosphaeria nodorum
  CDS (1)..(651)
atgtcttccctccccaacacctccacccgcctccaaccctctttcacagccgcctcgcaccccacagaaaccccctccacgcaaaacatcatcaccgccctcaacctagaaacccacatcgaaggcgggtacttttgcgaaatcgaccgcgacccgctactcatccccaaccccttcccccaatccccctccccctccaacacccaaaccgcgcccctcccgttctcaggcgacaactccgtccgcaacgccagcacgagcatatactacctgctcacgccgccgtcgccacaggggcattttcaccgcaacaagggccgcacggtccatacggtgatcgaggggcgcgggacgtacgtgctgattcacgctgatgaggagggggaggggcatggtgggaagagggttgagacgttcgtggttgggaaggatgtgagtaagggggagaaggcggtgtggattgttgaggggggcaagttcaaggcgagttatcttctgccttgtgagggcgaggacaggttgttgattagcgagacggtggttccgggcttcgagtatgcggatcatgattttttgacgagggaggggtttgaaaggttggtgaagggggaggtgaggggggggttggagtggttggttaggagggagtga

SEQ ID NO: 5089 - protein, 216 aa, Phaeosphaeria nodorum
MSSLPNTSTRLQPSFTAASHPTETPSTQNIITALNLETHIEGGYFCEIDRDPLLIPNPFPQSPSPSNTQTAPLPFSGDNSVRNASTSIYYLLTPPSPQGHFHRNKGRTVHTVIEGRGTYVLIHADEEGEGHGGKRVETFVVGKDVSKGEKAVWIVEGGKFKASYLLPCEGEDRLLISETVVPGFEYADHDFLTREGFERLVKGEVRGGLEWLVRRE

SEQ ID NO: 5090 - DNA, 669 bp, Aspergillus oryzae
  CDS (1)..(669)
atggatatcccaatcatctcaatcaagcccttctatcaaccaccttcgcgcaacgaaaaccgcgcgcctgaatcgcccaccattcagaagacgatccaggccctccaactacagcctcacccggagggaggttattactgcgaaacagatcgccatccgctccggattccaaatccctactgtgacgacatggacaacagaaagacagtcacagagacagatggtgagaaagctacccggtcagcgagcactacgatctactacttcatcacgccgggttcgccgatggggtatttccatcgaaaccggagtcgcacggtgcatacccttcatcgtggccgaggtcggtacgtcatcttacatgccgaccgggcgaaggagaatggagggatagcgcccattgaatcgtttgtggtgggccatcggattgaaaagggagagcgactgcaatgggtggtggatggcggaaagtataaatgcagttatctgttgcctgattctgatggcgacttgcctgacgataacaagtcagaggggttgttaatcagcgagaccgttgttccaggatttgaattctatgaccatgacttcctgacggcggagaagatggagcaactgctgactactgaacaggttgaggagctgaagtggatggtaagggagacctga

SEQ ID NO: 5091 - protein, 222 aa, Aspergillus oryzae
MDIPIISIKPFYQPPSRNENRAPESPTIQKTIQALQLQPHPEGGYYCETDRHPLRIPNPYCDDMDNRKTVTETDGEKATRSASTTIYYFITPGSPMGYFHRNRSRTVHTLHRGRGRYVILHADRAKENGGIAPIESFVVGHRIEKGERLQWVVDGGKYKCSYLLPDSDGDLPDDNKSEGLLISETVVPGFEFYDHDFLTAEKMEQLLTTEQVEELKWMVRET

SEQ ID NO: 5092 - DNA, 579 bp, Arabidopsis thaliana
  CDS (1)..(579)
atgtcgtcaaagatggtgaagtcttcagaaatcgtcggaaaacttaatctcagggcacaccaagaaggaggctttttcgctgaaactttcagagattcttctgttttcctctccacctctcagctccctccaacctttaaggtggacagagctgtgagcacaagtatctacttcttgcttccatctgggagcgtttctcgtcttcatcgcataccaatggctgaaacctggcacttttatttgggtgaaccccttactgtagtggaactctacgatgatgggaagttgaaattcacatgtcttggtcctgacttgtttgaaggtgatcagaagcctcagtacacggtccctccaaacgtctggtttggttcgtttcctacaaaggatgttcatttttctcaagacggggctctgcttaaagctgaggctagagactctgagaaccatttctctcttgttggctgcacctgcgctcctgctttccagttcgaggactttgagctcgcgaaacgctctgatctcttatcaaggtttccgcaacacgagtcactcatcacaatgctatcttacccggagtga

SEQ ID NO: 5093 - protein, 192 aa, Arabidopsis thaliana
MSSKMVKSSEIVGKLNLRAHQEGGFFAETFRDSSVFLSTSQLPPTFKVDRAVSTSIYFLLPSGSVSRLHRIPMAETWHFYLGEPLTVVELYDDGKLKFTCLGPDLFEGDQKPQYTVPPNVWFGSFPTKDVHFSQDGALLKAEARDSENHFSLVGCTCAPAFQFEDFELAKRSDLLSRFPQHESLITMLSYPE

SEQ ID NO: 5094 - DNA, 591 bp, Oryza sativa
  CDS (1)..(591)
atggcgctcacgagcgtggagaagaagacggcggcggagatcgtcgccatgctggatctgcagcgccaccccgacggcggcttctacctggagaccttccgcgacccctccatctccctccccaagtccgcgctccctccacgctataaggtagaccgttctgggagcagtgccatctatttcctgctgcctgctggagagattgctaagttgcaccgcatcccttgtgctgagacctggcactactacatgggggaacctctcacggtatttgaggtccatgacgatggacagatcaagatgacagtcgttggacctgatctacggcatggccaaaggccacaatacacagtccctccaaatgtttggtttggcgccttcttgacctgcgacattgagtccttcaccgaagatggaagtgtatttgtcaaaacgccaggaagagaccctgaacttcactactctttcgtcggtgtaacctgtgctccagcattccagtttgaggacaacgaaatggcaacacgggagaccatgaagacacttgctcctaaagccgaagctttcatcaactaccttgttccttcagactga

SEQ ID NO: 5095 - protein, 196 aa, Oryza sativa
MALTSVEKKTAAEIVAMLDLQRHPDGGFYLETFRDPSISLPKSALPPRYKVDRSGSSAIYFLLPAGEIAKLHRIPCAETWHYYMGEPLTVFEVHDDGQIKMTVVGPDLRHGQRPQYTVPPNVWFGAFLTCDIESFTEDGSVFVKTPGRDPELHYSFVGVTCAPAFQFEDNEMATRETMKTLAPKAEAFINYLVPSD

SEQ ID NO: 5096 - DNA, 591 bp, Oryza sativa
  CDS (1)..(591)
atggcggccacgagctcggagaagaagacggcggcggaggtcgtcgccatgctggatctgcagcgccaccccgatggcgggttcatcctggagaccttccgcgacccctccatctccctccccaagtccgccctccctccccgctataaggtagaccgtgctgtgagcaatgccatatatttcctgctacctgctggagagatcgttaagttgcatcgcatcccttgtgctgagacctggcactactacatgggggaacctctcacggtatttgaagtgcatgacgatggacaattcaagatgacagttgttggacctgatctacggcatggccaaaagccacaatacacagttcctccaaatgtttggtttggcgccttcttgacctgcgacatcgagtccttcaccgaagatggaagtgtgtttgtcaaaacgcctggaagagactctgagctgcactactctttcgtcggtgtaacctgtgctccagcattccagattgaagacgacgaaatggcaacacgggagagcatgaaagctttggctcctaaagcagaagctttcatcaactaccttgtgccttcagactga

SEQ ID NO: 5097 - protein, 196 aa, Oryza sativa
MAATSSEKKTAAEVVAMLDLQRHPDGGFILETFRDPSISLPKSALPPRYKVDRAVSNAIYFLLPAGEIVKLHRIPCAETWHYYMGEPLTVFEVHDDGQFKMTVVGPDLRHGQKPQYTVPPNVWFGAFLTCDIESFTEDGSVFVKTPGRDSELHYSFVGVTCAPAFQIEDDEMATRESMKALAPKAEAFINYLVPSD

SEQ ID NO: 5098 - DNA, 24 bp, Artificial sequence
  primer
atgtcagccaatgtacaagaagct

SEQ ID NO: 5099 - DNA, 25 bp, Artificial sequence
  primer
tcaagctaaaaaagctaactcagct

SEQ ID NO: 5100 - protein, 180 aa, Artificial sequence
  consensus sequence
  Variant (2)..(2): Xaa in position 2 is any amino acid
  Variant (4)..(5): Xaa in position 4 to 5 is any amino acid
  Variant (7)..(8): Xaa in position 7 to 8 is any amino acid
  Variant (11)..(13): Xaa in position 11 to 13 is any amino acid
  Variant (16)..(16): Xaa in position 16 is any amino acid
  Variant (18)..(22): Xaa in position 18 to 22 is any amino acid
  Variant (23)..(54): Xaa in position 23 to 54 is any or no amino acid
  Variant (56)..(60): Xaa in position 56 to 60 is any amino acid
  Variant (63)..(73): Xaa in position 63 to 73 is any amino acid
  Variant (74)..(74): Xaa in position 74 is any or no amino acid
  Variant (76)..(87): Xaa in position 76 to 87 is any amino acid
  Variant (89)..(106): Xaa in position 89 to 106 is any amino acid
  Variant (107)..(114): Xaa in position 107 to 114 is any or no amino acid
  Variant (116)..(124): Xaa in position 116 to 124 is any amino acid
  Variant (125)..(125): Xaa in position 125 is any or no amino acid
  Variant (127)..(128): Xaa in position 127 to 128 is any amino acid
  Variant (130)..(153): Xaa in position 130 to 153 is any amino acid
  Variant (154)..(173): Xaa in position 154 to 173 is any or no amino acid
  Variant (175)..(175): Xaa in position 175 is any amino acid
  Variant (177)..(179): Xaa in position 177 to 179 is any amino acid
LXLXXHXXGGXXXETXRXXXXXXXXXXXXXXXXXXXXXXXXXXXXXXXXXXXXXRXXXXXIYXXXXXXXXXXXXHXXXXXXXXXXXXGXXXXXXXXXXXXXXXXXXXXXXXXXXGXXXXXXXXXXQXXVXXXXXXXXXXXXXXXXXXXXXXXXXXXXXXXXXXXXXXXXXXXXPXFXXXD

SEQ ID NO: 5101 - protein, 15 aa, Artificial sequence
  protein pattern
  Variant (2)..(3): Xaa in position 2 to 3 is any amino acid
  Variant (5)..(5): Xaa in position 5 is any amino acid
  Variant (6)..(6): Xaa in position 6 is Asp, Glu or Gly
  Variant (9)..(9): Xaa in position 9 is Phe or Tyr
  Variant (10)..(11): Xaa in position 10 to 11 is any amino acid
  Variant (13)..(14): Xaa in position 13 to 14 is any amino acid
LXXHXXGGXXXEXXR

SEQ ID NO: 5102 - DNA, 768 bp, Saccharomyces cerevisiae
  CDS (1)..(768)
atgttgcgaccactgagaaaaagcgttctagcaagctgccgacattgtttcaaggtgtgcggtgggttgcctcaaaagcaattacccttattttcaccattgctcttgagagcacgatactcatcaactgatagctcaactaaaaggtctaacaaatcagataaaatagatgctccaggatttaagaaaattttccttgttgctattatcggtacagtgatatttgtcaagacagtacagtctttagataagaacaaaccgaagacaacattatcagaagaagaattcgaaaatgtggttaaagggttgaaaagacgtgtggctatcttcccacaaggtgaggtcgatataaagttttccttatcacccagcattgaagaaactagaaaggtactgcagaaatcacaaggcgatgatataaatgagctgcagtttgtcgatccagtcaaggtcatcgattactacagaaccttgagggatgatagatatgaggctttattaaatgaatactacaaaaaatacgggtgtgacacgtacgcttacaatttgccgaccggtatgttggtcatgcttttgggtagatatttcaaagagaacttcaagaccggtgacaagctagtagttgtgaactttcctcattcgattgctgatgcaacaagatttgaaaatgaggtttctatagtgtctaaaatctttgttccgaggaaattgagtggctctgacgtctgtaaatattacgaaactgtaggtaaagctgatatcatctga

SEQ ID NO: 5103 - protein, 255 aa, Saccharomyces cerevisiae
MLRPLRKSVLASCRHCFKVCGGLPQKQLPLFSPLLLRARYSSTDSSTKRSNKSDKIDAPGFKKIFLVAIIGTVIFVKTVQSLDKNKPKTTLSEEEFENVVKGLKRRVAIFPQGEVDIKFSLSPSIEETRKVLQKSQGDDINELQFVDPVKVIDYYRTLRDDRYEALLNEYYKKYGCDTYAYNLPTGMLVMLLGRYFKENFKTGDKLVVVNFPHSIADATRFENEVSIVSKIFVPRKLSGSDVCKYYETVGKADII

SEQ ID NO: 5104 - DNA, 693 bp, Candida glabrata CBS 138
  CDS (1)..(693)
atggcattgatgagacttggtctgaggatacctgctcgacttggttccaatcttcctgtagcccagctcggtattcgggcagctaagcatcgtttctatgcaacagcacctaggaacgatggtggtgagcttcccagcatcaagaagctgttgatgattgggcttgctggtacagcggtatttgtgttggcggtgaactcattggataagcagcagcccaagaactcatactcagagtccgagtttgagagcttacaaagactcaagaggaaagtggcactgttcccaggcaaccaattgaaggtgtatggtgttctaggcaccgaaaagtataataaaatagtctcgggtggtaagattgtggatccacgcaagattatcgagaaacaccgtaccactgcgggtgaccgttacgaagccttattgaacatcctatatgacaagtatggcgctgttgagtactttgacatgctaccacagggccttatggttaagttagtctccctgtacatgaaggataactgttctgagggcgataccgttgttatcctagactttccaaagtctatcaaggatgcatcgcaatttgaaaccgaagtggcaggcatctctaaatttatagtgtcacagaagctaaaggacactgatatttgtaagtattatgatgccgttggtaaacttgaatcagtataa

SEQ ID NO: 5105 - protein, 230 aa, Candida glabrata CBS 138
MALMRLGLRIPARLGSNLPVAQLGIRAAKHRFYATAPRNDGGELPSIKKLLMIGLAGTAVFVLAVNSLDKQQPKNSYSESEFESLQRLKRKVALFPGNQLKVYGVLGTEKYNKIVSGGKIVDPRKIIEKHRTTAGDRYEALLNILYDKYGAVEYFDMLPQGLMVKLVSLYMKDNCSEGDTVVILDFPKSIKDASQFETEVAGISKFIVSQKLKDTDICKYYDAVGKLESV

SEQ ID NO: 5106 - DNA, 654 bp, Kluyveromyces lactis NRRL Y-1140
  CDS (1)..(654)
atgttcgtacgcgctgcaccaagattattgaagtctccggtcatgcgccggatgctgtctggaaaaatggataaagctgaagaaccaccaagttttaaaaccattttacttgttggtttagttgggactgctatttttgttaaggcagtcgactctttggaacagaacaagcctaaaaacacgtacacattctctgaatttgacactgtgatgagtggtctaagaagaagagtttcgatctttgagcaagatgatttaaatttaagatgtgtgcaaaccggagttgcaaccaagaaactgaaattccccgaagatgcgaaggttatcaaaccttcagaagctattgaattcttcagaaataagtctgacgataaatattatgtgcttttaaatgatttatatgaaaaggaggggaaatcgtacatggaaaaactaccaacaggtctctctgtcgtcttgataggtaaatatatgaaggagaaatgtcaaaagggtgacactgtttatctacttgacttcccagacaatataaaagatgcgatcaagttcgaaaatgaggtttccgttatcgacaaagttattgtaccaaattcagaaggagacggccaggtttccaaatactttaaaaccgtggataaagttgagaccatctaa

SEQ ID NO: 5107 - protein, 217 aa, Kluyveromyces lactis NRRL Y-1140
MFVRAAPRLLKSPVMRRMLSGKMDKAEEPPSFKTILLVGLVGTAIFVKAVDSLEQNKPKNTYTFSEFDTVMSGLRRRVSIFEQDDLNLRCVQTGVATKKLKFPEDAKVIKPSEAIEFFRNKSDDKYYVLLNDLYEKEGKSYMEKLPTGLSVVLIGKYMKEKCQKGDTVYLLDFPDNIKDAIKFENEVSVIDKVIVPNSEGDGQVSKYFKTVDKVETI

SEQ ID NO: 5108 - DNA, 840 bp, Debaryomyces hansenii CBS767
  CDS (1)..(840)
atgttcagatcaagccagttacttaggaatggaattcgtggtatgcgcaatgctcgcataccaattattcaattgaaaccatcgccattcatgcctatgagagcacaactctactcaacaaaagcaaataatgaaccaccaaaattacgtttcctcttttacatgtttatttttgcttcaggtgtgctatacgttacaggtagtcaaatagagaaaaagaagcccaagagtagttttaccgagaaggaatttgaggaatatgaaagtagtagtgggttgaaaagacgtagtaagttgatctccacgcaagatgcagagaaatataagtttttcgttgttccatatgttcaccagaacgagtttattactaagatcgctcaaaagcttggagataaggaagtcagaattatcgatcctgaagaactcattaagcgtgaaagagaagatgagtcaagacattactcttatttattgcaagacttagcccaagaggataagccattgccaaaaggtttagttacggctttgattaaggatgatattaaattttatttaaatacaaggaacggaacttttgatactaactttctcattaaaaactatcctcaaactacggacgaagctattaaatttgagaatgacatttcagatattctgaagtgtatagtacttcattatgatatgttgaacgaattaaagaagaataaaggtgaggaaaatgcaagattgattaacaacgtcgttggttactacgaaactgtgaacaaagccaagatcatcaccgctaaacatgatgagttagatgataaattacaagaaatctcattagaatttatctaa

SEQ ID NO: 5109 - protein, 279 aa, Debaryomyces hansenii CBS767
MFRSSQLLRNGIRGMRNARIPIIQLKPSPFMPMRAQLYSTKANNEPPKLRFLFYMFIFASGVLYVTGSQIEKKKPKSSFTEKEFEEYESSSGLKRRSKLISTQDAEKYKFFVVPYVHQNEFITKIAQKLGDKEVRIIDPEELIKREREDESRHYSYLLQDLAQEDKPLPKGLVTALIKDDIKFYLNTRNGTFDTNFLIKNYPQTTDEAIKFENDISDILKCIVLHYDMLNELKKNKGEENARLINNVVGYYETVNKAKIITAKHDELDDKLQEISLEFI

SEQ ID NO: 5110 - DNA, 24 bp, Artificial sequence
  primer
atgttgcgaccactgagaaaaagc

SEQ ID NO: 5111 - DNA, 25 bp, Artificial sequence
  primer
tcagatgatatcagctttacctaca

SEQ ID NO: 5112 - protein, 257 aa, Artificial sequence
  consensus sequence
  Variant (2)..(22): Xaa in position 2 to 22 is any amino acid
  Variant (23)..(45): Xaa in position 23 to 45 is any or no amino acid
  Variant (47)..(73): Xaa in position 47 to 73 is any amino acid
  Variant (76)..(81): Xaa in position 76 to 81 is any amino acid
  Variant (84)..(88): Xaa in position 84 to 88 is any amino acid
  Variant (89)..(91): Xaa in position 89 to 91 is any or no amino acid
  Variant (93)..(93): Xaa in position 93 is any amino acid
  Variant (95)..(126): Xaa in position 95 to 126 is any amino acid
  Variant (127)..(137): Xaa in position 127 to 137 is any or no amino acid
  Variant (139)..(141): Xaa in position 139 to 141 is any amino acid
  Variant (143)..(145): Xaa in position 143 to 145 is any amino acid
  Variant (147)..(152): Xaa in position 147 to 152 is any amino acid
  Variant (154)..(155): Xaa in position 154 to 155 is any amino acid
  Variant (158)..(170): Xaa in position 158 to 170 is any amino acid
  Variant (171)..(172): Xaa in position 171 to 172 is any or no amino acid
  Variant (174)..(184): Xaa in position 174 to 184 is any amino acid
  Variant (186)..(193): Xaa in position 186 to 193 is any amino acid
  Variant (195)..(201): Xaa in position 195 to 201 is any amino acid
  Variant (202)..(202): Xaa in position 202 is any or no amino acid
  Variant (204)..(208): Xaa in position 204 to 208 is any amino acid
  Variant (210)..(211): Xaa in position 210 to 211 is any amino acid
  Variant (214)..(220): Xaa in position 214 to 220 is any amino acid
  Variant (222)..(223): Xaa in position 222 to 223 is any amino acid
  Variant (225)..(235): Xaa in position 225 to 235 is any amino acid
  Variant (236)..(250): Xaa in position 236 to 250 is any or no amino acid
  Variant (252)..(254): Xaa in position 252 to 254 is any amino acid
  Variant (256)..(256): Xaa in position 256 is any amino acid
RXXXXXXXXXXXXXXXXXXXXXXXXXXXXXXXXXXXXXXXXXXXXPXXXXXXXXXXXXXXXXXXXXXXXXXXXPKXXXXXXEFXXXXXXXXLXRXXXXXXXXXXXXXXXXXXXXXXXXXXXXXXXXXXXXXXXXXXXPXXXIXXXRXXXXXXYXXLLXXXXXXXXXXXXXXXLXXXXXXXXXXXYXXXXXXXXDXXXXXXXXPXXXXXAXXFEXXXXXXXKXXVXXXXXXXXXXXXXXXXXXXXXXXXXXYXXXVXK

SEQ ID NO: 5113 - protein, 24 aa, Artificial sequence
  protein pattern
  Variant (2)..(4): Xaa in position 2 to 4 is any amino acid
  Variant (5)..(6): Xaa in position 5 to 6 is any or no amino acid
  Variant (8)..(9): Xaa in position 8 to 9 is any amino acid
  Variant (10)..(11): Xaa in position 10 to 11 is any or no amino acid
  Variant (14)..(14): Xaa in position 14 is Asn or Thr
  Variant (15)..(15): Xaa in position 15 is Asp or Glu
  Variant (16)..(16): Xaa in position 16 is Ile or Val
  Variant (17)..(17): Xaa in position 17 is Ala or Ser
  Variant (18)..(18): Xaa in position 18 is any amino acid
  Variant (19)..(19): Xaa in position 19 is Ile or Val
  Variant (20)..(20): Xaa in position 20 is any amino acid
  Variant (22)..(22): Xaa in position 22 is any amino acid
  Variant (23)..(23): Xaa in position 23 is Phe or Ile
PXXXXXAXXXXFEXXXXXXXKXXV

SEQ ID NO: 5114 - protein, 40 aa, Artificial sequence
  protein pattern
  Variant (2)..(2): Xaa in position 2 is any amino acid
  Variant (3)..(3): Xaa in position 3 is any or no amino acid
  Variant (5)..(6): Xaa in position 5 to 6 is any amino acid
  Variant (7)..(7): Xaa in position 7 is any or no amino acid
  Variant (9)..(17): Xaa in position 9 to 17 is any amino acid
  Variant (18)..(18): Xaa in position 18 is any or no amino acid
  Variant (20)..(21): Xaa in position 20 to 21 is any amino acid
  Variant (23)..(23): Xaa in position 23 is Asp, Asn, Gln or Thr
  Variant (24)..(24): Xaa in position 24 is Gly or Ser
  Variant (25)..(25): Xaa in position 25 is any amino acid
  Variant (26)..(26): Xaa in position 26 is Asp, Glu or Gln
  Variant (27)..(27): Xaa in position 27 is any amino acid
  Variant (28)..(28): Xaa in position 28 is Glu, Asn or Gln
  Variant (29)..(30): Xaa in position 29 to 30 is any amino acid
  Variant (32)..(32): Xaa in position 32 is Asn, Pro or Thr
  Variant (33)..(34): Xaa in position 33 to 34 is any amino acid
  Variant (35)..(35): Xaa in position 35 is Ser or Thr
  Variant (36)..(36): Xaa in position 36 is any amino acid
  Variant (37)..(37): Xaa in position 37 is Glu, Ser or Thr
  Variant (39)..(39): Xaa in position 39 is any amino acid
  Variant (40)..(40): Xaa in position 40 is Asp or Glu
PXXKXXXLXXXXXXXXXXVXXVXXXXXXXXKXXXXXXEXX

SEQ ID NO: 5115 - DNA, 741 bp, Saccharomyces cerevisiae
  CDS (1)..(741)
atggagagtatatttggtgggtttggagatctagttgttcctaggccaaaggagcatctcggtcaaacagacctttccttcggtggaaaattattgcctgcattgaaaatttgtgaagatggcggtgaaagtggttgtggcggtaaagtctggatcgctggcgaactgttgtgcgagtacatactcgagaaatcagttgaccatctgctaagtaagacggtcaatggtacgaaacaatttaaaaaagtcttagaattgggtagtggtacaggtttagttggattgtgcgtggggttgttggaaaaaaacacattccacgatggcactaaagtatatgttacggacattgacaagttgataccactattgaaaagaaatatagaactggacgaagttcagtatgaagttcttgcgagggaactttggtggggtgagccgctgtcggcagatttctcacctcaagaaggtgctatgcaagcaaataacgttgatctagttttggcagctgattgtgtgtatctcgaggaagcttttccattactagaaaaaacactacttgatctcactcactgcataaacccacctgtaatcttgatggcttacaagaagagaagaaaagctgataaacattttttcaacaagattaaaagaaattttgacgttcttgaaattacagattttagtaaatttgaacattatcttaaggaaagaacccacttgtttcagcttatcaggaagtaa

SEQ ID NO: 5116 - protein, 246 aa, Saccharomyces cerevisiae
MESIFGGFGDLVVPRPKEHLGQTDLSFGGKLLPALKICEDGGESGCGGKVWIAGELLCEYILEKSVDHLLSKTVNGTKQFKKVLELGSGTGLVGLCVGLLEKNTFHDGTKVYVTDIDKLIPLLKRNIELDEVQYEVLARELWWGEPLSADFSPQEGAMQANNVDLVLAADCVYLEEAFPLLEKTLLDLTHCINPPVILMAYKKRRKADKHFFNKIKRNFDVLEITDFSKFEHYLKERTHLFQLIRK

SEQ ID NO: 5117 - DNA, 951 bp, Arabidopsis thaliana
  CDS (1)..(951)
atgtttggtccgtcgatgcacatggaagcagcagagatagtccattcggcggcgcgttttgaagctgagaaaatgggcaaggaggatgaggcggtggaggagatacgacgtatgagtggttacggcggagatgtgatagtagtaggtgggtttccggcgtcggagtcggaatctgaatctgaatccgatttggcggcggcggagattatggttatatgggctattcaagggccaacttcttttgctccaaacacactcgttgctcaatcttctcttgagctgcgtctcgacgcttgtggccactcactctctattctccagtcgccatgttcattgaacacgcctggagtaaccgggtcagtgatgtgggacagtggagtggtgctagggaagttcttagaacattctgttgactctaaggttctttctcttgaaggcaagaaaatcgtcgagttgggttctggctgtggcttagttggttgtatagcagcacttttgggaggcaatgctgtcctcactgatcttccagatagactgaggctactcaaaaagaacatccaaaccaatttgcaccgtgggaacacgcgtggatctgctattgtgcaggaacttgtttggggagatgaccctgatccagatttgatcgaaccattccctgattacgtattaggctcagatgttatatacagcgaagaagctgttcaccatttggtaaaaacgcttttgcaactttgcagcgatcaaactacaatcttcctatcaggagaactacgaaatgatgctgttcttgagtacttcttagaaaccgcactgaaagattttgcgatcgggcgtgtggaacaaacacaatggcatccagattatcgcagccatcgagtagtgctttacgttcttgaaaagaagtcgaagagatgcctcgctgatgaatcttcgcttaatcaatcttgttag

SEQ ID NO: 5118 - protein, 316 aa, Arabidopsis thaliana
MFGPSMHMEAAEIVHSAARFEAEKMGKEDEAVEEIRRMSGYGGDVIVVGGFPASESESESESDLAAAEIMVIWAIQGPTSFAPNTLVAQSSLELRLDACGHSLSILQSPCSLNTPGVTGSVMWDSGVVLGKFLEHSVDSKVLSLEGKKIVELGSGCGLVGCIAALLGGNAVLTDLPDRLRLLKKNIQTNLHRGNTRGSAIVQELVWGDDPDPDLIEPFPDYVLGSDVIYSEEAVHHLVKTLLQLCSDQTTIFLSGELRNDAVLEYFLETALKDFAIGRVEQTQWHPDYRSHRVVLYVLEKKSKRCLADESSLNQSC

SEQ ID NO: 5119 - DNA, 948 bp, Arabidopsis thaliana
  CDS (1)..(948)
atggatcccgacaggttaaattctccaagcacctgtactgttaccattgaggttttggggcacgaattagactttgctcaggatccaaattcgaagcatttaggaacgaccgtgtgggatgcgtccatggtgtttgccaaatatctggggaaaaatagcaggaagggaaggtttagttcatctaaactgaaagggaaacgtgctattgaactaggagcaggttgtggcgttgcaggatttgctttggcgatgctggggtgtgatgtggttacaactgaccaaaaggaggtattaccactgctaaagaggaatgtagaatggaatacgtccagaatcgtacagatgaatcctggttcagcatttggatcgctccgggttgcagaactcgactggggaaacgaagatcatataacggccgttgagcctccctttgactatgtcatcggtactgatgttgtatattctgagcagcttctggaaccgctattgcgtacgatacttgcattatcagggccaaagacaacagttatgttgggatatgagatacgttcgacggttgttcatgagaaaatgcttcagatgtggaaagacaactttgaagtcaaaaccataccgagatccaagatggatggtgaataccaagacccgagcattcatctgtacatcatggcacagaaatctgctgccgagagctctggaaacgtaagccgagatgaagttgttatagacacagacgaaacaaagtgtgagacgaaagtcccaaccggagaatgccataagagggtggaagaggaagctgttgttacacatggtcctcgtcttaatgaagatagtttgttgatgagactacgggatggaaagctaagtgaatgggagatgagaaggtatggtacagttgctgcacagcttctccgtgacgttaagatagatgttcaggtgaaaaaataa

SEQ ID NO: 5120 - protein, 315 aa, Arabidopsis thaliana
MDPDRLNSPSTCTVTIEVLGHELDFAQDPNSKHLGTTVWDASMVFAKYLGKNSRKGRFSSSKLKGKRAIELGAGCGVAGFALAMLGCDVVTTDQKEVLPLLKRNVEWNTSRIVQMNPGSAFGSLRVAELDWGNEDHITAVEPPFDYVIGTDVVYSEQLLEPLLRTILALSGPKTTVMLGYEIRSTVVHEKMLQMWKDNFEVKTIPRSKMDGEYQDPSIHLYIMAQKSAAESSGNVSRDEVVIDTDETKCETKVPTGECHKRVEEEAVVTHGPRLNEDSLLMRLRDGKLSEWEMRRYGTVAAQLLRDVKIDVQVKK

SEQ ID NO: 5121 - DNA, 1020 bp, Magnaporthe grisea 70-15
  CDS (1)..(1020)
atgaaggacatcataaacgaccgttcttcctcgccgccggtcttttcacccctggcaatcgacgcagacttggcacccctcccagagtacaaggcggctggcgagaccaagatcaactttggcggcctgctccccgcgacggcaccactgcgcctgcacgaggacctcagctcgggatgcggcggacagctgtggccggcgggcatggtgctggcaacgcatatgttgcgagaccgcaggagttccatcggtcgcgagaggatactggagctgggcgccggcggcggcctcgtgtcgctggccgtggcgcgagggtgcgacgtcgagacgccgatgctgataacggaccagctcgagatgttggccctgatggagcacaacatccgcctcaacgaggtggaggacaaggccaaggctttgatcctcaactggggtgagccgctcccacaacaagtggtcgaactcaagccgacggtggtcctagcagccgactgcgtctactttgagcccgcgttcccgctgctcctccagacgctgacagacctgctggccctgtcgccgcccaaggagtgcaccgtctacttttgcttcaagaagcggcggcgcgcagacatgcagttcctcaaaaaggcgcaaaagatgttttcggtcgtcgaggttcccgaccaggaccggcccgtctttagccgacaaaacctgttcctctacgccatcatcagcaaggaggaggcgataaagcggtcattgatcgtgcaaaaaaagacggcaaacaaaggtactgtagagaggacgcccgtccgattctccacgattcggaagagtgatccggtagcatcacggttcgcgcaccgttgggatcgttacccgtccaaggcggtcccattctccacggcaagtttgacacctgaaaatcccgggagcaacattccaagttttcaaaaatccaggagagcaaataccacggcagattctaaggggactagaaggagaactggaggcttctatcctcactggagttga

SEQ ID NO: 5122 - protein, 339 aa, Magnaporthe grisea 70-15
MKDIINDRSSSPPVFSPLAIDADLAPLPEYKAAGETKINFGGLLPATAPLRLHEDLSSGCGGQLWPAGMVLATHMLRDRRSSIGRERILELGAGGGLVSLAVARGCDVETPMLITDQLEMLALMEHNIRLNEVEDKAKALILNWGEPLPQQVVELKPTVVLAADCVYFEPAFPLLLQTLTDLLALSPPKECTVYFCFKKRRRADMQFLKKAQKMFSVVEVPDQDRPVFSRQNLFLYAIISKEEAIKRSLIVQKKTANKGTVERTPVRFSTIRKSDPVASRFAHRWDRYPSKAVPFSTASLTPENPGSNIPSFQKSRRANTTADSKGTRRRTGGFYPHWS

SEQ ID NO: 5123 - DNA, 750 bp, Gibberella zeae PH-1
  CDS (1)..(750)
atgagtagtccgccgtcatctcccttgatggaccctgtcaccatcagcgaggatatcgctccattgccatccttcaaggccagtggtgttgcggatgttgatttcgatggcgttctttctaaaccgctcaaggtgcacgaagatgtccggtctggttgtggtggccagacgtggccagcaggaatgcttctcggcaagcatatgctgcgctaccacaaagaccgactggttgatgctcaaatattggaactcggagctggaggcggtctcatagggcttgccatcgccttggaatgctcacttcgaaatccgctgttggtgacagaccagctggaaatgttcgagctgatgcagcataacatcgagctaaacaacttacaagacaaggcgaaagccatggtgctcaactggggagaggatttgccagcagctgtactggagcaaaaaccagatgtgatcctggctggcgaatgcgtctacttcgaaccagcatttccgctcttgatgtctacactcaaggctttactcgaacttaaccccaacgcagttgtgtatttctgtttcaagaagaggagacgagctgatatgaactttgtcaagatggcgaaaaaagccttcaaggtggaagagatcttcgatgaggaccgacccgtctttcagcgccagggtcttttccttttctcatttaccagccgcccaagtccaaccagagccaccaagagccaaagtgatcctcaatctgttgaatga

SEQ ID NO: 5124 - protein, 249 aa, Gibberella zeae PH-1
MSSPPSSPLMDPVTISEDIAPLPSFKASGVADVDFDGVLSKPLKVHEDVRSGCGGQTWPAGMLLGKHMLRYHKDRLVDAQILELGAGGGLIGLAIALECSLRNPLLVTDQLEMFELMQHNIELNNLQDKAKAMVLNWGEDLPAAVLEQKPDVILAGECVYFEPAFPLLMSTLKALLELNPNAVVYFCFKKRRRADMNFVKMAKKAFKVEEIFDEDRPVFQRQGLFLFSFTSRPSPTRATKSQSDPQSVE

SEQ ID NO: 5125 - DNA, 747 bp, Candida glabrata CBS 138
  CDS (1)..(747)
atggaagatattttgggatttggtgatttgatcgagagcaggccagtagagcatatgggtcaaagcgacttgacattcaatggaatgcttgtaccagggttaaaaatctacgaggatggtggtgaaagtggctgtggaggtaaagtctggattgccggtgagcttctttgtgaatttatactggaaaagtccagagacggtgaactactgaaggactggataaacgatgactcagtatcatttggtaatgtcttggagcttggtagcggaactggactagttggactgtgtgtcggtttggtgacgaaaaaacaaagccagcgaatggtgaaaacctacatcaccgacattgaccagttggtaccgttgatggagaagaatgtcgagttaaatctaatcgatcaacaagtttttgcaaaagaattgttatggggagaagcattgccaattgaatttgccccagtaaaaactggacatgcgaccactagttctcttgatttggtccttgctgctgattgtgtgtacttggagaaagccttccctctactagaaaaaacattacttgacttgacagagtgtgataacccaccagtgatcctaatggcttacaggaaaagaagaaaagctgataagcatttctttcaaaagatcagaaagaactttaatgttatagtcatcaatgattttaaaaactacgaccaatatctgaaacaaagaacacatctgttccaattggttcgtaaatag

SEQ ID NO: 5126 - protein, 248 aa, Candida glabrata CBS 138
MEDILGFGDLIESRPVEHMGQSDLTFNGMLVPGLKIYEDGGESGCGGKVWIAGELLCEFILEKSRDGELLKDWINDDSVSFGNVLELGSGTGLVGLCVGLVTKKQSQRMVKTYITDIDQLVPLMEKNVELNLIDQQVFAKELLWGEALPIEFAPVKTGHATTSSLDLVLAADCVYLEKAFPLLEKTLLDLTECDNPPVILMAYRKRRKADKHFFQKIRKNFNVIVINDFKNYDQYLKQRTHLFQLVRK

SEQ ID NO: 5127 - DNA, 801 bp, Kluyveromyces lactis NRRL Y-1140
  CDS (1)..(801)
atgtcacttttagaagtgctgacgagagatcgaaaagagcgaacagtgttggagacctgtaaggcattcattatgggggatgtgccgttttcaagttgttttgaggaactagtgccagctaggccaattgagcatctgggcaaaattgatatgtctttcaatggaaaactgccgagtcctcttataatcaatgaagatggtggtgaatccggatgcggaggtaaagtgtggatagcaggtgaactgctatgcgaatatatccttgaaaaatccgacaaggaacatttgctaagtcatttgtttccagatgggaattgcaatagcgttttggaactgggtagtggtacaggtctagttgggctttgtgttggtctaatggatcaagcgaatgaatattcagatcgtgaagtttatatttctgacattgatcagctgcttggtctcatggaatctaatattcaagtcaacggattggatgataaggttcacgccgaggtgttatggtgggggaatcccttgccggatgtatttgtcaagaaaccggttgatttagtgctagctgcggactgtgtgtacttagaagctgctttcccattattggaaaaaacactgttagaattaactgatggggagaatgtgccaattattctaatggcatacaagaaaaggcgtaaagcggacaaacatttcttccaaaagatcaagaagaactttaaaattgtagagatacgagattttattaacttcgataaatatttgaaacagagaactcatttgtttcagcttatgagggagaaataa

SEQ ID NO: 5128 - protein, 266 aa, Kluyveromyces lactis NRRL Y-1140
MSLLEVLTRDRKERTVLETCKAFIMGDVPFSSCFEELVPARPIEHLGKIDMSFNGKLPSPLIINEDGGESGCGGKVWIAGELLCEYILEKSDKEHLLSHLFPDGNCNSVLELGSGTGLVGLCVGLMDQANEYSDREVYISDIDQLLGLMESNIQVNGLDDKVHAEVLWWGNPLPDVFVKKPVDLVLAADCVYLEAAFPLLEKTLLELTDGENVPIILMAYKKRRKADKHFFQKIKKNFKIVEIRDFINFDKYLKQRTHLFQLMREK

SEQ ID NO: 5129 - DNA, 696 bp, Yarrowia lipolytica CLIB122
  CDS (1)..(696)
atggaaattctacagatcgaaacggaggtgctgcccgcagcggtggtcgacgttcccgagcgtctgaatcttggcagatccaacctcaactttgatgggctgctcaagggcgacggactcaagattgaggaagacggaggggcggcaggctgtggcggcaagctgtggcccgctggcgaaatgctggcctactatctgctacggaaaggcattcagtcctatccccgagtgctggaaattggctcaggtacaggtctgactggactggcaatagccctctcggaatcagcccctcctaatctcaaggtatgggtcacagatcaagaaaacatgattcccctgatgaaccagaacattgagctcaacaaccttcaggacaaggtcgtcgctgaggtgcttgattggggtgaggagctgcccgagttccttgagggacagcccgtcgacctggtccttgctgctgactgtgtctaccttgagtcggcctttcctctgctggaaaaaactctcattgatctgtccaacaaggacaccaagattctcatgagctacaagaagcgaagaaaggccgactcgcgcttctttaagagcgtcaagaagcactttaccattgtggaaatctccgactttgaggagcacgcccggttcaagaaggacggagtaaccctcatggagctcaagaagaagacaaagtga

SEQ ID NO: 5130 - protein, 231 aa, Yarrowia lipolytica CLIB122
MEILQIETEVLPAAVVDVPERLNLGRSNLNFDGLLKGDGLKIEEDGGAAGCGGKLWPAGEMLAYYLLRKGIQSYPRVLEIGSGTGLTGLAIALSESAPPNLKVWVTDQENMIPLMNQNIELNNLQDKVVAEVLDWGEELPEFLEGQPVDLVLAADCVYLESAFPLLEKTLIDLSNKDTKILMSYKKRRKADSRFFKSVKKHFTIVEISDFEEHARFKKDGVTLMELKKKTK

SEQ ID NO: 5131 - DNA, 945 bp, Ustilago maydis 521
  CDS (1)..(945)
atgccatcaacgcaggctgccgacgacgtgcgcgcggagctcgaacgcgaagaagagctcgatcttgtggatccattacgccactttctcgccgtggacgacgacgaacaaggacagctccacgatgcaacgcattctgcttctcacaagaccgcagatgtgcgtgagcctggctcgaacaccaagtaccgcattgtgccacaccaaatcgaaagcatcatcgatcggcgtacctcgatccggtactactgcgatctgtcacgtcgaccggagctgatcgatgacgcggttcagtcggacgcacatctagagaatgtgcgctggtgggatgtacatctgaagctcgacatgacgagtggatgtggtggcaaaatctggcccgcagctgaagtgctcggtgcttacatagctggtaaatactcgtgccccgctgacgctccagaggaccgcacaccaacgtcgaaccagcggttcaacaatcacaacttcgactggcgcaacaagagcatcattgagctcggttcaggcactggactggttggctaccttgttcacgcactcggcctctcgaactgccgaatctgggtcacggatcaagacgtcatgctcccactgatgcgagacaacctcgcactcaacttccacctggatcccaactcgccttgctcctcgatcgcttacagccccgaccaatcaggcttcgtccaagtagcagagctcaattggggccaacgtctccccgaattcgccaccacgcatcctccagacgtgttgctgctggctgactgcgtctacctcgaatctgccttccaaccgctgatcgataccatggtccatctttcgacccagcgaaccgagatcctgttttgctaccaaaagcgcaggaaggccgataaacgcttttttgctctgctcaagaggagtttcgttttcgaaaatatgtag

SEQ ID NO: 5132 - protein, 314 aa, Ustilago maydis 521
MPSTQAADDVRAELEREEELDLVDPLRHFLAVDDDEQGQLHDATHSASHKTADVREPGSNTKYRIVPHQIESIIDRRTSIRYYCDLSRRPELIDDAVQSDAHLENVRWWDVHLKLDMTSGCGGKIWPAAEVLGAYIAGKYSCPADAPEDRTPTSNQRFNNHNFDWRNKSIIELGSGTGLVGYLVHALGLSNCRIWVTDQDVMLPLMRDNLALNFHLDPNSPCSSIAYSPDQSGFVQVAELNWGQRLPEFATTHPPDVLLLADCVYLESAFQPLIDTMVHLSTQRTEILFCYQKRRKADKRFFALLKRSFVFENM

SEQ ID NO: 5133 - DNA, 1152 bp, Cryptococcus neoformans var. neoformans B-3501A
  CDS (1)..(1152)
atgagcccaccacgatatactatacttgggagcacgtacaaacctctagatgtccctttaccgaagaatgtgcaagtgggagagtcatggcgtctcggtcttttttcccataatgaaaatccgcatagttcaaatgggctattaagcggggaggaacggaaatggaagttggaacctacaaatgaactgctagacctgatcgacgatactccagatgttttgggcgtctggtcagaaggcattgaaatagcccgtgctgtatctggcctcaattccggtacgatccgcggacttggtagacaaaaggagccttcaatagataagggaaaatcaaagggaaaaagcaaagggaaagaaaaggagaaggagagagatgatcgaccaaagcaaggaagaataatgagagaatgggcgttacctgaagagggaactttgagaatcattgaacagacctctttcgaccttgacaagaaagtatgggactctggcctggctctgtcagcctggttttggaagcaccttgccaacgaaggatcactacctctaacaggccagaagatcttcactctcttgaagaggcaagaaaaacttagaattgttgaactcggcaccggtaccggcctcgtgtctatagttctctcccttgcactcaagcgcatcgcctctttggaaagaaagataacagcaactgatctcgaatctgccatacctctcatggacgaaaacattgctctcaacaatctaaactcccagatgaaccatatctctactgaccacgagaatgaacaaggagagcagtccaagggtaccttggtcgacgcgagggtactagactgggatcagcctatacctgcttgggtgaataatgaccatccagagcttgtaatagccgcagatgttacctacaatactagcgcgtttccctctctactctctactctcacttcccttctcctcccttcggcttcttctgccagtttaccaaatagaccattattggtattggcgtacaaggagcgcgatccggctgaacgcgagttatggggcatgctgaaggaaaagggcatagatatggtgatggtggatgaaattaaaggtgcggaggattatggatcaaccgagatttggattgggggaagcagcctttcttga

SEQ ID NO: 5134 - protein, 383 aa, Cryptococcus neoformans var. neoformans B-3501A
MSPPRYTILGSTYKPLDVPLPKNVQVGESWRLGLFSHNENPHSSNGLLSGEERKWKLEPTNELLDLIDDTPDVLGVWSEGIEIARAVSGLNSGTIRGLGRQKEPSIDKGKSKGKSKGKEKEKERDDRPKQGRIMREWALPEEGTLRIIEQTSFDLDKKVWDSGLALSAWFWKHLANEGSLPLTGQKIFTLLKRQEKLRIVELGTGTGLVSIVLSLALKRIASLERKITATDLESAIPLMDENIALNNLNSQMNHISTDHENEQGEQSKGTLVDARVLDWDQPIPAWVNNDHPELVIAADVTYNTSAFPSLLSTLTSLLLPSASSASLPNRPLLVLAYKERDPAERELWGMLKEKGIDMVMVDEIKGAEDYGSTEIWIGGSSLS

SEQ ID NO: 5135 - DNA, 957 bp, Cryptococcus neoformans var. neoformans B-3501A
  CDS (1)..(957)
atgctcgaatcaaccgagcgggcccactctaggtcctcatcggtctcctccaccgccgctctcccttcttttgaagatctcgctccaccccgtccaccgcttacgggcggagagcaagaaacggctgtccctgtacctgggctcgggagagatgtcaagttgaaggtagatgcaggtcctggatgcggtgggatcgcttggccggctggagaggtgttatccaggtacctcgcgtacagacatggattagatccttcccatttggtaggtaagacagtcatagagcttgggtctgggactggacttgttggaatagcggctgccatgttggagcccacatccgatgtctgggtgaccgaccaatcgatgttactcggtctcatggaagataatgcaaagctcaacttggccgatcttcagagggacaatgttcatgtagcggagttgaactggggagagcctctgccagctgaaatccccttagagaaatcttccctcatcctcgctgctgattgtgtctactttgagcccgcattcccattattagtccagaccctttgtgacttggctccgataggtaaagacattgaaatcctcttttgttggaagaaacgaaggaaggcagacaaacgattctttgccatgctcaagaaacatttcgcgcaagagattgttgaggatgataagcctggagagagggagagatgtggcagggaaggtgtgacgttgatgaggttaatgaggagaaactttttactcgccacatatgcttatccactgcatttctctcttctgataatcaacattactcctggaatgacagcaacgatcctcaagctcgtgcgttacaagagaaggcagagcgccaatatactattctactttttccaatggtcaactcgaacaagcgttctgaatgctccaatatgtttcggatggtatatcgttcgatcctga

SEQ ID NO: 5136 - protein, 318 aa, Cryptococcus neoformans var. neoformans B-3501A
MLESTERAHSRSSSVSSTAALPSFEDLAPPRPPLTGGEQETAVPVPGLGRDVKLKVDAGPGCGGIAWPAGEVLSRYLAYRHGLDPSHLVGKTVIELGSGTGLVGIAAAMLEPTSDVWVTDQSMLLGLMEDNAKLNLADLQRDNVHVAELNWGEPLPAEIPLEKSSLILAADCVYFEPAFPLLVQTLCDLAPIGKDIEILFCWKKRRKADKRFFAMLKKHFAQEIVEDDKPGERERCGREGVTLMRLMRRNFLLATYAYPLHFSLLIINITPGMTATILKLVRYKRRQSANILFYFFQWSTRTSVLNAPICFGWYIVRS

SEQ ID NO: 5137 - DNA, 603 bp, Phaeosphaeria nodorum
  CDS (1)..(603)
atgtcagacagtgaagagtacgacgtatttggtgtgagtcaggatctcgtcccgccagcgcctatcaagccagctggagcatccgagatcgactttgatgggctgctctcgccaccactgaagctgcacgaggacctgaagaatggtgtcgagttgggtgctggtggtgggcttgttggccttgccgtagtgctaggctgcaaaaccgacaaacccctacacatcactgatcaagagcccatgttcgatctgatgaaacgtaacatcacactcaacaacctcgacttacgcgtaactgcatcaatatacgactggggtgcggcgaaatcaccgaagctgccaccgcatccggacatcattcttgccgctgactgcgtgtacttcgaacctgcgtttccactgcttcaaaaaacactaagcgatcttattggcgataataccgtctgttacttctgctttaagaagcgcagaagagcggatttgcagttcatgaaagttgcgaggaagatgttcgatgtgaagcaggtggatgatgatccggataaggaggtttactcgagggagaatctattcctgtaccgcttcacgaagaaacggatatga

SEQ ID NO: 5138 - protein, 200 aa, Phaeosphaeria nodorum
MSDSEEYDVFGVSQDLVPPAPIKPAGASEIDFDGLLSPPLKLHEDLKNGVELGAGGGLVGLAVVLGCKTDKPLHITDQEPMFDLMKRNITLNNLDLRVTASIYDWGAAKSPKLPPHPDIILAADCVYFEPAFPLLQKTLSDLIGDNTVCYFCFKKRRRADLQFMKVARKMFDVKQVDDDPDKEVYSRENLFLYRFTKKRI

SEQ ID NO: 5139 - DNA, 807 bp, Medicago truncatula
  CDS (1)..(807)
atggaggaagaagaagagaatgcaacagcggcaatggtgaagttaggttcatacggtggttcagtgatgttggtggttcctggggaggaatcagctgcggaagagaccatgcttctttggggtattcagcagcctactctttccaaacccaacgcttttgttgctcaatcttccttgcaactccgccttgactcttgtggtcactctctctccattcttcaatccccttcttccttgggcaagcctggagtaactggatcagtgatgtgggacagtggaattgtgctggggaagtttctagagcattctgttgactcaggaatgcttgttctacaaggcaagaagattgttgaattgggatctggttgcggattggttggttgcattgcagctcttttgggtggagaagtcattcttactgatctgcctgataggatgaggcttctcagaaaaaacattgaaaccaatatgaagcatatttctctgcgcggttctataacagcaactgaacttacatggggagatgatcctgatcaagaactcattgacccgacacctgattacatactaggatctgacgtggtatacagtgagggcgctgtcgtagatctgctagagacacttggccagctatctgggcctaacacaacaatttttttggctggggaactcagaaatgatgcaattcttgagtacttcttagaagctgcaatgaacgatttcacaattggccgtgtggatcaaacgctatggcatcctgattatcacagcaatcgtgttgttctttatgttctagttaagaaatga

SEQ ID NO: 5140 - protein, 268 aa, Medicago truncatula
MEEEEENATAAMVKLGSYGGSVMLVVPGEESAAEETMLLWGIQQPTLSKPNAFVAQSSLQLRLDSCGHSLSILQSPSSLGKPGVTGSVMWDSGIVLGKFLEHSVDSGMLVLQGKKIVELGSGCGLVGCIAALLGGEVILTDLPDRMRLLRKNIETNMKHISLRGSITATELTWGDDPDQELIDPTPDYILGSDVVYSEGAVVDLLETLGQLSGPNTTIFLAGELRNDAILEYFLEAAMNDFTIGRVDQTLWHPDYHSNRVVLYVLVKK

SEQ ID NO: 5141 - DNA, 711 bp, Aspergillus oryzae
  CDS (1)..(711)
atgatggaagcttccaattctcccgaccaacaatcagtgctcagtgaatctatccttgttagcgagtcgcttgttccagcaagggatctcaaaggagttggccatgctgaaatttcatttgacggcctactgaaagaccccctaataatcaaggaagatctgaaggaagggtgcggaggccagctatggccggcaggcatggtcctagcaagatatttgttacttcagcaccgatctgactttaacaataagacaattgtcgagttgggagctggcggaggtcttgtggggcttgctgttgcgcgcggttgcgacatcgggtcgtcatcagtatacattacggatcaagcaccaatgctcccattaatggagactaatattaagctgaacaatgtttcctctcgtgttgcagctacggtgctaaactggggggaatctcttccagactgtattccgaaacaccccgctatcgtacttgccgcggactgtgtctattttgagccggcctttcctttgctgatatcaactctgaaaaacctcctaggcccagaatctatttgctatttctgcttcaagagacgtagacgagcagattctcgatttttgaaattggcaaagaagctattccacatagtcgaagtttgcgatgacccgatggcggagacttacaagcgagaaaacattttcctctattcaatacgttcgaaatag

SEQ ID NO: 5142 - protein, 236 aa, Aspergillus oryzae
MMEASNSPDQQSVLSESILVSESLVPARDLKGVGHAEISFDGLLKDPLIIKEDLKEGCGGQLWPAGMVLARYLLLQHRSDFNNKTIVELGAGGGLVGLAVARGCDIGSSSVYITDQAPMLPLMETNIKLNNVSSRVAATVLNWGESLPDCIPKHPAIVLAADCVYFEPAFPLLISTLKNLLGPESICYFCFKRRRRADSRFLKLAKKLFHIVEVCDDPMAETYKRENIFLYSIRSK

SEQ ID NO: 5143 - DNA, 879 bp, Arabidopsis thaliana
  CDS (1)..(879)
atgggcaaggaggatgaggcggtggaggagatacgacgtatgagtggttacggcggagatgtgatagtagtaggtgggtttccggcgtcggagtcggaatctgaatctgaatccgatttggcggcggcggagattatggttatatgggctattcaagggccaacttcttttgctccaaacacactcgttgctcaatcttctcttgagctgcgtctcgacgcttgtggccactcactctctattctccagtcgccatgttcattgaacacgcctggagtaaccgggtcagtgatgtgggacagtggagtggtgctagggaagttcttagaacattctgttgactctaaggttctttctcttgaaggcaagaaaatcgtcgagttgggttctggctgtggcttagttggttgtatagcagcacttttgggaggcaatgctgtcctcactgatcttccagatagactgaggctactcaaaaagaacatccaaaccaatttgcaccgtgggaacacgcgtggatctgctattgtgcaggaacttgtttggggagatgaccctgatccagatttgatcgaaccattccctgattacgtattaggctcagatgttatatacagcgaagaagctgttcaccatttggtaaaaacgcttttgcaactttgcagcgatcaaactacaatcttcctatcaggagaactacgaaatgatgctgttcttgagtacttcttagaaaccgcactgaaagattttgcgatcgggcgtgtggaacaaacacaatggcatccagattatcgcagccatcgagtagtgctttacgttcttgaaaagaagtcgaagagatgcctcgctgatgaatcttcgcttaatcaatcttgttag

SEQ ID NO: 5144 - protein, 292 aa, Arabidopsis thaliana
MGKEDEAVEEIRRMSGYGGDVIVVGGFPASESESESESDLAAAEIMVIWAIQGPTSFAPNTLVAQSSLELRLDACGHSLSILQSPCSLNTPGVTGSVMWDSGVVLGKFLEHSVDSKVLSLEGKKIVELGSGCGLVGCIAALLGGNAVLTDLPDRLRLLKKNIQTNLHRGNTRGSAIVQELVWGDDPDPDLIEPFPDYVLGSDVIYSEEAVHHLVKTLLQLCSDQTTIFLSGELRNDAVLEYFLETALKDFAIGRVEQTQWHPDYRSHRVVLYVLEKKSKRCLADESSLNQSC

SEQ ID NO: 5145 - DNA, 1470 bp, Oryza sativa subsp
  CDS (1)..(1470)
atggaccacgaaaggcaagcaaaccttctccgcgttggaacctcttcctcctcccccaagttgaactccccgagcacgtccgcgatttcgctggagttgctgggccatcggctgcacatttctcaggatcctaactcgaagcacctcggaaccacggtctgggatgcatccatggtgttcgtcaagttcttggaaaagaatagcagaaaaggtagattttctccatctaaactgaaaggaaaaagggtgattgagctaggagctggttgtggtctagctgggcttggaatggctttgctgggttgtgacgtggttacaacagaccaagttgaggtgctcccgctgcttttgaggaatgttgaacgcaacaaatcttggatttcacagtcaaactctgactcaggctccatcggctctgtcaccgttgcagaattggactggggtaacaaagatcatataagagctgttgatcctccattcgattacatcattggaactgatgttgtttattcagaacatctgttgcaacctctaatggagacaatcattgcattatctggtcctaaaacaaaaataatgctaggatacgagatccgttctaccactgtccatgaacagatgatgcaaatgtggaaaagcaattttaatgtgaaaaccgtctcgaaatcgaagatggatgtgaaataccaacatcctagtattcatctttacataatggaccccaaagcgacattgatccctgaggtcagcgataacggcaacaacgaggaggaggaggttgtctccaatccaggagatgatgaagatcctggagctgagagtggtggaccttgtactggctcagtggattcagcagaagccaaaactgcaggctacttggacgacgactgggaaatcagaagatgcggggctatggctgcaagacttcttaaggatagtgctagtacattttttgagatgttgagtgcatatgatcgccggcggcttgcaagaggagtgagccgccgccgtgccatcaccggcgagctcattgactcctcgtcggtggattgtaggactatttttctctgcaaattctgctcgttcgcgaccaatggtagtgaccatagtctcaacctggaggggctcgccatcccctctgctccgctcccgtcgtccccgtcgtccccgtcgtcccctacgcctcgttcgcgcatttcgtcgaacaccgtgacggcgccgaattcgcactgtccgcacatctcctcctcctcccccgtcctctccaaaccccaaaccctatctcccgtcctctccaaaccccaaaccctatctccacccccgaggcaggcgcccccatgcacttgtaagtcgattggatgtcctgtcccagaagacatatcgagcgaggaggcggaggaggacgaagggaagcggatcctagggcttcaaccatggatcggcatcccccatttcaaggtcatcccctga

SEQ ID NO: 5146 - protein, 489 aa, Oryza sativa subsp
MDHERQANLLRVGTSSSSPKLNSPSTSAISLELLGHRLHISQDPNSKHLGTTVWDASMVFVKFLEKNSRKGRFSPSKLKGKRVIELGAGCGLAGLGMALLGCDVVTTDQVEVLPLLLRNVERNKSWISQSNSDSGSIGSVTVAELDWGNKDHIRAVDPPFDYIIGTDVVYSEHLLQPLMETIIALSGPKTKIMLGYEIRSTTVHEQMMQMWKSNFNVKTVSKSKMDVKYQHPSIHLYIMDPKATLIPEVSDNGNNEEEEVVSNPGDDEDPGAESGGPCTGSVDSAEAKTAGYLDDDWEIRRCGAMAARLLKDSASTFFEMLSAYDRRRLARGVSRRRAITGELIDSSSVDCRTIFLCKFCSFATNGSDHSLNLEGLAIPSAPLPSSPSSPSSPTPRSRISSNTVTAPNSHCPHISSSSPVLSKPQTLSPVLSKPQTLSPPPRQAPPCTCKSIGCPVPEDISSEEAEEDEGKRILGLQPWIGIPHFKVIP

SEQ ID NO: 5147 - DNA, 945 bp, Arabidopsis thaliana
  CDS (1)..(945)
atgtttggtccgtcgatgcacatggaagcagcagagatagtccattcggcggcgcgttttgaagctgagaaaatgggcaaggaggatgaggcggtggaggagatacgacgtatgagtggttacggcggagatgtgatagtagtaggtgggtttccggcgtcggagtcggaatctgaatctgaatccgatttggcggcggcggagattatggttatatgggctattcaagggccaacttcttttgctccaaacacactcgttgctcaatcttctcttgagctgcgtctcgacgcttgtggccactcactctctattctccagtcgccatgttcattgaacacgcctggagtaaccgggtcagtgatgtgggacagtggagtggtgctagggaagttcttagaacattctgttgactctaaggttctttctcttgaaggcaagaaaatcgtcgagttgggttctggctgtggcttagttggttgtatagcagcacttttgggaggcaatgctgtcctcactgatcttccagatagactgaggctactcaaaaagaacatccaaaccaatttgcaccgtgggaacacgcgtggatctgctattgtgcaggaacttgtttggggagatgaccctgatccagatttgatcgaaccattccctgattacggctcagatgttatatacagcgaagaagctgttcaccatttggtaaaaacgcttttgcaactttgcagcgatcaaactacaatcttcctatcaggagaactacgaaatgatgctgttcttgagtacttcttagaaaccgcactgaaagattttgcgatcgggcgtgtggaacaaacacaatggcatccagattatcgcagccatcgagtagtgctttacgttcttgaaaagaagtcgaagagatgcctcgctgatgaatcttcgcttaatcaatcttgttag

SEQ ID NO: 5148 - protein, 314 aa, Arabidopsis thaliana
MFGPSMHMEAAEIVHSAARFEAEKMGKEDEAVEEIRRMSGYGGDVIVVGGFPASESESESESDLAAAEIMVIWAIQGPTSFAPNTLVAQSSLELRLDACGHSLSILQSPCSLNTPGVTGSVMWDSGVVLGKFLEHSVDSKVLSLEGKKIVELGSGCGLVGCIAALLGGNAVLTDLPDRLRLLKKNIQTNLHRGNTRGSAIVQELVWGDDPDPDLIEPFPDYGSDVIYSEEAVHHLVKTLLQLCSDQTTIFLSGELRNDAVLEYFLETALKDFAIGRVEQTQWHPDYRSHRVVLYVLEKKSKRCLADESSLNQSC

SEQ ID NO: 5149 - DNA, 906 bp, Oryza sativa
  CDS (1)..(906)
atggaccacgaaaggttgaactccccgagcacgtccgcgatttcgctggagttgctgggccatcggctgcacatttctcaggatcctaactcgaagcacctcggaaccacggtctgggatgcatccatggtgttcgtcaagttcttggaaaagaatagcagaaaaggtagattttctccatctaaactgaaaggaaaaagggtgattgagctaggagctggttgtggtctagctgggcttggaatggctttgctgggttgtgacgtggttacaacagaccaagttgaggtgctcccgctgcttttgaggaatgttgaacgcaacaaatcttggatttcacagtcaaactctgactcaggctccatcggctctgtcaccgttgcagaattggactggggtaacaaagatcatataagagctgttgatcctccattcgattacatcattggaactgatgttgtttattcagaacatctgttgcaacctctaatggagacaatcattgcattatctggtcctaaaacaaaaataatgctaggatacgagatccgttctaccactgtccatgaacagatgatgcaaatgtggaaaagcaattttaatgtgaaaaccgtctcgaaatcgaagatggatgtgaaataccaacatcctagtattcatctttacataatggaccccaaagcgacattgatccctgaggtcagcgataacggcaacaacgaggaggaggaggttgtctccaatccaggagatgatgaagatcctggagctgagagtggtggaccttgtactggctcagtggattcagcagaagccaaaactgcaggctacttggacgacgactgggaaatcagaagatgcggggctatggctgcaagacttcttaaggatgtcaaacttgcatga

SEQ ID NO: 5150 - protein, 301 aa, Oryza sativa
MDHERLNSPSTSAISLELLGHRLHISQDPNSKHLGTTVWDASMVFVKFLEKNSRKGRFSPSKLKGKRVIELGAGCGLAGLGMALLGCDVVTTDQVEVLPLLLRNVERNKSWISQSNSDSGSIGSVTVAELDWGNKDHIRAVDPPFDYIIGTDVVYSEHLLQPLMETIIALSGPKTKIMLGYEIRSTTVHEQMMQMWKSNFNVKTVSKSKMDVKYQHPSIHLYIMDPKATLIPEVSDNGNNEEEEVVSNPGDDEDPGAESGGPCTGSVDSAEAKTAGYLDDDWEIRRCGAMAARLLKDVKLA

SEQ ID NO: 5151 - DNA, 816 bp, Oryza sativa
  CDS (1)..(816)
atggagatggatccccctcggctgggcatgggcgcgtactccggccccgtccgcccggtcggggacggggacggcggcgccgcgggcgagacgatgctgctctgggccctcggccagccggcagcgcagcgccacaacgccttcgtccgccacggcgcgcactccctcaccctcgacgcctgcggccgccgtctctccctgctccagtccccgtcctccatgtccacgcccggcgtcaccggcgccgttgtgtgggacagcggcgtcgtcctcgccaagttcctcgagcacgccgtcgactcgggcctccttaccctccgggccgcgcgggcgctcgagctgggagcgggctgcggccttgctggctgcgtcgccgcgctcctcggagcccacgtgctgctcaccgacctccctgaccgcctcaagctcctcaggaagaatatcgacctcaacgtcggggacgacgcaaggggctctgctcgggtcgcccaactcgtctgggctgatgatcctcacccggacttgctcaacccacctctagattacgtgcttgggtcggacgtgatctacagcgaggaggcagtggatgatctgctgctcaccctcaagcacctctcagcccctcacaccaccatcatcctcgcagcagaactccgcaatgatgctgtactggagtgcttcttggaggcagcaatggcggacttccaagtcggctgcatcgagcaacagcaatggcacccagatttccgctctacacgtgttgccttgttcatcttgctcaagaaaccaccttcccaaccggacgtgctgctctag

SEQ ID NO: 5152 - protein, 271 aa, Oryza sativa
MEMDPPRLGMGAYSGPVRPVGDGDGGAAGETMLLWALGQPAAQRHNAFVRHGAHSLTLDACGRRLSLLQSPSSMSTPGVTGAVVWDSGVVLAKFLEHAVDSGLLTLRAARALELGAGCGLAGCVAALLGAHVLLTDLPDRLKLLRKNIDLNVGDDARGSARVAQLVWADDPHPDLLNPPLDYVLGSDVIYSEEAVDDLLLTLKHLSAPHTTIILAAELRNDAVLECFLEAAMADFQVGCIEQQQWHPDFRSTRVALFILLKKPPSQPDVLL

SEQ ID NO: 5153 - DNA, 25 bp, Artificial sequence
  primer
atggagagtatatttggtgggtttg

SEQ ID NO: 5154 - DNA, 25 bp, Artificial sequence
  primer
ttacttcctgataagctgaaacaag

SEQ ID NO: 5155 - protein, 237 aa, Artificial sequence
  consensus sequence
  Variant (2)..(4): Xaa in position 2 to 4 is any amino acid
  Variant (6)..(6): Xaa in position 6 is any amino acid
  Variant (7)..(50): Xaa in position 7 to 50 is any or no amino acid
  Variant (54)..(54): Xaa in position 54 is any amino acid
  Variant (56)..(56): Xaa in position 56 is any amino acid
  Variant (59)..(59): Xaa in position 59 is any amino acid
  Variant (61)..(72): Xaa in position 61 to 72 is any amino acid
  Variant (73)..(79): Xaa in position 73 to 79 is any or no amino acid
  Variant (82)..(87): Xaa in position 82 to 87 is any amino acid
  Variant (89)..(91): Xaa in position 89 to 91 is any amino acid
  Variant (93)..(95): Xaa in position 93 to 95 is any amino acid
  Variant (97)..(106): Xaa in position 97 to 106 is any amino acid
  Variant (107)..(126): Xaa in position 107 to 126 is any or no amino acid
  Variant (128)..(128): Xaa in position 128 is any amino acid
  Variant (131)..(146): Xaa in position 131 to 146 is any amino acid
  Variant (147)..(156): Xaa in position 147 to 156 is any or no amino acid
  Variant (158)..(159): Xaa in position 158 to 159 is any amino acid
  Variant (161)..(161): Xaa in position 161 is any amino acid
  Variant (163)..(163): Xaa in position 163 is any amino acid
  Variant (165)..(167): Xaa in position 165 to 167 is any amino acid
  Variant (169)..(170): Xaa in position 169 to 170 is any amino acid
  Variant (172)..(174): Xaa in position 172 to 174 is any amino acid
  Variant (176)..(203): Xaa in position 176 to 203 is any amino acid
  Variant (204)..(213): Xaa in position 204 to 213 is any or no amino acid
  Variant (215)..(233): Xaa in position 215 to 233 is any amino acid
  Variant (234)..(236): Xaa in position 234 to 236 is any or no amino acid
GXXXWXXXXXXXXXXXXXXXXXXXXXXXXXXXXXXXXXXXXXXXXXXXXXELGXGXGLXGXXXXXXXXXXXXXXXXXXXTDXXXXXXLXXXNXXXNXXXXXXXXXXXXXXXXXXXXXXXXXXXXXXLXWGXXXXXXXXXXXXXXXXXXXXXXXXXXDXXYXEXAXXXLXXTXXXLXXXXXXXXXXXXXXXXXXXXXXXXXXXXXXXXXXXXXXFXXXXXXXXXXXXXXXXXXXXXXL

SEQ ID NO: 5156 - protein, 20 aa, Artificial sequence
  protein pattern
  Variant (2)..(2): Xaa in position 2 is Cys or Val
  Variant (3)..(3): Xaa in position 3 is Ile or Val
  Variant (5)..(5): Xaa in position 5 is any amino acid
  Variant (7)..(10): Xaa in position 7 to 10 is any amino acid
  Variant (11)..(11): Xaa in position 11 is any or no amino acid
  Variant (13)..(14): Xaa in position 13 to 14 is any amino acid
  Variant (15)..(15): Xaa in position 15 is any or no amino acid
  Variant (17)..(17): Xaa in position 17 is Ile or Leu
  Variant (18)..(19): Xaa in position 18 to 19 is any amino acid
DXXYXEXXXXXLXXXTXXXL

SEQ ID NO: 5157 - protein, 10 aa, Artificial sequence
  protein pattern
  Variant (4)..(4): Xaa in position 4 is Ala or Ser
  Variant (6)..(6): Xaa in position 6 is Cys, Gly or Thr
  Variant (9)..(9): Xaa in position 9 is Ala, Ile or Val
  Variant (10)..(10): Xaa in position 10 is Gly or Ser
ELGXGXGLXX

SEQ ID NO: 5158 - protein, 14 aa, Artificial sequence
  protein pattern
  Variant (2)..(2): Xaa in position 2 is Gly, Ser or Thr
  Variant (3)..(4): Xaa in position 3 to 4 is any amino acid
  Variant (6)..(6): Xaa in position 6 is any amino acid
  Variant (7)..(7): Xaa in position 7 is Ala or Ser
  Variant (8)..(8): Xaa in position 8 is Ala, Gly or Ser
  Variant (9)..(9): Xaa in position 9 is any amino acid
  Variant (10)..(10): Xaa in position 10 is Leu, Met or Val
  Variant (11)..(11): Xaa in position 11 is Phe or Leu
  Variant (12)..(12): Xaa in position 12 is Ala, Cys, Gly, Ser or Val
  Variant (13)..(13): Xaa in position 13 is any amino acid
  Variant (14)..(14): Xaa in position 14 is Phe, His or Tyr
GXXXWXXXXXXXXX

SEQ ID NO: 5159 - DNA, 1263 bp, Saccharomyces cerevisiae
  CDS (1)..(1263)
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 5160 - protein, 420 aa, Saccharomyces cerevisiae
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGFLLHPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 5161 - DNA, 1245 bp, Ashbya gossypii
  CDS (1)..(1245)
atggcacgcggaaaggtttgcttggcatactcaggaggcctggacacttcggtgatcctcgcctggttactggagcagggttatgaagttgtagcgtttatggctaatgttgggcaagaggaagatttccaggctgcggaagagaaggcattgaagataggagcgtccaagtttgtgtgcgttgactgccgtgagcagttcgtgacggatgtcttgtttcctgcggtgcaggtgaacgcggtgtacgaagatgtttatctactggggacgtcgcttgcacggcccgtgattgccaaggcacagatcgacatcgcggagcaggagcattgttttgcggtcgctcacggatgcactgggaagggcaacgatcagatccggtttgagcttgcgttctacgcgctgaagccagacgtccaggttatcgcgccatggcgggaccctgcgtttttcgaccggtttgcaggtagaaatgacttgctagagtgtgcggcagagaaacagatacctgttgcgcagaccaaggccaaaccgtggtctaccgacgagaacgaggcgcatatatcgtacgaggctggaattttggaggatcccgatgtcacaccaccggcagacatgtggaagctcacgacagacccgcttcgagcaccaagtgagcctgaggacgtgacgttggtgttcaaggagggtgtccccactcagatgatttacaaggatggagaggcgagcaaaccgttggatatttttcttgcggcttccaaagtggcgcgtagaaacggcgttggcagaatcgacatcgtggaaaaccgttacatcaacctgaagtcgcgtggctgctacgaacaggcaccactgacactcctgcgccgggcccacgtgtatctcgagggtctcaccctggacaaagaggttcggcatttgcgtgaccaatttgttacgccgacttactctcgcctcctctacaatggctcctacttttctccggaatgcgagtatatccgtagcatgattaagccatcccaaattacggtaaatggccaggttcgcttgagactttacaagggtaatgtcattgtgttgggcaggtcctcggaaactgagaacttgtatgatgcgacggagtcctccatggacgaattgaccggattccagccgactgataccactggtttcatcgctattcaagcaattcgcatgaaaaagtacggtcaatccaagaaggacaaaggtgaatccctgactttgtaa

SEQ ID NO: 5162 - protein, 414 aa, Ashbya gossypii
MARGKVCLAYSGGLDTSVILAWLLEQGYEVVAFMANVGQEEDFQAAEEKALKIGASKFVCVDCREQFVTDVLFPAVQVNAVYEDVYLLGTSLARPVIAKAQIDIAEQEHCFAVAHGCTGKGNDQIRFELAFYALKPDVQVIAPWRDPAFFDRFAGRNDLLECAAEKQIPVAQTKAKPWSTDENEAHISYEAGILEDPDVTPPADMWKLTTDPLRAPSEPEDVTLVFKEGVPTQMIYKDGEASKPLDIFLAASKVARRNGVGRIDIVENRYINLKSRGCYEQAPLTLLRRAHVYLEGLTLDKEVRHLRDQFVTPTYSRLLYNGSYFSPECEYIRSMIKPSQITVNGQVRLRLYKGNVIVLGRSSETENLYDATESSMDELTGFQPTDTTGFIAIQAIRMKKYGQSKKDKGESLTL

SEQ ID NO: 5163 - DNA, 1227 bp, Neurospora crassa
  CDS (1)..(1227)
atgtctgagtccaagggccgcgtctgtctcgcctattccggaggtcttgatacttccggctacaccgtcgtctgcttcctcgccaatgtcggccaggaggagaactgggatgaggtccgcgccaaggccaagaagctcggtgctgaggagatggtgatcctcgacctccagcaggagttcgttgaccagatcgtcttccgtgccatccagtgcaatgccatctatgaggaccgctacctcctcggcacctccctcgcccgccccatcattgcccgtgcccaggtccgcgttgccgagcaatacaactgcgagttcgtctcccacggctgcactggcaagggcaacgaccaggtccgcttcgagcttgccttcaaggcctgcaaccccgagatcaaggtcattgctccctggagacttcccgagttctgtgctcgcttccagggtcgtcaggatctcctgaagtacgccgccgacaagaacatccccgtctcctcgacccccaaggccccttggtccatggatgacaaccttgtccactgcagctacgaggctggcattcttgaggaccccaaccacactccccccaaggagctctggacccgcactgttgacccccaggacgcccccaacactccccaggagttcaccatcgtctttgagaagggtatccccgtcaaggtcattgtcgatggcaaggagaccactggctctgttgagctcttcaagctcctcaacaagattggtcacgaccacggtgttggccgtgtcgatatcgttgagaaccgcttcatcggtctcaagtcccgtggctgctacgatactcccggcctcaccattgctcgccttgcccatcttgatcttgagggtcttgttatggactctagggtccgtgagctccgtgatcagttcgtcaccatctcctggtctcgtcagctgtacaacggcatgtacttcagccctgagcgcgagttcgtcgagaactccatcatcttctcccagcagaatgttactggtgaggtccgcatgatggcctacaagggtaacgcctacgtcctcggccgcaagtccgatgccagcaacctctactccgaggccgatgcctccatggactccctcgagggcttctcccccatggacaccaccggtttcattgagattaacgccatccgtctcaagaagtacggtcttcagaagattaaggacggcaagcccctcacccagtcttga

SEQ ID NO: 5164 - protein, 408 aa, Neurospora crassa
MSESKGRVCLAYSGGLDTSGYTVVCFLANVGQEENWDEVRAKAKKLGAEEMVILDLQQEFVDQIVFRAIQCNAIYEDRYLLGTSLARPIIARAQVRVAEQYNCEFVSHGCTGKGNDQVRFELAFKACNPEIKVIAPWRLPEFCARFQGRQDLLKYAADKNIPVSSTPKAPWSMDDNLVHCSYEAGILEDPNHTPPKELWTRTVDPQDAPNTPQEFTIVFEKGIPVKVIVDGKETTGSVELFKLLNKIGHDHGVGRVDIVENRFIGLKSRGCYDTPGLTIARLAHLDLEGLVMDSRVRELRDQFVTISWSRQLYNGMYFSPEREFVENSIIFSQQNVTGEVRMMAYKGNAYVLGRKSDASNLYSEADASMDSLEGFSPMDTTGFIEINAIRLKKYGLQKIKDGKPLTQS

SEQ ID NO: 5165 - DNA, 1413 bp, Kineococcus radiotolerans SRS30216
  CDS (1)..(1413): transl_table=11
atgtccaaggtgctcacgtccctgcccgccggcgaacgcgtcggcatcgccttctccggcggtctcgacacctccgtcgccgtggcgtggatgcgggagaagggcgcggtgccctgcacctacaccgccgacatcgggcagtacgacgaacccgacatcgactccgtgcccggccgcgccggggcctacggcgcggaactggcccggctggtggactgccgcgcggcgctcgtcgaggagggcctggccgccctgaccaccggcgcgttccacatccgctccgcggggcgcagctacttcaacaccacgcccctgggccgcgccgtcaccggcaccctgctggtgcgcgcgatgctggaggacgacgtccagatctggggcgacgggtccacctacaagggcaacgacatcgagcggttctaccgctacggcctgctcgccaacccctccctgcggatctacaagccgtggctggacgccgggttcgtcgccgagctcggcgggcgcaaggagatgtcggagtggctgcaggcgcgcgacctgccctaccgcgcgagcaccgagaaggcgtactccaccgacgcgaacatctggggcgccacccacgaggccaagcggctggagcacctcgacgtcggcgtcgagctcgtcgagcccatcatgggcgtgcggttctgggaccccgaggtcgagatcgcccccgaggacgtgagcatcgggttcgagcagggccggccggtctcgatcaacggcgcgaccttcgagagcgccgtcgacctcgtcctggaggccaacgccatcggcggccggcacgggctcggcatgtccgaccagatcgagaaccgcatcatcgaggccaagagccgcggcatctacgaggccccgggcatggcgctgctgcacgccgcctacgagcgcctcgtcaacgccatccacaacgaggacaccgtcgccagctaccacaacgagggccgtcgcctcgggcgcctcatgtacgagggccgctggctggacccgcaggccctcatgctccgggagtccctgcagcgctgggtcggcaacgccgtcaccggcaccgtcaccctgcgcctgcgccgcggggaggactactcgatcctcgacacgcagggcccggcgttcagctaccaccccgacaagctgtccatggagcgcaccgaggactccgccttcggccccgtggaccgcatcggccagctgacgatgcgcaacctcgacatcgccgactcccgcgccaagctggagcagtacgccgggatgggcatggtcggcagttcccaggtcagcctcatcggcgccctggagtccgggggcgcggaggcgatcgcctcgcgcggggagagcagcggggacgaactgctggaccgcgccgcgatggagtccggcaccgactga

SEQ ID NO: 5166 - protein, 470 aa, Kineococcus radiotolerans SRS30216
MSKVLTSLPAGERVGIAFSGGLDTSVAVAWMREKGAVPCTYTADIGQYDEPDIDSVPGRAGAYGAELARLVDCRAALVEEGLAALTTGAFHIRSAGRSYFNTTPLGRAVTGTLLVRAMLEDDVQIWGDGSTYKGNDIERFYRYGLLANPSLRIYKPWLDAGFVAELGGRKEMSEWLQARDLPYRASTEKAYSTDANIWGATHEAKRLEHLDVGVELVEPIMGVRFWDPEVEIAPEDVSIGFEQGRPVSINGATFESAVDLVLEANAIGGRHGLGMSDQIENRIIEAKSRGIYEAPGMALLHAAYERLVNAIHNEDTVASYHNEGRRLGRLMYEGRWLDPQALMLRESLQRWVGNAVTGTVTLRLRRGEDYSILDTQGPAFSYHPDKLSMERTEDSAFGPVDRIGQLTMRNLDIADSRAKLEQYAGMGMVGSSQVSLIGALESGGAEAIASRGESSGDELLDRAAMESGTD

SEQ ID NO: 5167 - DNA, 1194 bp, Lactococcus lactis subsp. lactis Il1403
  CDS (1)..(1194): transl_table=11
atgggaaacaaaaaaattgtcttggcatattcgggtggattggatacaagtgttgctgtaaaatggttgactgataaaggatttgacgtcattgctgactgcatggacgttggtgaaggaaaagacttgaattttattcatgataaggcgcttcaagtaggggcagtggaatctgttgttttggattgcaaggaagaattcgctaaaatatttgttggagctgcactcaaaggaaatttaatgtatgaaaataaatatcctttagtatccgctttgagtcgccctttgattgctcaaaaattagtagaagtagccaaagaaaaaggggcaacggctattgctcatggttgtacaggaaaaggaaatgaccaagtgcgttttgaagtagccatccattcccttgcgcctgagcttgaagtcattgctccagttcgtgaatggcattgggctcgtgaagaagaaatcgaatatgccaatcaaaatggtgttcctattcctgctgatttagacaatccctactcaattgacatgaatttatggggacgtgcgattgaagctggtgttcttgaaaatccttggaatacttgtccagaggatgctttctttatgactaattctgtagagaacgctccaaacgaagctgaatttatcgaggttgagtttaaagaaggattaccaatcgccttaaatggaaaaagcttagaattgcatgaaatcattaaaaaagtgaatattattgcaggaaaacatggaattggtcggattgaccatattgaaaatcgcctggttgggattaaatcccgtgaattttatgaatgtcctgctgccattactttattaaaagcacataaagatttggaagatttaactttcgttcgagaacttgcacattttaaaccagttcttgaaaatgaattagcaaacttgatttacaatggtttgtggttcaatcctgctactaaggctttgatcgcttatcttgatgaaactcaaaaagtagttaacgggattgtaaaaattaaattatataaaggtttagcaacaccagtgggacgtaaatcaactaattcgctttacagcgaaaaattagcaacatatactgctgcagatgagtttgaccaagcagcggcagttggatttattaaattgtggggtctacctactcaagtcaatgctcaagtaaatctcaaataa

SEQ ID NO: 5168 - protein, 397 aa, Lactococcus lactis subsp. lactis Il1403
MGNKKIVLAYSGGLDTSVAVKWLTDKGFDVIADCMDVGEGKDLNFIHDKALQVGAVESVVLDCKEEFAKIFVGAALKGNLMYENKYPLVSALSRPLIAQKLVEVAKEKGATAIAHGCTGKGNDQVRFEVAIHSLAPELEVIAPVREWHWAREEEIEYANQNGVPIPADLDNPYSIDMNLWGRAIEAGVLENPWNTCPEDAFFMTNSVENAPNEAEFIEVEFKEGLPIALNGKSLELHEIIKKVNIIAGKHGIGRIDHIENRLVGIKSREFYECPAAITLLKAHKDLEDLTFVRELAHFKPVLENELANLIYNGLWFNPATKALIAYLDETQKVVNGIVKIKLYKGLATPVGRKSTNSLYSEKLATYTAADEFDQAAAVGFIKLWGLPTQVNAQVNLK

SEQ ID NO: 5169 - DNA, 1221 bp, Sulfolobus solfataricus P2
  CDS (1)..(1221): transl_table=11
atgatatcaattgtttttaagcttcttctttaccctttttgtgaaatgaaaatagtccttgcatactctggtggacttgatactacagtatcgattagatggctaaaggaaacctttaaggctgagattataacagttactgtagatgttggtcaaaaggacgattttaagaaaatagaagaaagagcgtatatagccggcgcctcaaagcattatacaatagacgctgttaggcaatttgccaacaattacatagcatatgcgataaaattaaatggattatatgaaggagtctatccgttgtcaacggcattggcaagaccattaatagcagaaaaagtagttgaagttgcaaaaaaggaaggagctgaagccgtagctcacggttctacatctaagggaaatgatcaagtgagatttgaccttgcagttaaggcattataccctgacgttaagataatagcaccagctagaatatggaatatgactagagaagacgaaataaaatacgctaaagagaaaggaatacctatcaaggttgaaagtgacaaatacagcatagatgagaatctttggggaagaagtatagaaggagacataatctctgatccttctcttgaagtcccagaagatgcctttgaatggactaaacagatctacaataaaaaggaaatagtctctatagaatttagtaatggagttcctacagctgtgaacggagaaaaaatggaattaaataagttagtagattttctaaatttaaaattcggaagccatggatttggaagggtagaacatatagaaaatagagttgttggatttaagtctagagaggtatatgaagtaccagctgctctaggtctaatttacgctcatattgacttagaaaaaactatctatactccaatggaattaagattcaaaagacacatagatcagttatggtctgatctagtatatcaaggattatggtttgagccactaagagagacattacataaagttgctgatgaaatgaataaatggattagcggagaagcgaaggttgaagttagtaatggttcgttcagaatagtaggtagagaatcagaatattctccatattctgaaaaaattgctagttataacaaaggatggtatccaagcgacgaaatggctaggggatttatagagatttggggaatgcactcactaatagcgagaagagtaaggggactttga

SEQ ID NO: 5170 - protein, 406 aa, Sulfolobus solfataricus P2
MISIVFKLLLYPFCEMKIVLAYSGGLDTTVSIRWLKETFKAEIITVTVDVGQKDDFKKIEERAYIAGASKHYTIDAVRQFANNYIAYAIKLNGLYEGVYPLSTALARPLIAEKVVEVAKKEGAEAVAHGSTSKGNDQVRFDLAVKALYPDVKIIAPARIWNMTREDEIKYAKEKGIPIKVESDKYSIDENLWGRSIEGDIISDPSLEVPEDAFEWTKQIYNKKEIVSIEFSNGVPTAVNGEKMELNKLVDFLNLKFGSHGFGRVEHIENRVVGFKSREVYEVPAALGLIYAHIDLEKTIYTPMELRFKRHIDQLWSDLVYQGLWFEPLRETLHKVADEMNKWISGEAKVEVSNGSFRIVGRESEYSPYSEKIASYNKGWYPSDEMARGFIEIWGMHSLIARRVRGL

SEQ ID NO: 5171 - DNA, 1383 bp, Agrobacterium tumefaciens str. C58
  CDS (1)..(1383): transl_table=11
gtggctggtcatcacccatcgtcatgcctgcccatcaattgttttgtcgcttatctcacggaaaagcgcttcacacatttcgggttgcactgtaaaagtgccgaaatcccaaggaaatggcggtgccccgatgccgtcatcatgcagatggacatcattatggcactcccgaaagacgttaagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgcacgctcgccaagcgtaacctcaacaagtaa

SEQ ID NO: 5172 - protein, 460 aa, Agrobacterium tumefaciens str. C58
MAGHHPSSCLPINCFVAYLTEKRFTHFGLHCKSAEIPRKWRCPDAVIMQMDIIMALPKDVKKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLRTLAKRNLNK

SEQ ID NO: 5173 - DNA, 1248 bp, Streptococcus pneumoniae R6
  CDS (1)..(1248): transl_table=11
ttgaggatgcctttaaagcgtccattgaaaaatagaaagaaggaaaagaacatgagtaaagaaaaagtaattttggcctattctggcggtttagacacatcagttgctattacctggctgaagaaagactatgatgttgttgcagtttgtatggatgtgggtgaagggaaagacttagatttcatccatgataaggctcttaaggttggggcagtcgaatcttatgtcattgatgttaaggacgaatttgctacagattatgtgctagtggctcatcagtcacatgcctattatgaacaaaagtatcccttggtatctgccttgagccgccctctgatttctaaaaaattggttgaaatagcgcatcagataggagcgactacaattgctcatggttgtaccggtaaggggaatgaccaagtacgttttgaagtatcgattgcagccttggatctcaatttaaaagtgattgctccagttcgtgaatggaaatggtctcgggaggaagaaatttattatgccaaggaaaatggggtgcctgttcctgctgaccttgacaatccctactctgtcgaccaaaatctttggggacgtgccaatgagtgtggtattttggaaaatccatggaatcaggctccagaagaagcctttggcatcacaacttctccagagcaagctccagatatgccagaatacattgagattgagtttagtgaaggtgttccagtttccctcaatggagaagtgttaaaattggcagatttgattcaaaaactcaatgaaatagctggaaaacatggggttggacggattgaccacgtggaaaatcgcttggttgggattaaatcaagagaaatctatgagtgtccaggtgcagtgaccctgctgacagctcataaggaaattgaggacttgacgcttgtgagagaagtggctcattttaaaccaatcatagaaaatgaattatcaaatctcatttataatgctttgtggtttagttcggctacacaagccttgattgcttatattaaagagactcaaaaagttgtcaatgggactgcaaaagtcaaactgtataaggggagcgctcaggtcgtggctcggaaatcaccaagttctctttacgatgaaaatttggcgacgtatactagtgcagatacctttgaccaagatgcggctgttggctttattaagttatggggacttccaaccaaggttcattctgaggttcaaaaaagcgccaaatag

SEQ ID NO: 5174 - protein, 415 aa, Streptococcus pneumoniae R6
MRMPLKRPLKNRKKEKNMSKEKVILAYSGGLDTSVAITWLKKDYDVVAVCMDVGEGKDLDFIHDKALKVGAVESYVIDVKDEFATDYVLVAHQSHAYYEQKYPLVSALSRPLISKKLVEIAHQIGATTIAHGCTGKGNDQVRFEVSIAALDLNLKVIAPVREWKWSREEEIYYAKENGVPVPADLDNPYSVDQNLWGRANECGILENPWNQAPEEAFGITTSPEQAPDMPEYIEIEFSEGVPVSLNGEVLKLADLIQKLNEIAGKHGVGRIDHVENRLVGIKSREIYECPGAVTLLTAHKEIEDLTLVREVAHFKPIIENELSNLIYNALWFSSATQALIAYIKETQKVVNGTAKVKLYKGSAQVVARKSPSSLYDENLATYTSADTFDQDAAVGFIKLWGLPTKVHSEVQKSAK

SEQ ID NO: 5175 - DNA, 1218 bp, Thermoplasma acidophilum DSM 1728
  CDS (1)..(1218): transl_table=11
ttgttcgccatggacaaggcgcttcttctgtattcaggtggacttgatacatcggtcatgatcaaatggatccaggaaaatctgtcgatggatgttgctacgctcacgctcaacgtgggcaacagcgatctggttgccatagaggaaaaggcaaggatgctcggggctgatcctgtcttcgtccacgatgcaaaggatgagtttgctgaaaaattcatagcgaagtcaataatggcaaacgggagctatgaaggctacccgctttcaacagctctcgcaaggccgcttatggctgaaaaggcggtgaaatatgcacagaagatcggtgcaaaatacatcgttcatggatccacgggaaggggcaacgatcaggtcaggtttgaggtatccatcagggcccttgacccgtcaatgcaggttcttgtacccgtacgcgaatggaacatgatgcgaaaggatgaggttgagtatgcaaaaacgcacggaataccggtaaagctcgatggcaagtactcaatagatgagaatatatggggaaggtctgttgaaggcccggatcttgaagatatcggcaagggcgtacctgaggatgtctatgaatgggttgtgcctccatggaaggctaatgcggaacatacactaaaaattgcattcgatggtggcataccgagtgaaattgatggtgaaaaaatgaaactcgcggatctcatagtttttcttaacaccttggcaggatcgagcggcataggcctcatcgatcacatggagaacagggttgttggcctcaagagccatgaggtttacgaatgcccggcagcaacggtgatcacccatgcgcacaggtatctcgaatcgctgatacttaacaggaacgaggccgaggtcaagatgaacatggactggcagttcgcgaagtttgtctacggtgggctatggcatgatcctgttatgaacgctgtgaatgcggctgaggccgaattcaacagggacatcagcggcgagatcaagatcaggatgtcccacggcataatgtacatagaaggtgcatgggggaacagcttcctttacagcaaggatctgatcaactacagttcaatggcctttgatcagagggcgtccaagggcttcatagatatatacggaaatgccacggtgcattctcacaacaggaatccgaagatggtaaaggaggtgcagggttcttcggtcgaattctga

SEQ ID NO: 5176 - protein, 405 aa, Thermoplasma acidophilum DSM 1728
MFAMDKALLLYSGGLDTSVMIKWIQENLSMDVATLTLNVGNSDLVAIEEKARMLGADPVFVHDAKDEFAEKFIAKSIMANGSYEGYPLSTALARPLMAEKAVKYAQKIGAKYIVHGSTGRGNDQVRFEVSIRALDPSMQVLVPVREWNMMRKDEVEYAKTHGIPVKLDGKYSIDENIWGRSVEGPDLEDIGKGVPEDVYEWVVPPWKANAEHTLKIAFDGGIPSEIDGEKMKLADLIVFLNTLAGSSGIGLIDHMENRVVGLKSHEVYECPAATVITHAHRYLESLILNRNEAEVKMNMDWQFAKFVYGGLWHDPVMNAVNAAEAEFNRDISGEIKIRMSHGIMYIEGAWGNSFLYSKDLINYSSMAFDQRASKGFIDIYGNATVHSHNRNPKMVKEVQGSSVEF

SEQ ID NO: 5177 - DNA, 1245 bp, Methanosarcina mazei Go1
  CDS (1)..(1245): transl_table=11
ttgacacatcaattattttggttcttatcacatatctgccaaataaggggtagtaaaagcatggtaaaaaaagttgcacttgcatattccggtgggcttgacacctctgtgtgtatccccatcctcaaagaaaagtacggttacgatgaagtaattacaatttcggttgacgtcggccagcccgaagaagaaatcaggaaggctgatgcgaaagcccagaagatcagcaacaagcactacacgatcgatgcaaaggaagagttcgtaagggactacatcttccccctgataaaagccaacggaaactacgaaggctatgtcatgggcacgtccgtagcccgccccctgattgccaaaaaagtagtcgaagcagccaaaaaagaaggcgcaattgcccttgcccacggctgcaccggaaaaggaaacgaccagctccgctttgaagccgtcttccgccagaccgatatggacgttatcgccccaatgcgtgagatgaacctgacccgcgagtgggaaatcaattacgcaaaggagcacggcatccctgtcgaagccacaaagtccaagccctggagcgttgacgaaaatatctggagccgcagcatcgaaggcggcaggcttgaagatccctcttttgtcccgccggaagagatcttcgagtggacaaaatccgcagaagatgccccgaacgagcccaggattgttgacatcgactttgaagccggtgtccctgttgcaattgacggcgaaaaacttggcggctatgcccttgtcaagaagatgaacgaaattgcaggcgagaacggcgtcggcaggaccgatatgatcgaagaccgcgtgctcggcttaaaagcccgtgagaactacgagcacccggctgcaaccgtcctcctcgcagcccacgccgacctcgagaaactcgtcctgacccgcggggaactgaagttcaagaaaatcgttgaagagcagtggtccgaaatggcatacgcaggccttgtggacgaccctctatttgccgacctcaacgcttttatcgacaagtcgcaggaaagggttacaggtacagtgaaagtgaagctctacaaaggcgcacttactatccttgcccgcagttcgccaaatgccctgtattccgaagacctggtctcgtttgacagccagaccattgaccagaaggatgcagaaggatttgcgaagtatcacgggttccaggcgaggatgtacaggaaagtcgtgggaaaataa

SEQ ID NO: 5178 - protein, 414 aa, Methanosarcina mazei Go1
MTHQLFWFLSHICQIRGSKSMVKKVALAYSGGLDTSVCIPILKEKYGYDEVITISVDVGQPEEEIRKADAKAQKISNKHYTIDAKEEFVRDYIFPLIKANGNYEGYVMGTSVARPLIAKKVVEAAKKEGAIALAHGCTGKGNDQLRFEAVFRQTDMDVIAPMREMNLTREWEINYAKEHGIPVEATKSKPWSVDENIWSRSIEGGRLEDPSFVPPEEIFEWTKSAEDAPNEPRIVDIDFEAGVPVAIDGEKLGGYALVKKMNEIAGENGVGRTDMIEDRVLGLKARENYEHPAATVLLAAHADLEKLVLTRGELKFKKIVEEQWSEMAYAGLVDDPLFADLNAFIDKSQERVTGTVKVKLYKGALTILARSSPNALYSEDLVSFDSQTIDQKDAEGFAKYHGFQARMYRKVVGK

SEQ ID NO: 5179 - DNA, 1371 bp, Yersinia pestis KIM
  CDS (1)..(1371): transl_table=11
ttgatgacaactattcttaaacaccttcctattaatcagcgtgttggtattgctttttccggtggcctggacaccagtgcggcactgctgtggatgcaaaaaaaaggcgccattccttacgcttataccgctaatctgggtcagcctgatgaagaagattacgaggccatcccgcgtaaagcgatggaatacggcgcggaaaaagcccgtctgatcgattgccgtaagcagttggtggcagaaggtatcgccgctattcaatgtggcgcattccataacaccacggcgggtgtcacttatttcaacaccaccccactgggccgtgcggtaaccggcaccatgctggtggcagccatgaaagaagatgatgtaaatatctggggtgacggtagcacttataaaggtaacgatatcgagcgcttctatcgttacggtctgctgaccaacgctgagctgaaaatttacaaaccgtggctggatactgatttcatcgatgaattgggcggccgccatgagatgtcagaatttatgatccaatccggtttcgactacaaaatgtcaaccgagaaagcctactcgaccgactccaatatgttgggtgccacccacgaggccaaggatctggagttcctcaattccagcgttaaaatcgttaacccgattatgggcgtgaaattctgggacgaaaatgtggtggtgaaggccgaagaagtcactgtccgttttgaacgtggttacccggtcgcgctaaatggtgttgtctttgacgatagcgttgagctgatgatggaggctaaccgcatcggtggccgtcacggtctgggtatgagtgatcagattgaaaaccgtatcatcgaagccaaaagccgtggcatctatgaagcccctgggatggcgctgttgcatatcgcctatgagcgcttgctaacaggtattcacaatgaagataccattgagcaatatcatgctaatgggcgggtactgggtcgtctgctatatcaaggccgttggtttgatccacaagcgctgatgctgcgtgactccattcagcgttgggttgccagcgagataaccggtgaagtgacgctggagctgcgtcgtggcaatgattactccatcctgaataccgtgtctgacaatctgacttacaaaccagaacgtttgaccatggagaaaggtgattccgtgttctcaccagatgatcgtatcggccaactgacgatgcgtaatctggacatcaccgatacccgcgagaagttattcaactatgttgagacggggctgttaacctcttctgcggcgacggggttaccacaagtggataacaataatctgtcgtcagggcgtgggttgcaggataagcgtcagtaa

SEQ ID NO: 5180 - protein, 456 aa, Yersinia pestis KIM
MMTTILKHLPINQRVGIAFSGGLDTSAALLWMQKKGAIPYAYTANLGQPDEEDYEAIPRKAMEYGAEKARLIDCRKQLVAEGIAAIQCGAFHNTTAGVTYFNTTPLGRAVTGTMLVAAMKEDDVNIWGDGSTYKGNDIERFYRYGLLTNAELKIYKPWLDTDFIDELGGRHEMSEFMIQSGFDYKMSTEKAYSTDSNMLGATHEAKDLEFLNSSVKIVNPIMGVKFWDENVVVKAEEVTVRFERGYPVALNGVVFDDSVELMMEANRIGGRHGLGMSDQIENRIIEAKSRGIYEAPGMALLHIAYERLLTGIHNEDTIEQYHANGRVLGRLLYQGRWFDPQALMLRDSIQRWVASEITGEVTLELRRGNDYSILNTVSDNLTYKPERLTMEKGDSVFSPDDRIGQLTMRNLDITDTREKLFNYVETGLLTSSAATGLPQVDNNNLSSGRGLQDKRQ

SEQ ID NO: 5181 - DNA, 1218 bp, Vibrio vulnificus CMCP6
  CDS (1)..(1218): transl_table=11
atggaaatgagcaaattaaatgtcaataaagtggttgtcgcttactcaggcggtttggatacgtcagtgatcattccttggttaaaagagaactacgattgtgaagtggtggcctttgttgctgatgtgggtcagggcgaagaagagcttgtcggtattgaagagaaagccaaagcttctggtgcctcagaatgttatgtcgtcgatctgaaagaagaattggtcgctgactacatctacccaacactgaaaacgggcgcttactatgaaggcaaatacctcttggggacgtctatggcgcgcccggtgattgccaaagcacaagttgaaattgcccgtaaagtgggggctgatgcattgtgtcacggctgtactggtaaagggaatgaccaagtgcgttttgaaggcgccttcgccgcattggcccctgatctgaaagtgattgcgccttggcgtgaatgggatcttgtgagtcgtgagcagtgtttagactacttggctgagcgcaacattccttgtgctgcctcgttgaccaaaatctattctcgtgacgcgaatgcgtggcatatctctacggagggtggcgtactagaaagtacctggaatgcaccgaatgaagattgctgggtatggaccgtcgatccagagcaagcgccgaatgaagcggaatacgttaccctgcaagttgaaaaaggtgaagttgtggccgtggatggtgagcaaatgacgccgtacaacgcgctggtttacttgaacgaaaaaggggcgaaacacggtgttggtcgtatcgacattgtagaaaaccgtctagttggtatgaagtctcgtggttgttatgaaaccccagggggcaccattatgatggaagcgctgcgtgcggttgagcagttggtgctggacaaaacctcttttgagttccgtgaagaactgggtttaaaagcgtctcaccttgtctatgatggtcgctggttcacaccactgcgtaaatcgatcatggctgcggcagatgaattggcgcaggatgtcaatggtgaagtcgtggtgaagctgtataaaggcatggcaacagtgacacagaaacgctctgaaaacagcttgtattccgaagcgtttgcaacctttggtgaagatgaagtgtacgatcaaagccacgcaggcggctttatccgcctttactcactttctagccgaattcgcgcactcaatagccagaaataa

SEQ ID NO: 5182 - protein, 405 aa, Vibrio vulnificus CMCP6
MEMSKLNVNKVVVAYSGGLDTSVIIPWLKENYDCEVVAFVADVGQGEEELVGIEEKAKASGASECYVVDLKEELVADYIYPTLKTGAYYEGKYLLGTSMARPVIAKAQVEIARKVGADALCHGCTGKGNDQVRFEGAFAALAPDLKVIAPWREWDLVSREQCLDYLAERNIPCAASLTKIYSRDANAWHISTEGGVLESTWNAPNEDCWVWTVDPEQAPNEAEYVTLQVEKGEVVAVDGEQMTPYNALVYLNEKGAKHGVGRIDIVENRLVGMKSRGCYETPGGTIMMEALRAVEQLVLDKTSFEFREELGLKASHLVYDGRWFTPLRKSIMAAADELAQDVNGEVVVKLYKGMATVTQKRSENSLYSEAFATFGEDEVYDQSHAGGFIRLYSLSSRIRALNSQK

SEQ ID NO: 5183 - DNA, 1410 bp, Salmonella enterica subsp. enterica serovar Typhi Ty2
  CDS (1)..(1410): transl_table=11
ttgcataaaaatgcactaaagcagaaaccgatctcattatcagtcaatcaagcagggttctattctatgacgacgattcttaagcatcttccagcaggtcaacgtattggtatcgctttttccggcggtctggacactagcgccgcgctgctgtggatgcgacaaaaaggagctgtcccatatgcctatactgcgaatctgggacaaccggatgaggatgactatgacgccattcctcgtcgcgcaatggagtatggcgcagagaatgcccgcctgattgattgccgcaagcagttggttgcagaagggatcgcaacgattcagtgcggcgctttccataatacgactggcggactgacctatttcaataccacgccgctgggccgtgccgtgaccggcacgatgctggtcgccgcaatgaaagaagacggcgtgaatatctggggcgacggcagcacctataaaggcaacgatattgaacgtttctatcgttacggcctgctgaccaacgccgagctgcagatttacaaaccgtggctggataccgactttatcgatgagctgggcggccgtcatgagatgtctgaatttatgattgcctgcggtttcgactataagatgtcagtcgaaaaagcctactccaccgactccaacatgctcggcgcgacgcacgaagcgaaagatctggagtttcttaactccagcgtcaagatcgtcaacccgattatgggcgtgaagttctgggacgaaagcgtgaagatcccggcagaagaggtgaccgtccgtttcgaacagggacatccagtggcgctgaacggtaaaaccttcagcgatgatgttgagatgatgctggaagcgaaccgcatcggcggacgtcacggcctgggcatgagcgaccagatcgaaaaccgtatcattgaagcgaaaagccgcggtatttatgaagcccccggaatggcactgctgcacatcgcttacgagcgtctgttgaccggtattcacaacgaagacaccattgaacagtatcattctcatggtcgtcagttgggtaaactgctgtatcagggtcgctggttcgactctcaggcgctgatgctgcgtgacggcctgcaacgttgggtcgccagccagattaccggtgaagtgacgttggagctgcgtcgcggcaacgactactccatcctgaacaccgtgtcagacaacctgacctataaggctgagcgtctgaccatggagaaaggcgagtccgtgttctcgccagacgatcgtatcggtcagttgaccatgcgtaatctggacattactgatacccgcgagaaactgttcggctacgcgaaagcgggtctgttaaccgcctcttccgcgaccggtctgccgcaggttgagaatctggaaaacaaagcgaagtaa

SEQ ID NO: 5184 - protein, 469 aa, Salmonella enterica subsp. enterica serovar Typhi Ty2
MHKNALKQKPISLSVNQAGFYSMTTILKHLPAGQRIGIAFSGGLDTSAALLWMRQKGAVPYAYTANLGQPDEDDYDAIPRRAMEYGAENARLIDCRKQLVAEGIATIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEFLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHSHGRQLGKLLYQGRWFDSQALMLRDGLQRWVASQITGEVTLELRRGNDYSILNTVSDNLTYKAERLTMEKGESVFSPDDRIGQLTMRNLDITDTREKLFGYAKAGLLTASSATGLPQVENLENKAK

SEQ ID NO: 5185 - DNA, 1209 bp, Bacteroides thetaiotaomicron VPI-5482
  CDS (1)..(1209): transl_table=11
atggaagaaaagaagaaaaaagtagtggtggcattcagcggcggactggacacatcgttcaccgtcatgtacctcgctaaagaaaaaggttacgaagtatatgcagcttgtgccaatacgggcggtttcagcgaagaacagctgaagacaaacgaagaaaacgcctacaaactgggagcagtgaaatatgtaacattggacgttactcaggaatactacgaaaagagtctgaaatatatggttttcggaaatgtgctgcgtaatggtacttacccgatctctgtcagctcggaacgtatcttccaggcattggccatcgcacgttatgccaacgaaatcggtgcggatgccattgcccacggttctaccggagcaggtaacgaccagattcgttttgacatgactttccttgtactggctccgaatgtagaaatcatcacgctgacccgtgatatggcattaagccgtcaggaagaaatcgactatctgaacaaacatggtttcagcgcggacttcaccaaactgaaatactcttataacgtaggtttgtggggtacatccatctgtggtggcgaaatcctcgactccgcacagggattaccggaaacagcctacctgaaacatgtggaaaaagaaggcagcgaacaactccgtctcactttcgaaaagggagaactgaaagctgtcaatgacgaaacattcgatgatccgatccaagctatccagaaggtagaagagatcggtgccgcatacggtatcggacgtgatatgcacgtgggcgatacgattatcggcatcaaaggccgtgtgggtttcgaggctgccgctccgatgttgattatcggtgctcaccgcttcctcgaaaaatacacattgagcaaatggcagcaatactggaaagatcaggtggccaactggtacggaatgttcctccacgaaagccagtatctcgaaccggtgatgcgtgacatcgaagccatgcttcaggaaagccagcgtaacgttaacggtacggcaatcctcgagctccgcccgctttctttctctaccgtcggtgtagaatcggaagacgacctcgtgaaaacgaagttcggcgaatatggtgaaatgcagaagggctggacagccgaagatgctaagggctttattaaggtaacttctactccgctacgtgtttactacaataaccataaagacgaagagatatga

SEQ ID NO: 5186 - protein, 402 aa, Bacteroides thetaiotaomicron VPI-5482
MEEKKKKVVVAFSGGLDTSFTVMYLAKEKGYEVYAACANTGGFSEEQLKTNEENAYKLGAVKYVTLDVTQEYYEKSLKYMVFGNVLRNGTYPISVSSERIFQALAIARYANEIGADAIAHGSTGAGNDQIRFDMTFLVLAPNVEIITLTRDMALSRQEEIDYLNKHGFSADFTKLKYSYNVGLWGTSICGGEILDSAQGLPETAYLKHVEKEGSEQLRLTFEKGELKAVNDETFDDPIQAIQKVEEIGAAYGIGRDMHVGDTIIGIKGRVGFEAAAPMLIIGAHRFLEKYTLSKWQQYWKDQVANWYGMFLHESQYLEPVMRDIEAMLQESQRNVNGTAILELRPLSFSTVGVESEDDLVKTKFGEYGEMQKGWTAEDAKGFIKVTSTPLRVYYNNHKDEEI

SEQ ID NO: 5187 - DNA, 1455 bp, Streptomyces avermitilis MA-4680
  CDS (1)..(1455): transl_table=11
atgtctaaggtcctcacctcccttcccgccggcgagcgcgtcggtatcgccttctcgggcggcctcgacacctcggtcgcggtcgcgtggatgcgcgacaagggcgccgtcccgtgcacctacaccgccgacatcggccagtacgacgagcccgacatcgcctcggtgccgggccgcgcgaagacctacggtgccgagatcgcgcggctggtcgactgccgcgcggcgctggtcgaggagggcctggccgcgctcacctgcggggcgttccacatccgttcgggcgggcgtgcctacttcaacaccacgccgctcggtcgcgccgtcacgggcaccctcttggtccgggcgatgctcgaggacgacgtacagatctggggcgacggctcgaccttcaagggcaatgacatcgagcggttctaccggtacggcctgctcgccaacccgcacctgcggatctacaagccgtggctggacgcggacttcgtgaccgagctcggcggccgcaaggaaatgtcggagtggcttctcgcccacgacctgccctaccgcgacagcacggagaaggcgtactccaccgacgccaacatctggggcgccacccacgaggccaagaccctggagcacctggacaccggcgtggagaccgtggagccgatcatgggcgtgcggttctgggaccccgcggtcgagatcgccaccgaggacgtgacgatcggcttcgaccagggccgcccggtgacgatcaacggcaaggagctcgcctcccctgtcgacctggtcatggaggcgaacgcgatcggcggtcggcacggcatgggcatgtcggaccagatcgagaaccggatcatcgaggccaagagccgcggcatctacgaggcgcccggcatggccctgctgcacgcggcgtacgagcgcctggtcaacgcgatccacaacgaggacacgctcgcccagtaccacaacgagggacggcgcctcggccggctgatgtacgagggccgctggctggacccgcaggcgctgatggtgcgcgagtcgctgcagcgctgggtcggcgcggccgtcaccggcgaggtgacgctgcgactgcggcgcggtgaggactactcgatcctcgacaccacgggcccggcgttcagctaccacccggacaagctgtccatggagcgcaccgaggactcggcgttcggcccggtcgaccggatcggccagctcaccatgcgcaacctggacatcgcggattcacgcgtcaagctggagcagtacgccggcctcggcctgatcggcaccggcagtcccgccatcggtgccgcccaggcggccgcgaccggcctgatcggcaccatgccgcagatgccggagggcagcgccgaggccatcgcctcccgcggcgaggtctccggtgacgacgagatgctggaccgcgccgcgatggagttcggcacggactga

SEQ ID NO: 5188 - protein, 484 aa, Streptomyces avermitilis MA-4680
MSKVLTSLPAGERVGIAFSGGLDTSVAVAWMRDKGAVPCTYTADIGQYDEPDIASVPGRAKTYGAEIARLVDCRAALVEEGLAALTCGAFHIRSGGRAYFNTTPLGRAVTGTLLVRAMLEDDVQIWGDGSTFKGNDIERFYRYGLLANPHLRIYKPWLDADFVTELGGRKEMSEWLLAHDLPYRDSTEKAYSTDANIWGATHEAKTLEHLDTGVETVEPIMGVRFWDPAVEIATEDVTIGFDQGRPVTINGKELASPVDLVMEANAIGGRHGMGMSDQIENRIIEAKSRGIYEAPGMALLHAAYERLVNAIHNEDTLAQYHNEGRRLGRLMYEGRWLDPQALMVRESLQRWVGAAVTGEVTLRLRRGEDYSILDTTGPAFSYHPDKLSMERTEDSAFGPVDRIGQLTMRNLDIADSRVKLEQYAGLGLIGTGSPAIGAAQAAATGLIGTMPQMPEGSAEAIASRGEVSGDDEMLDRAAMEFGTD

SEQ ID NO: 5189 - DNA, 1335 bp, Rhodopirellula baltica SH 1
  CDS (1)..(1335): transl_table=11
gtgctgcttgactttccggccaggatccttctgaccgtccttgcgtgtttcgcaccggacaacttaaatgcgaggccttcaaacatagccgattcccccgcatttggatgcagatctgagatgaaaagttgtgtgctggcctattccggtggtctcgatacgtccgtcattctgggctggctccaggaccaaggctacgaagttcactgtgtttacgtggacctcgggcagccctgtgaggatcgcgatgccatcatggagaaggctcgtacctgcggggccaagtcctctcgtttggtggacgttcgtgaagaactgtgccgcgattttgctttccccgtgttggcgtggcaagccaagtacgaacaaatctatctgctgggcacctcgatcgctcgcccgctgatcagcaaggtttgcttggaagtggctcgcgaagtcggcgcgaccgcctacgctcacggagcaacaggcaaaggcaatgaccaatgtcgtttccaacttgctgccgaagctcttgatccaaacatcgaaatgatcgctccttggcgaatcaaatcgttccgcgatgccttccctggccgcaccgaactgatcgagtactgcgacgtgaagcgaattcctgtcaaagcctcgactgcaaagccatacagcagcgatgaaaacgtcctgcacatttcctacgaagcgggcaagcttgaagaactcgacgtcaacggcgtggagctggtcgaattcggaatgggcgtttcacctcaagatgctcccgacaaaccagaagaagtcacgatcggttttgaatccggcgtaccaaaaacgttgaatggcaaagccgtcaacgctttggaaatggtcgagcaactcaatgacatcgctggacgcaacggcgtcggtcgcatcgacatggtcgaaaatcgtttcgtcggcatgaagagccgcggtgtttacgagtcgcccggcatgactgtgttgtacgacgcattgatgtacgtcgaacaactcaccatggaccgcgacctgatgcaccttcgcgaccgcatggctcccgaagtggctgaaatggtttactacggtttctggtacacgcccaagatggacgcactgatgtcgttcatcgaaaccgctcagcgtccagtcaccggcgaagtcacgttgcaactctacaagggcaacatcatggtgtcttcacgaaccagcccaaacagcttgtacgacgaagagatcgcaaccatggaaggcggcggctcgtacaaccaagacgacgccgaaggcttcctgcgaatccaaggcttgccgtcgcgagtccaaggccgcgtgtcaccacgcaagttctaa

SEQ ID NO: 5190 - protein, 444 aa, Rhodopirellula baltica SH 1
MLLDFPARILLTVLACFAPDNLNARPSNIADSPAFGCRSEMKSCVLAYSGGLDTSVILGWLQDQGYEVHCVYVDLGQPCEDRDAIMEKARTCGAKSSRLVDVREELCRDFAFPVLAWQAKYEQIYLLGTSIARPLISKVCLEVAREVGATAYAHGATGKGNDQCRFQLAAEALDPNIEMIAPWRIKSFRDAFPGRTELIEYCDVKRIPVKASTAKPYSSDENVLHISYEAGKLEELDVNGVELVEFGMGVSPQDAPDKPEEVTIGFESGVPKTLNGKAVNALEMVEQLNDIAGRNGVGRIDMVENRFVGMKSRGVYESPGMTVLYDALMYVEQLTMDRDLMHLRDRMAPEVAEMVYYGFWYTPKMDALMSFIETAQRPVTGEVTLQLYKGNIMVSSRTSPNSLYDEEIATMEGGGSYNQDDAEGFLRIQGLPSRVQGRVSPRKF

SEQ ID NO: 5191 - DNA, 1332 bp, Haemophilus ducreyi 35000HP
  CDS (1)..(1332): transl_table=11
atgtcagcaacgattttagaatctctcccattaggtcaaaaggttggtatcgctttctcaggtggtttggatacttcagccgcgttactttggatgcgtaaaaaaggtgcaataccttatgcatatactgccaatttaggccaaccagatgaaaatgattacaatgcaattccaaacaaagcgatggaatatggtgcagaaaatgcccgcttaattgattgccgtactcaattagctcacgaagggattgccgcaattcaatgtggagcatttcatatttcaacaggtggtattccatatttcaatactacaccgcttggccgagcagtaacaggcacaatgcttgtggcagcaatgaaagaagataatgtgaatatttggggggatggttcaacgtttaaaggtaatgatattgaacgtttttaccgctatggcttattaactaatccaaaattaaaaatttataaaccttggttagatcagctttttattgatgagcttggcggtcgttttgaaatgtcacaatttttaatttcaaacggctttgattataaaatgtctgttgaaaaagcatattcgactgattcaaatatgttaggcgctacccacgaagcaaaagatttagaagaacttggcacggatatgaaaattgtcaagccaattatgggcgttgcattttgggatgaatcggttgaaattaaaccagaaattgtatcggtcacctttgaagaagggattcctgttgctttaaatggtaaacggattgatgatgcagttgaattaatcttagaagcaaaccgtatcggtggccgtcatggcttaggtatgtcagatcaaattgaaaaccgtattattgaagcaaaatcacgtggaatttatgaagcgccaggaatggcaatattacatattgcttatgagcgtttagtgacgggtattcataatgaagacacgatagaacaatatcgtatcaatggcttgcgtttagggcgtttattatatcaaggtcgttggtttgatcctcaagcgttaatgttacgagaaacggcacaacgttgggtcgcaaaagcaattgcgggcacggtaacattagaattacggcgtggtaatgatttcagcattttaaatactgaatcggttaatttaacttatcaagcagagcggttaagtatggaaaaagtcgaagatgcaccttttacccctgctgatcgtataggtcaattaactatgcgtaatttagacattgttgatacacgtgataaactagctgtttatacggacgcaggtttattatctgtgcaaaataatgttattccacaattgaataaaaaataa

SEQ ID NO: 5192 - protein, 443 aa, Haemophilus ducreyi 35000HP
MSATILESLPLGQKVGIAFSGGLDTSAALLWMRKKGAIPYAYTANLGQPDENDYNAIPNKAMEYGAENARLIDCRTQLAHEGIAAIQCGAFHISTGGIPYFNTTPLGRAVTGTMLVAAMKEDNVNIWGDGSTFKGNDIERFYRYGLLTNPKLKIYKPWLDQLFIDELGGRFEMSQFLISNGFDYKMSVEKAYSTDSNMLGATHEAKDLEELGTDMKIVKPIMGVAFWDESVEIKPEIVSVTFEEGIPVALNGKRIDDAVELILEANRIGGRHGLGMSDQIENRIIEAKSRGIYEAPGMAILHIAYERLVTGIHNEDTIEQYRINGLRLGRLLYQGRWFDPQALMLRETAQRWVAKAIAGTVTLELRRGNDFSILNTESVNLTYQAERLSMEKVEDAPFTPADRIGQLTMRNLDIVDTRDKLAVYTDAGLLSVQNNVIPQLNKK

SEQ ID NO: 5193 - DNA, 1191 bp, Photorhabdus luminescens subsp. laumondii TTO1
  CDS (1)..(1191): transl_table=11
atgagttctgatcgcgttttggtgatttactataatcgcctctataatcctcttatcataagaagtcttaaatctgaatatagagaggtaattgctctttatattgatgaagggcaggtaagagatattgaagatattgaattagaatgcatggttgcaggtgctgataaatttatctataaagattatcgagcgcaatatgctgaacacttccttacaaaagcgataaaagcgaatgctatttatcaaaatggttattttctcagtgctgcactttcccggcctgcgattgctgaggcagcagttgaagttgccaatgagctcaatattgattatattgctcatcaattcagaggtaatgatcaagtcagaatggatatgaatatagaaattctgaataaaatacctattgcttcgttgagagattttaaatacgacgaaaatattgtaaatagttatgcgatgaaatatggtattcctcaagaatttggttgtaataacccttattctactagtgaaaatatatggggattaagtgtcgaatgtggaccgttggcagaaccggaagcattaattccggaagatgccagagagaaattatttgaacatgcactatcagctactgagccaatatttttgtcattaggttttgagaatggtataccgatatcgattgacggcgaaaagaaatcattatatgaaattattgaaatattaaatgagattggtaaaaaattatcaattggtatttttgatattgttgaagatggcattgtcggtttgaaaacacgcgcaatttatcaatcacctgccgcacatatcttaattaccgcacatcgtgatttagaatgttattgtagtaatcgtcacgaaaattggtttaaagagatagttgataaaaaatgggttgaattagtttattctgggctttggtatgatcccttattaactcatttaaaccactttattgatagcatgaatcaacatgtcaatggtgagattaagcttgaattaggttataaatatgccaatgtttgttcccgtatttcaaagacaactatctatgatgataatttagcaatatataattgtgggcatttatatagtcaaaacgatgcagagggatttgcaaaaatatttaatattcatactaagcaaagtgctaaatctaagatgaggcaaaagttatga

SEQ ID NO: 5194 - protein, 396 aa, Photorhabdus luminescens subsp. laumondii TTO1
MSSDRVLVIYYNRLYNPLIIRSLKSEYREVIALYIDEGQVRDIEDIELECMVAGADKFIYKDYRAQYAEHFLTKAIKANAIYQNGYFLSAALSRPAIAEAAVEVANELNIDYIAHQFRGNDQVRMDMNIEILNKIPIASLRDFKYDENIVNSYAMKYGIPQEFGCNNPYSTSENIWGLSVECGPLAEPEALIPEDAREKLFEHALSATEPIFLSLGFENGIPISIDGEKKSLYEIIEILNEIGKKLSIGIFDIVEDGIVGLKTRAIYQSPAAHILITAHRDLECYCSNRHENWFKEIVDKKWVELVYSGLWYDPLLTHLNHFIDSMNQHVNGEIKLELGYKYANVCSRISKTTIYDDNLAIYNCGHLYSQNDAEGFAKIFNIHTKQSAKSKMRQKL

SEQ ID NO: 5195 - DNA, 1257 bp, Vibrio vulnificus YJ016
  CDS (1)..(1257): transl_table=11
atggcactgaccgccgagtgcaggccagacaaatggagaatggaaatgagcaaattaaatgtcaataaagtggttgtcgcttactcaggcggtttggatacgtcagtgatcattccttggttaaaagagaactacgattgtgaagtggtggcctttgttgctgatgtgggtcagggcgaagaagagcttgtcggtattgaagagaaagccaaagcttctggtgcctcagaatgttatgtcgtcgatctgaaagaagaattggtcgctgactacatctacccaacactgaaaacgggcgcttactacgaaggcaaatacctcttggggacgtctatggcgcgtccggtgattgccaaagcacaagttgaaattgcccgtaaagtgggggctgatgcattgtgtcacggctgtactggtaaagggaatgaccaagtgcgttttgaaggtgccttcgccgcattggcccctgatctgaaagtgattgcgccttggcgtgaatgggatcttgtgagtcgtgagcagtgtttagactacttggctgagcgcaacattccttgtgctgcctcgttgaccaaaatctattctcgtgacgcgaatgcgtggcatatctctactgagggtggcgtactagaaagtacctggaatgcaccgaatgaagattgctgggtatggaccgtcgatccagagcaagcgccgaatgaagcggaatacgttaccctgcaagttgaaaaaggtgaagttgtggcggtggatggtgagcaaatgacgccgtacaacgcgctggtttacttgaatgaaaaaggggcgaaacacggtgttggtcgtatcgacattgtagaaaaccgtctagttggcatgaagtctcgtggttgttatgaaaccccagggggcaccatcatgatggaagcgctgcgtgcggttgagcagttggtgctggacaaaacctcttttgagttccgtgaagaactgggtttaaaagcgtctcaccttgtctatgatggtcgctggttcacaccactgcgtaaatcgatcatggctgcggcagatgaattggcgcaggatgtcaatggtgaagtcgtggtgaagctgtataaaggcatggcaacagtgacacagaaacgctctgaaaatagcttgtattccgaagcgtttgcaacctttggtgaagatgaagtgtacgatcaaagccacgcaggcggctttattcgcctttactcactttctagccgaattcgcgcactcaatagccagaaataa

SEQ ID NO: 5196 - protein, 418 aa, Vibrio vulnificus YJ016
MALTAECRPDKWRMEMSKLNVNKVVVAYSGGLDTSVIIPWLKENYDCEVVAFVADVGQGEEELVGIEEKAKASGASECYVVDLKEELVADYIYPTLKTGAYYEGKYLLGTSMARPVIAKAQVEIARKVGADALCHGCTGKGNDQVRFEGAFAALAPDLKVIAPWREWDLVSREQCLDYLAERNIPCAASLTKIYSRDANAWHISTEGGVLESTWNAPNEDCWVWTVDPEQAPNEAEYVTLQVEKGEVVAVDGEQMTPYNALVYLNEKGAKHGVGRIDIVENRLVGMKSRGCYETPGGTIMMEALRAVEQLVLDKTSFEFREELGLKASHLVYDGRWFTPLRKSIMAAADELAQDVNGEVVVKLYKGMATVTQKRSENSLYSEAFATFGEDEVYDQSHAGGFIRLYSLSSRIRALNSQK

SEQ ID NO: 5197 - DNA, 1338 bp, Rhodopseudomonas palustris CGA009
  CDS (1)..(1338): transl_table=11
atgactacgatcttgaaaagcctgcccaagggcgaaaacgtcggcatcgctttctcagggggtctcgataccagcgcggcgctgctgtggatgaagcagaagggcgccaaggtgttcgcctatacggcgaacctcggccagcccgacgaggccgactacgacgcgatcccgcgcaaggcgatggagttcggcgccgagaaagcccggctggtcgattgccgcacccagctggtgcacgaaggcatcgcggcgatccaggccggcgccttccacgtctcgaccggcggcatcgcgtatttcaacaccaccccgctcggccgcgccgtcaccggcaccatgctggtgtcggcgatgaaggaagacggcgtcaacatctggggcgacggctcgacctacaagggcaacgacatcgagcggttctaccgctacggcctgctcaccaatccggccttgcggatctacaagccctggctcgaccagcagttcatcgacgagctcggcggccgcgccgagatgtcggcgttcatgacttcgcacggcttcgcctacaagatgagcgccgaaaaggcgtactcgaccgacagcaacctgctcggcgccacccacgaggccaaggatctcgaacacctcgacagcggcatcaagatcgtcaacccgatcatgggcgtgccgttctggcgcgacgattgcgcggtgaaagccgaagccgtcacggtgcggttcgaggaaggccagccggtcgcgctcaatggccagactttcacggatccggtcgcgatgttctacgaagccaatgccatcggcggacgtcacggcctcggcatgagcgaccagatcgagaaccgcatcatcgaggccaagagccgcggcatctacgaggcgcccggcatggcgctgctgcacatcgcctatgagcggctggtcaccggcattcacaacgaagacaccatcgagcagtaccgcatcaacggcatgaagctcggccggctgctgtatcagggccgctggttcgactcgcaggctttgatgctgcgcgagaccgcgcagcgctgggtcgcccgtgccgtcaccggcgaggtgacgctcgaactgcgccgcggcaacgactactcgatcctcaacaccgtcagcccgaacctgacctacgcgccggagcggctgagcatggagaaggtcgaggacgcgccgttcactccggccgaccgcatcggccagctcaccatgcgcaacctcgacatcaccgacacccgcgccaagctcggcctctacgccaagaccggcctgctgtcctccggcgaaggcaccccgatcccgcagctggaaaacgacaagggctga

SEQ ID NO: 5198 - protein, 445 aa, Rhodopseudomonas palustris CGA009
MTTILKSLPKGENVGIAFSGGLDTSAALLWMKQKGAKVFAYTANLGQPDEADYDAIPRKAMEFGAEKARLVDCRTQLVHEGIAAIQAGAFHVSTGGIAYFNTTPLGRAVTGTMLVSAMKEDGVNIWGDGSTYKGNDIERFYRYGLLTNPALRIYKPWLDQQFIDELGGRAEMSAFMTSHGFAYKMSAEKAYSTDSNLLGATHEAKDLEHLDSGIKIVNPIMGVPFWRDDCAVKAEAVTVRFEEGQPVALNGQTFTDPVAMFYEANAIGGRHGLGMSDQIENRIIEAKSRGIYEAPGMALLHIAYERLVTGIHNEDTIEQYRINGMKLGRLLYQGRWFDSQALMLRETAQRWVARAVTGEVTLELRRGNDYSILNTVSPNLTYAPERLSMEKVEDAPFTPADRIGQLTMRNLDITDTRAKLGLYAKTGLLSSGEGTPIPQLENDKG

SEQ ID NO: 5199 - DNA, 1248 bp, Magnaporthe grisea 70-15
  CDS (1)..(1248)
atgtccaaaggtcgcgtctgcttagcctactctggaggtcttgatacctctaccatcctggtgtggctcattgagcagggctacaccgtcgtctgcttcctcgccaatgtcggccaggaggaggactgggatgaggtcaaggccaaggccaagaagcttggtgctgaggagatggtgatcctcgacctgcagaaggagtttgtcgagcagatcgtcttccgcgccatccagtgcaacgccatatacgaggacaggtacctgctgggcacctcgctggcccgccccatcatcgcccgcgcccaggtccgcgtcgccgagcagtacaactgccagtacgtcagccacggctgcaccggcaagggcaacgaccaggtccgcttcgagctcgccttcaaggcctgcaacccttccatcgaggttattgccccatggaggctgcccgagttcatctccaagttccagggtcgtcaagacctgctcaagtacgccgaggagaagaacatccccgtctcttccagccccaaggccccctggtccatggacgacaacctcgtccactgcagctacgaggccggcgtgctcgaggaccccgaccacacccctcccaaggagctgtggactcgtaccgttgaccccgtcgacgcccctgccactcctcaggagttcactgttgagttcgagaagggtatccccacaaaggttacggtcgacggtaaggagacgaccggctcggttgaggtcttcaagctgctcaacaagctgggccacgaccacggtgttggccgtatcgacattgtcgagaaccgcttcatcggcctcaagtctcgtggctgctacgacacccctggtttgaccattgcccgcctggcccacttggatctcgagggtctggtcatggactccaaggtccgtgagattcgtgaccagttctgtactctgtcgtggtctcgccagctgtacaacggcatgtacttcagcccggagcgcgagttcgtcgagaactcgatcatcttcagccaggagaacgtcaccggtcaggtcaggttggccgtctacaagggcaacacttacgtcctgggccgcaagagcgacgccagcaacctctactcggagcaggacgcttccatggactcgctcgagggcttctcgcccatggacacgactggcttcatcgagatcaatgccatccgcctgaagaaatacggtctgcaaaagatcaaggacggcaagccccttactcagtcatga

SEQ ID NO: 5200 - protein, 415 aa, Magnaporthe grisea 70-15
MSKGRVCLAYSGGLDTSTILVWLIEQGYTVVCFLANVGQEEDWDEVKAKAKKLGAEEMVILDLQKEFVEQIVFRAIQCNAIYEDRYLLGTSLARPIIARAQVRVAEQYNCQYVSHGCTGKGNDQVRFELAFKACNPSIEVIAPWRLPEFISKFQGRQDLLKYAEEKNIPVSSSPKAPWSMDDNLVHCSYEAGVLEDPDHTPPKELWTRTVDPVDAPATPQEFTVEFEKGIPTKVTVDGKETTGSVEVFKLLNKLGHDHGVGRIDIVENRFIGLKSRGCYDTPGLTIARLAHLDLEGLVMDSKVREIRDQFCTLSWSRQLYNGMYFSPEREFVENSIIFSQENVTGQVRLAVYKGNTYVLGRKSDASNLYSEQDASMDSLEGFSPMDTTGFIEINAIRLKKYGLQKIKDGKPLTQS

SEQ ID NO: 5201 - DNA, 1248 bp, Magnaporthe grisea 70-15
  CDS (1)..(1248)
atgtccaaaggtcgcgtctgcttagcctactctggaggtcttgatacctctaccatcctggtgtggctcattgagcagggctacaccgtcgtctgcttcctcgccaatgtcggccaggaggaggactgggatgaggtcaaggccaaggccaagaagcttggtgctgaggagatggtgatcctcgacctgcagaaggagtttgtcgagcagatcgtcttccgcgccatccagtgcaacgccatatacgaggacaggtacctgctgggcacctcgctggcccgccccatcatcgcccgcgcccaggtccgcgtcgccgagcagtacaactgccagtacgtcagccacggctgcaccggcaagggcaacgaccaggtccgcttcgagctcgccttcaaggcctgcaacccttccatcgaggttattgccccatggaggctgcccgagttcatctccaagttccagggtcgtcaagacctgctcaagtacgccgaggagaagaacatccccgtctcttccagccccaaggccccctggtccatggacgacaacctcgtccactgcagctacgaggccggcgtgctcgaggaccccgaccacacccctcccaaggagctgtggactcgtaccgttgaccccgtcgacgcccctgccactcctcaggagaacactgttgagttcgagaagggtatccccacaaaggttacggtcgacggtaaggagacgaccggctcggttgaggtcttcaagctgctcaacaagctgggccacgaccacggtgttggccgtatcgacattgtcgagaaccgcttcatcggcctcaagtctcgtggctgctacgacacccctggtttgaccattgcccgcctggcccacttggatctcgagggtctggtcatggactccaaggtccgtgagattcgtgaccaggtctgtactctgtcgtggtctcgccagctgtacaacggcatgcacttcagcccggagcgcgagttcgtcgagaactcgatcatcttcagccaggagaacgtcaccggtcaggtcaggttggccgtctacaagggcaacacttacgtcctgggccgcaagagcgacgccagcaacctctactcggagcaggacgcttccatggactcgctcgagggcttctcgcccatggacacgactggcttcatcgagatcaatgccatccgcctgaagaaatacggtctgcaaaagatcaaggacggcaagccccttactcagtcatga

SEQ ID NO: 5202 - protein, 415 aa, Magnaporthe grisea 70-15
MSKGRVCLAYSGGLDTSTILVWLIEQGYTVVCFLANVGQEEDWDEVKAKAKKLGAEEMVILDLQKEFVEQIVFRAIQCNAIYEDRYLLGTSLARPIIARAQVRVAEQYNCQYVSHGCTGKGNDQVRFELAFKACNPSIEVIAPWRLPEFISKFQGRQDLLKYAEEKNIPVSSSPKAPWSMDDNLVHCSYEAGVLEDPDHTPPKELWTRTVDPVDAPATPQENTVEFEKGIPTKVTVDGKETTGSVEVFKLLNKLGHDHGVGRIDIVENRFIGLKSRGCYDTPGLTIARLAHLDLEGLVMDSKVREIRDQVCTLSWSRQLYNGMHFSPEREFVENSIIFSQENVTGQVRLAVYKGNTYVLGRKSDASNLYSEQDASMDSLEGFSPMDTTGFIEINAIRLKKYGLQKIKDGKPLTQS

SEQ ID NO: 5203 - DNA, 1185 bp, Gibberella zeae PH-1
  CDS (1)..(1185)
atggctcccgaacgtgtttgccttgcctactctggtggtcttgacaccagcaccatcctccgatggttggtcctccagggctaccaggtcgtctgcttccttgccgactgtggtcaggaggaggactttgacgccgtcaaggtcaaggctgagaagctcggcgctgagcgcatgatcatcctcgatgttcagcaggagcttatcgacgagcttgtctggcctgctgtccagtgcaatgccatctacgaggaccgatacctcctcggaaccagtcttgctcgccctgtcattgctagggccatggtcaaggtcgccaaggagcacaactgcacaattctcagccacggatgcactggcaagggtaacgagtacgactctcttttcaacacagttttggcatatggacgtgccgatctgctcaagttcgcctccgagcagaacattcccgttagctctacccccaaggccccttggtctatggacgacaacatcatccactgctcttacgaggccggtattctcgagcaaaccgagcttgagccccccaaggacatgtggaagcgcactgttgaccccatgaaggcccccgatgagcccacccccttcgttattcacttcgagcagggtgttcccgtcaagctcgaggttgcaggcaagaccatcactggatctctcgagatcttcaaggaggctaacgagatcggccgaatcaacggtattggacgtgtcgacattgtcgagtcccgattcattggtctcaagagccgaggctgctacgacacccccggtctcaccatcctccgacaggcccacatcgaccttgagggacttgtccttgactccaaggttcgagccatccgtgaccgtcttactcaggactggtctgcctgcatctacaacggcatgtacttcagccctgagcgtgagcttgtcgagcacgccatcaagttctctcagcgccaggttgagggtaaggtgagccttgtcgcctacaagggcaacgcctacgtcgtcggacgatccagcgagacctccaacctctactccgaggacgagagcagcatggacaccctcgacatgaactggactcctcaggacaccaccggctttatcgccatccagggtatccgcctcgagaagtacggcgccaggaagatcaaggacggcgagcctcttgccccttag

SEQ ID NO: 5204 - protein, 394 aa, Gibberella zeae PH-1
MAPERVCLAYSGGLDTSTILRWLVLQGYQVVCFLADCGQEEDFDAVKVKAEKLGAERMIILDVQQELIDELVWPAVQCNAIYEDRYLLGTSLARPVIARAMVKVAKEHNCTILSHGCTGKGNEYDSLFNTVLAYGRADLLKFASEQNIPVSSTPKAPWSMDDNIIHCSYEAGILEQTELEPPKDMWKRTVDPMKAPDEPTPFVIHFEQGVPVKLEVAGKTITGSLEIFKEANEIGRINGIGRVDIVESRFIGLKSRGCYDTPGLTILRQAHIDLEGLVLDSKVRAIRDRLTQDWSACIYNGMYFSPERELVEHAIKFSQRQVEGKVSLVAYKGNAYVVGRSSETSNLYSEDESSMDTLDMNWTPQDTTGFIAIQGIRLEKYGARKIKDGEPLAP

SEQ ID NO: 5205 - DNA, 1248 bp, Gibberella zeae PH-1
  CDS (1)..(1248)
atgtcaaaaggccgtgtttgtcttgcctactctggaggactcgatacctctacgatcctaaaatggcttatccttgagggatatgaggttgtgtgtttcctcgccgacgttggccaagttgaggactttgatgctgtcgagaagaaggctctggctctcggtgctgagcgtatgatcattgagaacctacagaaggaattcatcgaacaaatcgtcttccgagcgattcagtgcaacgccatctacgaggatcgatatcttcttggaaccgcccttgctcgacccgtcatcgctcgtgctcaggtccgagtcgctgagaagtacaactgcaaccttctgagccatggctgcactggtaaaggaaacgaccaagttcgtttcgaactcgccttcaaggcctgcaacccttcgatcaaaatcattgccccttggcgactacctgagttctgtgaaaagttccagggccgacaagatcttctcaagttcgctgccgagaacaacatccccgtctcatccacccccaaggctccttggagccaagacgagaatcttgttcactgctcgtatgaagctggcatccttgaggatcctgaccacacccctcccaaggacctgtggacccagacagtcgaccctctcgaggcccccgacaagcctttcaactttgccgtccacttcgagaagggcctacctgtcaaggttgccacccctgaccaggaggccactgactcagtagagctcttcaagcttctcaacaagattggacacgatcacggcgttggccgaattgacattgtcgagaaccgatggatcggactcaaaagccgtggctgctacgatacccatggcttgaccattgctcgtctcgctcacgttgatctcgagggccttgtccttgactccaaggtccgtaagcttcgagatcaatttgtgactgttgaatggtctcagtgcctctacagcggcatgtacttctctcccgagcgtgagtggctcgatgaggctatcgtctctgctcagaagggcgtcaatggccaggtccgtctccaagtgtacaagggcaacgtctacgttctcggacgatcgagcgagaccagctccctctattcccaggaggacgcttccatggacagccttgacaccttctctcccatggatagcactggctttatcgctatccagtccattcgattggagaagtatggcgttcaaaaagccaaggatggtcaacctctcagccagtcttga

SEQ ID NO: 5206 - protein, 415 aa, Gibberella zeae PH-1
MSKGRVCLAYSGGLDTSTILKWLILEGYEVVCFLADVGQVEDFDAVEKKALALGAERMIIENLQKEFIEQIVFRAIQCNAIYEDRYLLGTALARPVIARAQVRVAEKYNCNLLSHGCTGKGNDQVRFELAFKACNPSIKIIAPWRLPEFCEKFQGRQDLLKFAAENNIPVSSTPKAPWSQDENLVHCSYEAGILEDPDHTPPKDLWTQTVDPLEAPDKPFNFAVHFEKGLPVKVATPDQEATDSVELFKLLNKIGHDHGVGRIDIVENRWIGLKSRGCYDTHGLTIARLAHVDLEGLVLDSKVRKLRDQFVTVEWSQCLYSGMYFSPEREWLDEAIVSAQKGVNGQVRLQVYKGNVYVLGRSSETSSLYSQEDASMDSLDTFSPMDSTGFIAIQSIRLEKYGVQKAKDGQPLSQS

SEQ ID NO: 5207 - DNA, 1263 bp, Candida glabrata CBS 138
  CDS (1)..(1263)
atgtctaaaggaaaagtttgtttggcatactctggtggtctagatacctccatcatcctagcttggttgctagaacaaggctacgaagttgttgctttcatggccgatgtcggtcaggaagaagacttcgaagccgctagagctaaggctttgaagattggtgctaccaaggttgttatcagtgacgtccgtgaacaatttgttaaggatatcatcttccctgccgtccaagtcaacgctgtctacgaagatgtctatttgctaggtacttctttggctagaccagttattgctaaggctcaaatcgatgttgctgaacaagaaggttgtttcgccgtttctcacggttgtaccggtaagggtaacgatcaaatcagattcgaactatctttctacgctttgaagccagacgtccaagtgatcgctccatggagattgccagaattcttcaacagatttgccggtagaaaggatctattggactacgccgcagaaaagggtatcccagtcgcacaaaccaaggccaagccatggtccaccgatgaaaacatggcgcacatctcttacgaggctggtatcctagaagacccaaatactaccccaccaaaggatatgtggaagttgattaccgacccaatggatgctccaaacactccacaagatatcacgctagatttcgaaaagggtatccctgttaagctaacatacaaggacaacgctactggtaaggaacatgtagtcactgacgccttggagttggcccttcacgtctctaacttgggtagagccaacggtgtcggcagaatcgacattgttgaaaaccgttacattaacttgaagtccagaggttgttacgagcaagccttgctaactattttgagaaaggcccacgtcgatcttgaaggtctggtgctagacaaggaagtccgtcaattgagagaccaatttgtcactaccacttactccaagctgctgtacaacggttcttacttcaccccagaatgtgaattcatcagagccatgatcgagccatctcaaaagaccgtcaacggtacagtcagactttctctatacaagggtaacgtgatagtactaggaagatactctaacactgaatccctgtatgacgccactgaatcctcaatggatgagctaacaggtttcctacctaccgataccaccggtttcatcgccatccaagccatcagagtcaagaagttcggtgaagccaagaaggccagcggtgagaagatcactttatag

SEQ ID NO: 5208 - protein, 420 aa, Candida glabrata CBS 138
MSKGKVCLAYSGGLDTSIILAWLLEQGYEVVAFMADVGQEEDFEAARAKALKIGATKVVISDVREQFVKDIIFPAVQVNAVYEDVYLLGTSLARPVIAKAQIDVAEQEGCFAVSHGCTGKGNDQIRFELSFYALKPDVQVIAPWRLPEFFNRFAGRKDLLDYAAEKGIPVAQTKAKPWSTDENMAHISYEAGILEDPNTTPPKDMWKLITDPMDAPNTPQDITLDFEKGIPVKLTYKDNATGKEHVVTDALELALHVSNLGRANGVGRIDIVENRYINLKSRGCYEQALLTILRKAHVDLEGLVLDKEVRQLRDQFVTTTYSKLLYNGSYFTPECEFIRAMIEPSQKTVNGTVRLSLYKGNVIVLGRYSNTESLYDATESSMDELTGFLPTDTTGFIAIQAIRVKKFGEAKKASGEKITL

SEQ ID NO: 5209 - DNA, 1263 bp, Kluyveromyces lactis NRRL Y-1140
  CDS (1)..(1263)
atgtctaaaggtaaggtttgtttggcatactccggtggtttggatacctctgtgattttggcctggttgttagaacaagggtacgaagttgttgccttcatggccaatgttggtcaagaagaagatttcgaagctgctgaaaagaaggctttactaattggtgctaccaagtttgttctagttgactgcagagaagaattcgtcaaggacgttttgttcccagctgttcaagttaacgcggtatacgaagacgtttatctgttaggtacctctttggctagacctgttatcgctaaggctcaaatcgacgtcgctaagcaagaaggttgtttcgctgtttctcatggttgcaccggtaagggtaacgatcaaattagattcgaattgggtttctacgcattgaaaccagacgtcaaggtcattgccccatggagagatccaactttcttcgacagatttgctggtagaaaagatctattggcttatgctgccgaaaagaacatccctgtgttccaaaccgcttctaaaccatggtccactgatgagaacttggctcatatctcctacgaagctggtattctagaagatccaaaccaaactcctccaaacgatatgtggaagttgatcactggtccagaagatgctccagatcaaccacaagatttggatatcgttttcgaaaagggtttgccagtgaagttgacttacaaggatgccgcttctggcaaagaaactactgctacttcaccattggatatcttcttgacttctgcgaaattggctagagctaacggtgttggtagaatcgatatcgttgaaaatcgttacatcaacttgaaatctagaggttgttacgaacaagctccattgtccgtcttgagaagagctcacgttgacttggaaggtttgactttggacaaagaagtccgtgccttgagagatcaatttgtcactccaaattactccagattgttgtacaacggttcatacttcactccagaatgtgaatatatcagatctatgatccaaccttcccaatctacagttaacggtaccgttagattgagactatacaagggtaacatcattgtgctaggcagatactcagagactgagaacctatacaatcctgatgaatcttctatggatatattgactggtttccaaccaaccgacactaccggtttcatcgctattcaagcgatcagagtaaaaaagtacggtgaatccaaggctgccaagggtgaagaactaactttataa

SEQ ID NO: 5210 - protein, 420 aa, Kluyveromyces lactis NRRL Y-1140
MSKGKVCLAYSGGLDTSVILAWLLEQGYEVVAFMANVGQEEDFEAAEKKALLIGATKFVLVDCREEFVKDVLFPAVQVNAVYEDVYLLGTSLARPVIAKAQIDVAKQEGCFAVSHGCTGKGNDQIRFELGFYALKPDVKVIAPWRDPTFFDRFAGRKDLLAYAAEKNIPVFQTASKPWSTDENLAHISYEAGILEDPNQTPPNDMWKLITGPEDAPDQPQDLDIVFEKGLPVKLTYKDAASGKETTATSPLDIFLTSAKLARANGVGRIDIVENRYINLKSRGCYEQAPLSVLRRAHVDLEGLTLDKEVRALRDQFVTPNYSRLLYNGSYFTPECEYIRSMIQPSQSTVNGTVRLRLYKGNIIVLGRYSETENLYNPDESSMDILTGFQPTDTTGFIAIQAIRVKKYGESKAAKGEELTL

SEQ ID NO: 5211 - DNA, 1251 bp, Debaryomyces hansenii CBS767
  CDS (1)..(1251)
atgtctaaaggtaaggtttgtttggcatactcaggtggtttagatacctcagtcattttggcttggttattggaagaaggatatgaagttatcgcttatttggctaacattggtcaagaggaagacttcgaagaagccgaaagaaaggctttagcaattggtgccaccaagtttgttgttgttgatgtcagaaaggaattcgttgaacaagtttgtttcccagctatccaaactaacgctatttacgagaatgtctacttattaggtacttcgttagctagaccagttattgctcaagctcacatcaaggttgctgaagaaaacggatgttttgctgtttctcacggttgtactggtaagggtaacgatcaagttagatttgaattagctttttatgcattgaaaccagatgttactgttattgctccatggagagacccagactttttcaacagatttgcaggtagaaaagatttattagaatatgctggttctaagaacatcccagttgctcaaaccaaggctaagccatggtcaaccgacgaaaacttggcccatatttccttcgaagctggtattttagaagatcctgataccactccacctaaggatatgtggaaattgactgtcgacccactcgatgctccagataccccagaagatttctctgtttactttgaaaaaggtataccaaagaaattgatcttagatggtggtaagaaggtcattactgaaccagtcgaattgtttactgaagctaacgctttagccagaagaaatggtgtcggtagaattgatattgttgagaacagattcattggtatcaaatctagaggttgttatgaaactcctggtttgaccattttaagatctgcacacattgatttggaaggtttgactcttgatcgtgaagtccgtgccattagagatcaatttgttaccactacttactccaaattattgtacaatggtatgtactttacaccagaatgtgagtatgttagaaccatgattgacccatcccaaaagaccgtaaatggtgttgtcagagctagagcttacaagggatccttgtctattttaggtagatcttctgatactgaaaagttatatgacgaaaccgaatcatctatggacgaattaactggcttttccccagaagacacatccggatttattgccgttcaatccattagaatcaaaaaatatggtgaagcagttagagaaaagggtaatacattatctttataa

SEQ ID NO: 5212 - protein, 416 aa, Debaryomyces hansenii CBS767
MSKGKVCLAYSGGLDTSVILAWLLEEGYEVIAYLANIGQEEDFEEAERKALAIGATKFVVVDVRKEFVEQVCFPAIQTNAIYENVYLLGTSLARPVIAQAHIKVAEENGCFAVSHGCTGKGNDQVRFELAFYALKPDVTVIAPWRDPDFFNRFAGRKDLLEYAGSKNIPVAQTKAKPWSTDENLAHISFEAGILEDPDTTPPKDMWKLTVDPLDAPDTPEDFSVYFEKGIPKKLILDGGKKVITEPVELFTEANALARRNGVGRIDIVENRFIGIKSRGCYETPGLTILRSAHIDLEGLTLDREVRAIRDQFVTTTYSKLLYNGMYFTPECEYVRTMIDPSQKTVNGVVRARAYKGSLSILGRSSDTEKLYDETESSMDELTGFSPEDTSGFIAVQSIRIKKYGEAVREKGNTLSL

SEQ ID NO: 5213 - DNA, 1407 bp, Aspergillus nidulans FGSC A4
  CDS (1)..(1407)
atgggcaaaggaaagatctgtgtcgccttcagcggtggtctcgacaccagcgttatcttgaaatggctcatcgatgagggctacgaggttgtcgctttcactgccgatgttggccaggaagaggacttcgccgccatcaaggagaaagctctgaagctcggtgccgtcaaggccgaagttgtcgatcttcgccgcgagtttgttgaggaactctgcttccccgccattgcttgcaacgccatttacgagaacgtctacctcctcggtacctctctggctcgtcccgtcattgctcgtgctcagatcgaagttgctaagcgggaaggatgctttgctgtctcccacggttgtaccggcaagggtaacgatcaggtccgtttcgagctcgccttctacgctctccagcccgacatcaaggtcatcgctccttggcgtgacccccgtttctacgagcgcttcgccggtcgcaacgatctcctcgcctacgccgctgagaagggtatccccgtcacttccaccaaggccaagccctggagtatggacgaaaatctggcccactgctcttatgaggctggtatcctggaggaccctgacatcactcctcccaccgacatgtggaagcttactgtcgacccccttgccgctcccgacaagcccgaggatttcaccgtccacttcgagaagggtctccccgttaagctcgagtacaccgagaacggccagcagaagactgctacggacgctgttgacatcttcttgactgccaacgccatcgctcgccgtaacggtatcggccgtatcgacattgttgagaaccgtttcatcggtatcaagtctcgcggctgctacgagacccctggtctcacctgcctgcgctccgcacacgttgaccttgagggtcttgtgctcgaccgtgaggttcgtgctctgcgtgaccagttcgttactatcaactactccaagctcctttacaacggtctctacttctctccggagcgtgagttccttgagcaggccatccctgcctcccagaagtcggtcaacggcaaggttcgctgccgcgcctacaagggcaacatgatcatcctcggccgttcctctgagaccgagaagctgtacgatatgtccgagtccagcatggacgagattggtgactttgctcccaccgagactaccggattcattggcgtgtctgccatccgtctgaagaagtacggtcagatgaagcaggccgctggcgagaagctaaaagtgatatggaataacacgctcgagggatatcccgcaacttcagcccctgtttctctccgcattcagggcggccaggcatggtctgaaactcacctatctaatgcgtcctcggacgaaaatcctgccgactatgggccaaacccaatcagcgattga

SEQ ID NO: 5214 - protein, 468 aa, Aspergillus nidulans FGSC A4
MGKGKICVAFSGGLDTSVILKWLIDEGYEVVAFTADVGQEEDFAAIKEKALKLGAVKAEVVDLRREFVEELCFPAIACNAIYENVYLLGTSLARPVIARAQIEVAKREGCFAVSHGCTGKGNDQVRFELAFYALQPDIKVIAPWRDPRFYERFAGRNDLLAYAAEKGIPVTSTKAKPWSMDENLAHCSYEAGILEDPDITPPTDMWKLTVDPLAAPDKPEDFTVHFEKGLPVKLEYTENGQQKTATDAVDIFLTANAIARRNGIGRIDIVENRFIGIKSRGCYETPGLTCLRSAHVDLEGLVLDREVRALRDQFVTINYSKLLYNGLYFSPEREFLEQAIPASQKSVNGKVRCRAYKGNMIILGRSSETEKLYDMSESSMDEIGDFAPTETTGFIGVSAIRLKKYGQMKQAAGEKLKVIWNNTLEGYPATSAPVSLRIQGGQAWSETHLSNASSDENPADYGPNPISD

SEQ ID NO: 5215 - DNA, 1482 bp, Candida albicans SC5314
  CDS (1)..(1482): transl_table=12
atgactaattcggtaattggacaattgaaaaattttttaaccgcgcttaacctattatccattcattcatcaagaaaagaaattttttttttcttaaactataaaagggatagtaaaaacttgttgaacgaaaatttcatatatcttttctttttctctttcttttcttttcttctctttttattccattcaatttatacacacacatatacacaaaacaccaacagaaacatgtcaaagggaaaagtttgtttagcctattcaggtggtttggacacctcagtcatcttagcctggttattagaacaaggttatgaagtcattgctttcttagccaacattggacaagaagaagattttgaagaagctgaaaaaaaggcattagccattggtgccaccaaatttgttgtggttgatgtcagaaaagaatttgttgaaaaagtttgtttcccagcaattcaatcaaatgccatttatgaaaatgtttatttgttaggtacttcattagctagaccagtcattgctcaagcacaaattaaagttgctgaagaaaatggttgttttgccgtttctcacggttgtactggtaaaggtaatgaccaggttagatttgaattgagtttctatgcattgaaaccagatgttgtggtcattgctccatggagagacccagaattcttccaaagatttgctggtagaaaagatcttttagattatgctgcttctaaaaacatcccagtggcacaaaccaaagctaaaccatggtctactgatgaaaacttggctcatatttcatttgaagctggtattttggaaaatccagatactactccaccaaaagatatgtggaaattaactgtggatccaactgatgccccagataaaccagaaactttctcagttgtttttgaaaaagggttaccagtgaaattgatcttggatgacagtaaaaaagaaattactgatccagtagaattattcattgaagctaattctttagctagaagaaatggggttggtagaattgatattgtggagaatagatttattggtattaaatccagaggttgttatgaaactccaggtttgaccatcttaagaaatactcacgttgatttagaaggattgactttagatcgtgaagttagagccatcagagatcaatttgtgacaccaacttgggccaaaatcttatacaatggtatgtacttcacaccagaaggagaatacgttcgttcaatgattcctccatctcaagtcactgttaatggagttgttagagctgctgcttataaaggatctgtcaccatattaggtagatcttcagacactgaaaaattatacgatgaaaccgaatcatcaatggatgaattgaccggattctcaccagaagatactagtgggtttattgctgtgcaagccattagaatcaagaaatacggtgaagctgccagagaaaagggtaaaccattggatttgtaa

SEQ ID NO: 5216 - protein, 493 aa, Candida albicans SC5314
MTNSVIGQLKNFLTALNLLSIHSSRKEIFFFLNYKRDSKNLLNENFIYLFFFSFFSFLLFLFHSIYTHTYTQNTNRNMSKGKVCLAYSGGLDTSVILAWLLEQGYEVIAFLANIGQEEDFEEAEKKALAIGATKFVVVDVRKEFVEKVCFPAIQSNAIYENVYLLGTSLARPVIAQAQIKVAEENGCFAVSHGCTGKGNDQVRFELSFYALKPDVVVIAPWRDPEFFQRFAGRKDLLDYAASKNIPVAQTKAKPWSTDENLAHISFEAGILENPDTTPPKDMWKLTVDPTDAPDKPETFSVVFEKGLPVKLILDDSKKEITDPVELFIEANSLARRNGVGRIDIVENRFIGIKSRGCYETPGLTILRNTHVDLEGLTLDREVRAIRDQFVTPTWAKILYNGMYFTPEGEYVRSMIPPSQVTVNGVVRAAAYKGSVTILGRSSDTEKLYDETESSMDELTGFSPEDTSGFIAVQAIRIKKYGEAAREKGKPLDL

SEQ ID NO: 5217 - DNA, 1281 bp, Ustilago maydis 521
  CDS (1)..(1281)
atgccaggacagaccggaaaggtgctgttggcctactctggtggactcgacacgtccaccatccttgcatggcttatcgatgagggctacgatgtcatcgccttcatggccgatgttggtcaggaggaggacttcgaggctgctcgctccaaggcgctcaaatgcggtgccaaggacttcatccttgccgatctcaggcgcgaatttatcgaggagctcatcttccctgccgtccaggccaacgccatctacgaggatgtctacctgctcggcacctcgctcgctcgtcctgtcattgcccgcggcatgatcgaggctgctgaaaagaccggctgccagttcgtctcgcacggctgcaccggtaagggcaacgaccaggtccgattcgagcttgccttctacggtctcaagcccgacatcaaggtgattgctccatggcgtatccccgagttcttcaaccgctttgccggccgatctgctttgctcgagtacgccgagtccaagggtatccctgttacccagaccaaggccaagccctggtcgaccgacgagaacctcttccacatctcgtacgaggctggtattctcgaagaccctaacaccacgcctcctgctgacatgtggaagctcaccaagagccccgagtcggctcccgacactcccgagcgtatcgtgatcgagttcaagcagggtcttccctccaaggtcaaggtgctctccacgggtaaggagcacactgaccccgtcgacgtcttcctcacgcttaacgctcttgcccgtgccaacggtatcggccgtatcgacattgtcgaaaaccgtttcatcggtgtcaagtcgcgtggctgctacgagtcgcccggtgccaccatcctgcgcgccgctcacttggacctggagggtctcacgctcgaccgcgaggttcgtcgtatccgtgaccaggtgatcactcagaagttctcggaacagctctactacggtttcttcttctcgcccgaatgcgagtttgtccgttcgtgcattccccaatcgcaaaagacggtcaacggtcaggtcaaggtggcgctgtacaagggtaacgtcattatcgagggccgaagctccgaggaattgctgtacgacgagaagttcacctcaatggacgagcagggtggtttcgattcggcggccaccagcggtttcatcaccgttcaggctatccgtctgcgccgatatggtctcggtctcagcgagaagggtcagggtggctcggatcgcgagaccgcctacgctatccgcaagtga

SEQ ID NO: 5218 - protein, 426 aa, Ustilago maydis 521
MPGQTGKVLLAYSGGLDTSTILAWLIDEGYDVIAFMADVGQEEDFEAARSKALKCGAKDFILADLRREFIEELIFPAVQANAIYEDVYLLGTSLARPVIARGMIEAAEKTGCQFVSHGCTGKGNDQVRFELAFYGLKPDIKVIAPWRIPEFFNRFAGRSALLEYAESKGIPVTQTKAKPWSTDENLFHISYEAGILEDPNTTPPADMWKLTKSPESAPDTPERIVIEFKQGLPSKVKVLSTGKEHTDPVDVFLTLNALARANGIGRIDIVENRFIGVKSRGCYESPGATILRAAHLDLEGLTLDREVRRIRDQVITQKFSEQLYYGFFFSPECEFVRSCIPQSQKTVNGQVKVALYKGNVIIEGRSSEELLYDEKFTSMDEQGGFDSAATSGFITVQAIRLRRYGLGLSEKGQGGSDRETAYAIRK

SEQ ID NO: 5219 - DNA, 1290 bp, Cryptococcus neoformans var. neoformans B-3501A
  CDS (1)..(1290)
atggttgctactggtgagaagaagggcaaagtcattctcgcctactctggtggtcttgacacttcttgcattcttctctggcttatcgagcaaggctatgaggttgttgcctatatggctgatgttggtcaggaggaggactttgaggctgctcgtgccaaggctatgcagtgtggtgccgttggtttccaccttgccgacttgaagcgagagtttgttgaggagctcatttaccccgccgttcaatgtaacgccatctatgagaacgtgtacctcctcggtacttcccttgcccgtcctgttatcgcccgaggcatgatcgaggctgccgtcaaggaaggttgcgactttgtctctcacggttgtaccggcaagggtaacgaccaagtccgattcgagctcgccttttacggtctcgcccccaacatcaaggtcattgctccctggcgattgcctgagttctacgagcgattcgacggtcgatccgctttgctcgagtacgccgctaagaacggtattcccgtcacccagaccgcggccaagccctggtctactgacgagaacctcttccacatctcttacgaggccggtatccttgaggaccccaaccagactccccccgatgacatgtggaagcttactgtttcccccgagaaggctcccgatgcccccgagcgagttcacatcgagttcgccaagggcctccccgtcaaggttactttccctgctgacggcaacactgtgaccgactctgttgacattttccttaccctcaacgctcttgccaggaggcacggtgtcggccgaatcgacattgtcgagaaccgattcattggtgtcaagtctcgaggatgctacgagtctccggccgccaccatcctccgagctgcccacatggacctcgaaggtttgacccttgatcgaaacgtccgagctctccgagaccaattcgttaccacccaactctctcagatcctctacaacggtttcttcttctcccccgagcgtgaattcatcactgccgccatccctgcttctcagaagactgtcaacggtgtcgtccgactcaagctctacaagggcaacgttgttgtcgagggccgagatgccgatgagggcttgtacgacgccaagttcacctctatggacgagatgggcggtttcgagcccactgcgaccagcggcttcatcgaaatttcttctatcaggatcaaggcttggggcagagccaacatcaagcgaggccaggacggtgtctcccccaaagacgtgtaccaccgtgaaaactag

SEQ ID NO: 5220 - protein, 429 aa, Cryptococcus neoformans var. neoformans B-3501A
MVATGEKKGKVILAYSGGLDTSCILLWLIEQGYEVVAYMADVGQEEDFEAARAKAMQCGAVGFHLADLKREFVEELIYPAVQCNAIYENVYLLGTSLARPVIARGMIEAAVKEGCDFVSHGCTGKGNDQVRFELAFYGLAPNIKVIAPWRLPEFYERFDGRSALLEYAAKNGIPVTQTAAKPWSTDENLFHISYEAGILEDPNQTPPDDMWKLTVSPEKAPDAPERVHIEFAKGLPVKVTFPADGNTVTDSVDIFLTLNALARRHGVGRIDIVENRFIGVKSRGCYESPAATILRAAHMDLEGLTLDRNVRALRDQFVTTQLSQILYNGFFFSPEREFITAAIPASQKTVNGVVRLKLYKGNVVVEGRDADEGLYDAKFTSMDEMGGFEPTATSGFIEISSIRIKAWGRANIKRGQDGVSPKDVYHREN

SEQ ID NO: 5221 - DNA, 1215 bp, Prochlorococcus marinus str. AS9601
  CDS (1)..(1215): transl_table=11
atgcagcagttaaaaaaagttgtactagcttattctggtggcgtagatacgagcgtttgtattccatatttaaagaatgaatatggaatttcagaagtagttacttttgtagcagatcttggacaaggcgaggatttagaacttgttagacaaaaagctttaaactctggtgcatctaaatcaatcgttggcaatttagttaatagttttgttgaaagatacgcttttccagccattagagcaaatgcattatatttagataaatatcctttatctactgctcttgctaggcctttaattgctgaaaatctcgtaaatattgctagagagattaatgccgatgcagtagctcatggatgcactggtaaagggaatgatcaagttcggttcgatttagcaattaacgctttaggtcctgatttaaaaataattactcctgcaagggagtggaatatgagtagagaagaggcaatattgtatggagaaaagtttggtatacctgcaccagtatcaaaaaaatcaccatattcaatagacgttaacttactcggtaggagtattgaagcaggtatattagaagacccaatgcaagaagcacctgaggatattttttcgatgacatcatcagttaataattcacctgattctcatcaagatatagaaattgttttcaaaaatgggtttccagttggaattaatgatcaatttttaactccagtagagatcattcaaagagctaataatcttgcaggtaaacacggttttggaagaatagatatgattgaggatcgagtagtaggaattaaaagtagagagatttacgaaacacctggcctcttacttttaatcaaagctcacaaagaattagagagcattacgttaaatcctgatgttatcgattttaaaggaatggtggaaaaaaaatggggtcaattagtttatcaaggtttttggtttggtcctcttaaagaaagtttagatgcatttatatcatcgactcaaacttcagtaaatggaagagtaaaaattagactttataagggaaacgcaatagtcattgggagaatgtcggaaaataattcactttacagggaagatttggcaacttacagcaaagatgatgtatttaatcattctctagcagagggttttatttatatgtggggtatgtctaataaaatatgggctgagttaaattcaaaaacaaaagattaa

SEQ ID NO: 5222 - protein, 404 aa, Prochlorococcus marinus str. AS9601
MQQLKKVVLAYSGGVDTSVCIPYLKNEYGISEVVTFVADLGQGEDLELVRQKALNSGASKSIVGNLVNSFVERYAFPAIRANALYLDKYPLSTALARPLIAENLVNIAREINADAVAHGCTGKGNDQVRFDLAINALGPDLKIITPAREWNMSREEAILYGEKFGIPAPVSKKSPYSIDVNLLGRSIEAGILEDPMQEAPEDIFSMTSSVNNSPDSHQDIEIVFKNGFPVGINDQFLTPVEIIQRANNLAGKHGFGRIDMIEDRVVGIKSREIYETPGLLLLIKAHKELESITLNPDVIDFKGMVEKKWGQLVYQGFWFGPLKESLDAFISSTQTSVNGRVKIRLYKGNAIVIGRMSENNSLYREDLATYSKDDVFNHSLAEGFIYMWGMSNKIWAELNSKTKD

SEQ ID NO: 5223 - DNA, 1215 bp, Prochlorococcus marinus str. MIT 9515
  CDS (1)..(1215): transl_table=11
atgcagcacccaaaaaaagttgttcttgcctattctggtggagttgatactagtgtttgtattccatatcttaaaaatgaatacggaatttcagaagttattacttttgtggcagatcttggtcaaggagacgatatagagagtattagtcaaaaagctttaaattccggagcaacaaaatcggtgattggaaatttagtagaggattttgttgagaagtatgcttttcctgctataagagcaaacgcactttatggagaaaagtatcctttatcaacagctttggccagacctttaatagctgaaaatcttgtcaaattagcaagaaaattaaatgctggcgcagttgcgcacggttgtacaggaaaaggaaatgatcaagtaagatttgacttggctattaatgctttaggacctgatttggagataattacacctgctcgagaatggaagatgagtagagaagaagctattttatatggagaaaaatttggaattcctgctccggtttctaagaaatcaccatactcgattgatgtcaatcttcttggccgtagtgtcgaagctggttttttggaagatccgatgcaagaacctaatgaagaagtttttgcgatgacttcatctattgatgattcgccaaattatccaaaggatatagaaattacatttaaaaatggatttcctattgctattgggaacgaatctctaagccctttaaagattattcaaaaggttaattacttagcaggaaaaaatggttttggtaggattgatatgattgaagatagagtagttggcattaaaagtagagaaatatatgaggctcctggtcttttactgcttataaaagctcataaagaattagaaagcataacgttaaatccagatgtattagattttaaaaatttagtcgaaaaaaaatgggcccaacttgtatatcagggattttggttcggccctcttaagaaagcattagatggttttattgatgcaacacaaacttctgttaatggaaaggtgaaaataagattacataaaggaaatgcaataataattggtaggtcctctgaaaataattctctttatagggaagatttagcaacctatagtaaagatgatatttttgaccacaagcaagcagaaggattcatctatatgtggggtatgtctaataaaatatgggcagaattaaattcaaaaatgaataattaa

SEQ ID NO: 5224 - protein, 404 aa, Prochlorococcus marinus str. MIT 9515
MQHPKKVVLAYSGGVDTSVCIPYLKNEYGISEVITFVADLGQGDDIESISQKALNSGATKSVIGNLVEDFVEKYAFPAIRANALYGEKYPLSTALARPLIAENLVKLARKLNAGAVAHGCTGKGNDQVRFDLAINALGPDLEIITPAREWKMSREEAILYGEKFGIPAPVSKKSPYSIDVNLLGRSVEAGFLEDPMQEPNEEVFAMTSSIDDSPNYPKDIEITFKNGFPIAIGNESLSPLKIIQKVNYLAGKNGFGRIDMIEDRVVGIKSREIYEAPGLLLLIKAHKELESITLNPDVLDFKNLVEKKWAQLVYQGFWFGPLKKALDGFIDATQTSVNGKVKIRLHKGNAIIIGRSSENNSLYREDLATYSKDDIFDHKQAEGFIYMWGMSNKIWAELNSKMNN

SEQ ID NO: 5225 - DNA, 1203 bp, Prochlorococcus marinus str. NATL1A
  CDS (1)..(1203): transl_table=11
atgggaaaggctaaaaaagttgttttggcttattcaggaggggttgatactagcgtttgtattccttacttgaagaaggaatatggagtcgagcatgtaattgcatttgcagcagatcttggtcaaggcgacgagcttgatcaaatcaaacaaaaggctatttcagcaggagcttcagaatctttaattggcaatttggtaaagcctttcatagaagattttgctttcccagcgattagatctaatgctttgtatcaaggtagatatcctctttcaacggcattagctagaccattaattgcaaaaaaccttgttgaaattgcaagggaactaaatgccgatggagtcgctcacgggtgtacgggcaaagggaacgatcaagtgcgttttgatgtgactattggagctttagctcctgatttgcaattgcttacaccagcacgggaatggggtatgagccgcgaagaaaccattgcctatggagaaaaatatggaatagttccccctgtaagtaaaaaaactccttactcgattgatttgaatcttttggggagaagtattgaagctggtcctcttgaagatccatttgagatgccatcagaagaagtgtttggcatcacttcttctatagctgattcaccaaacgagcctgagatagtagatattttgtttgaaaatggttatccagttgcaattaatggagaagcgatggagccagtatccctgattaaaaaagctaatagccttgcaggaaagcatggctttggacgtttggatattattgaagacagagtagtaggaattaaaagtcgagaaatttatgaaactccaggattgcttttattaattaaagctcatcaggaaattgagagtttaactttacctgccgacttattagatactaaatttagactcgaacgacaatgggcagacttggtttataaaggtttttggtttagtcctctaaaagaagctttggatggatttattaattattctcaaaagcaagtgaatggaacagtcagggttaggctttttaagggtaatgtcgatgttataggtcgcaagtcaaaagaaaatagtttgtatatttcagatatgtctacttatggaagtgaggataagttcaatcacaaatccgctgaaggatttatatatgtatggggattgcctagtcgaatttggtcttggataaacaagtaa

SEQ ID NO: 5226 - protein, 400 aa, Prochlorococcus marinus str. NATL1A
MGKAKKVVLAYSGGVDTSVCIPYLKKEYGVEHVIAFAADLGQGDELDQIKQKAISAGASESLIGNLVKPFIEDFAFPAIRSNALYQGRYPLSTALARPLIAKNLVEIARELNADGVAHGCTGKGNDQVRFDVTIGALAPDLQLLTPAREWGMSREETIAYGEKYGIVPPVSKKTPYSIDLNLLGRSIEAGPLEDPFEMPSEEVFGITSSIADSPNEPEIVDILFENGYPVAINGEAMEPVSLIKKANSLAGKHGFGRLDIIEDRVVGIKSREIYETPGLLLLIKAHQEIESLTLPADLLDTKFRLERQWADLVYKGFWFSPLKEALDGFINYSQKQVNGTVRVRLFKGNVDVIGRKSKENSLYISDMSTYGSEDKFNHKSAEGFIYVWGLPSRIWSWINK

SEQ ID NO: 5227 - DNA, 1206 bp, Prochlorococcus marinus str. MIT 9303
  CDS (1)..(1206): transl_table=11
atggggcgtgcgaagaaggtggtgcttgcttattccggtggtgttgataccagcgtttgcatcccatatctcaagcatgaatggggggtagacgaggtgatcacctttgctgccgatttaggtcagggcgatgagcttgatcccatccgccttaaggctcttgatgctggtgctagtcagtctctggtgggagatttgatagagccttttgtagaagagtttgctttgccggcgattcgtgccaatgctctttatgaaggtcgttatccactgtctacggctttagctcgccccctgattgctcgtcggttggtagaggttgccagggaggtcggtgccgatgcggttgctcatggctgtaccggtaaaggcaacgatcaggtgcgttttgatttggctattgcagcactagcacctgatctcaaggtgctaactcccgctcgggaatggagcatgagcagagaggaggcgatcgcctatggcgaacgttgtgggatccctgcccccgtgagtaagaaatcgccttattcgattgatctgaatctgttgggtcgaagtattgaagcgggtcctcttgaagatccgatggtggctccgcccgaggaggtctttgccatgacctcctcgattgacgctgcaccctctcaggctcaggacattgagatcagatttgaagctggtaatcctgtggctattgatggggtgcgacttgattcggtgggtttgatcaaggaggcgaatcgtcttgctggacggcatggtttcggtcgccttgacatcattgagaatcgggtggttggtatcaagagtcgggagatttatgaaactccagggttacttttattgattcgtgctcatcaggaattggagagtttgacacttgctgcggatgtgttgcgcatgaagcgtcaattggagatgcaatgggctgagctggtctatcagggtctttggttttcccctttgaaggatgctctggatggattcatggatcgcactcagatttatgtgaatggcttggtgcggattcgtctccataaaggcaatgccatggtgattggccggagctctgacaccaacagcttgtatatatctgagatggctacctatggcagcgaggacaactttgaccacagggctgctgaaggatttatctacatctggggacttccaagtcgcctttgggcagcagctcggcgaggctaa

SEQ ID NO: 5228 - protein, 401 aa, Prochlorococcus marinus str. MIT 9303
MGRAKKVVLAYSGGVDTSVCIPYLKHEWGVDEVITFAADLGQGDELDPIRLKALDAGASQSLVGDLIEPFVEEFALPAIRANALYEGRYPLSTALARPLIARRLVEVAREVGADAVAHGCTGKGNDQVRFDLAIAALAPDLKVLTPAREWSMSREEAIAYGERCGIPAPVSKKSPYSIDLNLLGRSIEAGPLEDPMVAPPEEVFAMTSSIDAAPSQAQDIEIRFEAGNPVAIDGVRLDSVGLIKEANRLAGRHGFGRLDIIENRVVGIKSREIYETPGLLLLIRAHQELESLTLAADVLRMKRQLEMQWAELVYQGLWFSPLKDALDGFMDRTQIYVNGLVRIRLHKGNAMVIGRSSDTNSLYISEMATYGSEDNFDHRAAEGFIYIWGLPSRLWAAARRG

SEQ ID NO: 5229 - DNA, 1218 bp, Clostridium thermocellum ATCC 27405
  CDS (1)..(1218): transl_table=11
atgagtcaaaaagaaaaagtaatccttgcctattccggcggtctggatacttcaataatcattccctggcttaaagaaaattatgactatgaagtcattgcaatggcagctgacgttggacagggcgaagagcttgaacccttaagagagaaagctataaaaaccggggcaagcaaaatatatattgaagacttgaaagaagaatttgtgacagactttattttccccacattaaaagcaggtgccgtatatgaaggaaaatatcttttgggtacatcctttgcaagacctcttatagcaaagagaatggttgaaattgccttaaaagaaggcgctacagcagtcgctcacggagcaacgggaaaaggaaacgaccaggtccgtttcgagctgaccgtcaaagctcttgctccccatcttaaaatcattgctccgtggagaatatgggacattaaatccagagaagatgaaatcgaatacgcccaggcaagaaacatccccattcctgtatcaaaagaagacaactacagcatggacagaaacctctggcacctcagccatgaaggcttggatttggaagacccatggaacgaaccgcagtatgacaaaatattaaagctcatggttccgccggaaaaagctccggacaaacccacctatgttgaaatatattttgaaaagggtatacctaaaaaagttaacggtgtggaatacggacctgtggagcttattgaagttcttaacaaaatcggcggtgaaaacggtataggaatcgttgacatagtggaaaacagattggtcggaatgaaatccagaggcgtttatgaaactccgggtggaaccattctttatgcggctcacagagagcttgagcttttgtgtcttgaccgtgacactctccattacaaagatcttgtggctcaaagatttgcagagcttgtttattacggacagtggtatactcctctgcgtgaggctatttcagcctttgttgatgttactcaggagacggttaccggtacagtaagattaaaactttacaaaggaaatataataagcgcgggagccaaatccgattattccctctacagtgaagaactttccacgttcggagaagacaatgtatacaatcaaaaggatgccgaaggatttataaatctctttggtcttccgatgaaggttcaggctcttatgaaagaaaagaataaaggcaaataa

SEQ ID NO: 5230 - protein, 405 aa, Clostridium thermocellum ATCC 27405
MSQKEKVILAYSGGLDTSIIIPWLKENYDYEVIAMAADVGQGEELEPLREKAIKTGASKIYIEDLKEEFVTDFIFPTLKAGAVYEGKYLLGTSFARPLIAKRMVEIALKEGATAVAHGATGKGNDQVRFELTVKALAPHLKIIAPWRIWDIKSREDEIEYAQARNIPIPVSKEDNYSMDRNLWHLSHEGLDLEDPWNEPQYDKILKLMVPPEKAPDKPTYVEIYFEKGIPKKVNGVEYGPVELIEVLNKIGGENGIGIVDIVENRLVGMKSRGVYETPGGTILYAAHRELELLCLDRDTLHYKDLVAQRFAELVYYGQWYTPLREAISAFVDVTQETVTGTVRLKLYKGNIISAGAKSDYSLYSEELSTFGEDNVYNQKDAEGFINLFGLPMKVQALMKEKNKGK

SEQ ID NO: 5231 - DNA, 1203 bp, Mycobacterium sp. JLS
  CDS (1)..(1203): transl_table=11
atgtccgaacgcgtcatcctggcgtactccggcggtctggacacctcggtggcgatcagctggatcggcaaggagaccgggcgcgaggtggtggcggtcgccatcgacctcggtcagggcggcgaggacatggacgtcgtgcgccagcgtgccctcgactgcggtgcggtcgaagccgtcgtcgtcgacgcccgcgacgagttcgccgagaactactgcctgcccgccatccagtccaacgcgctctacatggaccgctatccgctggtgtccgcgctcagccggccgctgatcgtcaaacacctcgtcgacgccgcccgcgaacacaagggcggcatcgtcgcgcacggctgcacgggcaagggcaacgaccaggtccgcttcgaggtcgggttcgcctcgctggcgccggatctcgaggtgctcgccccggtccgcgactatgcgtggacgcgcgagaaggcgatcgcgttcgccgaggagaacgcgatcccgatcaacgtcaccaagcgctcaccgttctcgatcgaccagaacgtgtggggccgcgcggtggagaccggattcctcgagcacctgtggaacgcgcccaccaaggacgtctacgactacaccgaggatccgacactcaactggagcacccccgacgaggtgatcgtcggtttcgacaagggtgtgccggtgtccgtcgacggccgcgacgtgaccgtgctgcaggcgatcgaggaactcaaccgccgtgcgggcgcgcagggcgtgggccgcctcgatgtcgtcgaggaccggttggtcggcatcaagagccgcgagatctacgaggcccccggtgcgatggtgctcatcaccgcgcacaccgaactcgaacatgtcacgctggaacgcgaactcggccggttcaagcgcaccaccgaccagaagtggggtgagctggtctacgacgggctgtggttctccccgctgaagaccgcgctcgagtcgttcgtcgccaagacgcaggaacacgtcagcggtgagatccggctggtgctgcacggtggccacatcgccgtgaatggacgccggagccaggaatctctgtacgacttcaacctggccacctacgacgagggcgacaccttcgaccagtcctcggccaagggcttcgtgcacgtgcacggcctgagctcgagcatctccgcgcgccgcgacctgggcatcaagtga

SEQ ID NO: 5232 - protein, 400 aa, Mycobacterium sp. JLS
MSERVILAYSGGLDTSVAISWIGKETGREVVAVAIDLGQGGEDMDVVRQRALDCGAVEAVVVDARDEFAENYCLPAIQSNALYMDRYPLVSALSRPLIVKHLVDAAREHKGGIVAHGCTGKGNDQVRFEVGFASLAPDLEVLAPVRDYAWTREKAIAFAEENAIPINVTKRSPFSIDQNVWGRAVETGFLEHLWNAPTKDVYDYTEDPTLNWSTPDEVIVGFDKGVPVSVDGRDVTVLQAIEELNRRAGAQGVGRLDVVEDRLVGIKSREIYEAPGAMVLITAHTELEHVTLERELGRFKRTTDQKWGELVYDGLWFSPLKTALESFVAKTQEHVSGEIRLVLHGGHIAVNGRRSQESLYDFNLATYDEGDTFDQSSAKGFVHVHGLSSSISARRDLGIK

SEQ ID NO: 5233 - DNA, 1215 bp, Prochlorococcus marinus str. MIT 9301
  CDS (1)..(1215): transl_table=11
atgcagcaggtaaaaaaagttgtgctagcttattctggcggcgtagatacgagcgtttgtattccatatttaaagaaagaatatggagtttcagaagtggttacttttgttgcagatcttggtcaaggcgaggatttagaacttattaggcaaaaagctttaaattctggtgcatctcaatcaattgttggcaatttagttaatagttttgttgaaagatacgcttttccagccattagagcaaacgcattatatttagataaatatcctttatctacagctcttgctaggcctttaattgcagaaaatcttgtaaatattgctcgagagattagtgctgatgcagttgctcatggatgcactggtaaagggaatgatcaagttagatttgatttagcaataaatgctttaggtcctgatttaaaaataattactcctgcaagggaatggaatatgagtagggaagaggcaatagagtacggagaaaagtttggtattcccgcaccagtatcaaaaaaatcaccatattcaatagatgttaatttacttggtaggagtattgaagcaggcatattagaagacccaatgaaagaagcacctgaagatatttttgcaatgacatcatctattgagaattcaccggattctcctcaagaagtagaaattatttttaaaaatgggtttcctgttggaattaatgatgaatctctaacccccgtagagattattaaaaaagctaatgttctcgcaggagagcatggttttggaagaattgatatgattgaagaccgggtagtaggaattaaaagtagagagatttacgaaacgccaggcctcttgcttttaatcaaagctcacaaagaattagaaagcatcacattaaatccagacgttgtcgattttaaaggaatagttgaaaaaaaatggggtcaacttgtctatcaaggtttttggtttggacctcttaaagatagtttagattcatttatttcgtcgactcaaacagcagttaatggaagagtaaagattagacttcataaggggaacgcaatagtaatcggtagaatgtcggaaaataactcactttatagagaggatttggcaacttatagcgaagaagatgtttttaatcattctttagcagagggttttatttacatgtggggtatgtctaataaaatatgggctgaattaaattcaaaaacaaaagattaa

SEQ ID NO: 5234 - protein, 404 aa, Prochlorococcus marinus str. MIT 9301
MQQVKKVVLAYSGGVDTSVCIPYLKKEYGVSEVVTFVADLGQGEDLELIRQKALNSGASQSIVGNLVNSFVERYAFPAIRANALYLDKYPLSTALARPLIAENLVNIAREISADAVAHGCTGKGNDQVRFDLAINALGPDLKIITPAREWNMSREEAIEYGEKFGIPAPVSKKSPYSIDVNLLGRSIEAGILEDPMKEAPEDIFAMTSSIENSPDSPQEVEIIFKNGFPVGINDESLTPVEIIKKANVLAGEHGFGRIDMIEDRVVGIKSREIYETPGLLLLIKAHKELESITLNPDVVDFKGIVEKKWGQLVYQGFWFGPLKDSLDSFISSTQTAVNGRVKIRLHKGNAIVIGRMSENNSLYREDLATYSEEDVFNHSLAEGFIYMWGMSNKIWAELNSKTKD

SEQ ID NO: 5235 - DNA, 1338 bp, Herminiimonas arsenicoxydans
  CDS (1)..(1338): transl_table=11
atgtcgaatattctccaatccgttcccgtcaatcaaaaagtaggcatcgccttttccggcggcctcgacaccagcgcagccttgcactggatgcgtcaaaaaggcgcgatcccttatgcatacactgcgaatctgggtcagcctgacgaaaccgactacaacgcgattccggaaaaagccaaggcctacggcgccgaactggcacgcctgatcgattgccgcgaacaactggtggcggaaggtatcgctgcattgcaaagcggcgccttccacatctcgaccgccggcgttacctatttcaacacgacgcctttgggccgcgcagtcaccggcaccatgctggtcgccgcgatgaaagaagacaacgtcgatatctggggtgacggcagcacattcaagggcaatgacatcgaacgtttctatcgctacggcttgctgatgaatccggcgctgcgcatttacaaaccctggctggacgatgccttcatcaacgaactcggcggccgcaaggaaatgtcggaattcctgatcaagtccggcttcgactacaagatgtccaccgagaaagcgtattcgaccgattccaacatcctcggtgctacgcatgaagcaaaagatctggaagagctcagcagcggcatgcagatcgtcgaacctatcatgggcgtcgcattctggcgtgacgacgtggaagtcaaacgcgaaactgtcaccgtgcgtttcgaagaaggccgtccgatcgcattgaatggcgttgtctataccgatctggtcgaactgatgctggaagccaatcgcatcggcggccgtcatggcctcggcatgagcgatcaaatcgaaaaccgcatcatcgaagcgaagagccgcggcatctacgaagccccgggcctggcgctgttattcattgcttacgaacgcctgatcaccggcatccacaacgaagacacgatcgagcaataccgcgaaagcggccgccgtctgggtcgtctgttgtaccagggccgctggttcgatccgcaagccatcatgctgcgcgaagccgcacaacgctgggttgcacgtgcgatcactggcgaagtcacgatcgaactgcgtcgcggcaacgattattccatcctcaataccgtgtcggccaacctgacctacgcgccggaacgcctgtcgatggaaaaagtggaagatgcaccgttctcgccagccgaccgtattggtcaattgacgatgcgtaatctggacatcacagacacacgtcacaagctggccatctacagcagcgccggcctgctgaccggcaactcgtctgttgctctcccaagctttgaaaaagacaagaaataa

SEQ ID NO: 5236 - protein, 445 aa, Herminiimonas arsenicoxydans
MSNILQSVPVNQKVGIAFSGGLDTSAALHWMRQKGAIPYAYTANLGQPDETDYNAIPEKAKAYGAELARLIDCREQLVAEGIAALQSGAFHISTAGVTYFNTTPLGRAVTGTMLVAAMKEDNVDIWGDGSTFKGNDIERFYRYGLLMNPALRIYKPWLDDAFINELGGRKEMSEFLIKSGFDYKMSTEKAYSTDSNILGATHEAKDLEELSSGMQIVEPIMGVAFWRDDVEVKRETVTVRFEEGRPIALNGVVYTDLVELMLEANRIGGRHGLGMSDQIENRIIEAKSRGIYEAPGLALLFIAYERLITGIHNEDTIEQYRESGRRLGRLLYQGRWFDPQAIMLREAAQRWVARAITGEVTIELRRGNDYSILNTVSANLTYAPERLSMEKVEDAPFSPADRIGQLTMRNLDITDTRHKLAIYSSAGLLTGNSSVALPSFEKDKK

SEQ ID NO: 5237 - DNA, 1338 bp, Burkholderia vietnamiensis G4
  CDS (1)..(1338): transl_table=11
atgagcacgattctcgaaagcctcccgaccggccagaaggtcggtatcgccttctccggcggcctggacaccagcgccgcgctgcactggatgaaactgaagggcgccgtcccgtacgcatacacggcgaacctcggccagcccgacgaagacgattacgatgcgatcccgaagcgcgcgatcgaatacggcgcagccggcgcccgtctgatcgactgccgcgcccagctcgtcgccgaaggcatcgcggcgctgcaaagcggcgcgttccacatcacgacggccggcgtcacctacttcaacacgacgccgatcggccgcgcggtcacgggcacgatgctggtcgccgcgatgaaggaagacggcgtcaacatctggggcgacggcagcacgtacaagggcaacgacatcgagcgtttctaccgctacggcctgctcgtcaaccccgatctgaagatctacaagccgtggctcgaccagacgttcatcgacgagctcggcggccgcgccgaaatgtccgagttcatgaaccaggcgggcttcgcgtacaggatgtcggccgagaaggcgtattcgaccgactcgaacctgctcggcgcgacgcacgaagcgaaggatctggaaagcctcgagagcggcatcaagatcgtgaacccgatcatgggcgtcgcgttctggcgcgacgacgtgaagatcgccgccgaagaagtgacggtgcgcttcgaagccggccagccggttgcgctgaacggcgtcgagttcaaggatcaggtcgagctgctgctggaagcgaaccgcatcggcggccgccatgggctcggcatgagcgaccagatcgagaaccggatcatcgaggcgaagagccgcggcatctacgaggctccggggctcgcgctgctgtacatcgcgtacgagcgtctcgtcaccggcatccacaacgaagacacgatcgagcagtaccgcgagaacggccgccgtctcggccgcctgctgtatcaaggccgctggttcgacccgcaggcgatcatgctgcgcgaaaccgcgcaacgctgggtcgcgcgcgcgatcaccggcgaagtgaagatcgaactgcgccgcggcaacgactactcgatcctgagcacgaagtcgccgaacctcacgtatcagccggaacgcctgtcgatggagaaggttgcgtcgacgttctcgccgcgcgaccggatcggccagttgacgatgcgcaacctcgacatcaccgatacgcgcgacaagctgcgtgtttatgcgcaagtcggtttgttaacgccgggtgaatcgtcggcgctgccgcagatcaagagcgacagcggcgagtaa

SEQ ID NO: 5238 - protein, 445 aa, Burkholderia vietnamiensis G4
MSTILESLPTGQKVGIAFSGGLDTSAALHWMKLKGAVPYAYTANLGQPDEDDYDAIPKRAIEYGAAGARLIDCRAQLVAEGIAALQSGAFHITTAGVTYFNTTPIGRAVTGTMLVAAMKEDGVNIWGDGSTYKGNDIERFYRYGLLVNPDLKIYKPWLDQTFIDELGGRAEMSEFMNQAGFAYRMSAEKAYSTDSNLLGATHEAKDLESLESGIKIVNPIMGVAFWRDDVKIAAEEVTVRFEAGQPVALNGVEFKDQVELLLEANRIGGRHGLGMSDQIENRIIEAKSRGIYEAPGLALLYIAYERLVTGIHNEDTIEQYRENGRRLGRLLYQGRWFDPQAIMLRETAQRWVARAITGEVKIELRRGNDYSILSTKSPNLTYQPERLSMEKVASTFSPRDRIGQLTMRNLDITDTRDKLRVYAQVGLLTPGESSALPQIKSDSGE

SEQ ID NO: 5239 - DNA, 1347 bp, Bradyrhizobium sp. ORS278
  CDS (1)..(1347): transl_table=11
atgaccacgatcctcaaaggcctgcctacgggcgagaaagtcggcatcgccttctccggcggcctcgacaccagcgcggcgctgctctggatgaagcagaagggcgcgcgctgcttcgcctacaccgccaatctcgggcagcccgacgagtccgactatgacgagatcccgcgcaaggcgatgagcttcggcgccgagaaggcgcgcctggtcgattgccgcacccagctggtgcatgagggcatcgccgcgatccagtccggcgccttccacatctcgaccggcggcgcgacctatttcaacaccacgccgctcggccgcgccgtcaccggcaccatgctggtggccgcgatgaaggaggacggcgtcaacatctggggcgacggctcgacctacaagggcaacgacatcgagcgcttctaccgctacggcctgctgaccaacccgaacctcaagatctacaagccctggctcgaccagcagttcatcgacgagctcggcggccgcgccgagatgtcggcattcctcaccgcccacggcttcaattacaagatgagcgccgaaaaggcgtattcgaccgacagcaatctgctcggcgccactcacgaggcgaaggatctcgaaagcctgtcgagcggcatccgcatcgtcaatccgatcatgggcgtgccgttctggcgtgaggactgcgcggtgaggcccgagaccgtcgtggtgcgcttcgaggaaggccagccggtcgcgctgaacggccagacattcacagatcccgtcgcgctgttcctggaggccaatgcgatcggcggccgccatggcctgggaatgtgcgaccagatcgagaaccgcatcatcgaggccaagagccgcgggatctacgaggcgcccggcatggcgctgctgcacattgcctatgagcggctcgtcaccggcatccacaacgaggatacgatcgagcagtaccgcatgagcggcatgaagcttggccgtctgctgtatcaaggccgttggttcgactcgcaggccttgatgctgcgcgagaccgcgcagcgctgggtcgccagcgccatcaccggcgaggtgactttggagctgcgccgcggcaacgactactcgctgctcaacaccgagagccccaacctgacctatcagccggagcggctgagcatggaaaaggtcgaggacgccgccttcacgcccgccgaccgtatcggccagctgaccatgcgcaacctcgacatcaccgacacccgcaccaagctgaagctctattcggacacgggcctgctgtctggcgcggagggcgctcaaattttccagctcggccatgacaagggcgacaagagctga

SEQ ID NO: 5240 - protein, 448 aa, Bradyrhizobium sp. ORS278
MTTILKGLPTGEKVGIAFSGGLDTSAALLWMKQKGARCFAYTANLGQPDESDYDEIPRKAMSFGAEKARLVDCRTQLVHEGIAAIQSGAFHISTGGATYFNTTPLGRAVTGTMLVAAMKEDGVNIWGDGSTYKGNDIERFYRYGLLTNPNLKIYKPWLDQQFIDELGGRAEMSAFLTAHGFNYKMSAEKAYSTDSNLLGATHEAKDLESLSSGIRIVNPIMGVPFWREDCAVRPETVVVRFEEGQPVALNGQTFTDPVALFLEANAIGGRHGLGMCDQIENRIIEAKSRGIYEAPGMALLHIAYERLVTGIHNEDTIEQYRMSGMKLGRLLYQGRWFDSQALMLRETAQRWVASAITGEVTLELRRGNDYSLLNTESPNLTYQPERLSMEKVEDAAFTPADRIGQLTMRNLDITDTRTKLKLYSDTGLLSGAEGAQIFQLGHDKGDKS

SEQ ID NO: 5241 - DNA, 1206 bp, Synechococcus sp. WH 7803
  CDS (1)..(1206): transl_table=11
atgggacgcgccaagaaggttgtgctcgcttattccggtggcgtggatacgagtgtttgcattccgtatctcaagcaggagtggggagtcgaggaggtgatcacgtttgccgctgacctcggccagggcgacgagctggagccgattcggcgcaaggctctggaggctggcgccagtcagtctctggtgggtgatctcatacagccgttcatcgaagagttcgcctttcctgccatccgtgccaatgccctttacgagggtcgttaccccttgtccacggccctggcccgtccgttgattgcccggcggcttgtggaagtggcgcgagaggttggcgcggatgcagtggcccatggatgcacgggcaagggcaacgaccaggtgcgttttgatgtggcgattgccgccttggctcccgatctcaaggtgctcacgccagccagggagtggggaatgagcagggaggaaacgattgcctacggcgaacgctgcggtctaccagcaccggtgagcaagaaatctccttattccatcgatctcaatctgcttggtcgcagcgttgaagccggccctctggaggatccgatgcaggctccccctgaagaagtgttcgccatgacggtgtccatcgatgcggcgccctcggaggctgaagagatcgagatcgccttcgaggctggcaaccctgtgagcatcaacggccagcgactcgatcctgttgccttgatccgagaagccaaccgtttggctggatcccatggcatcggtcgactcgacatgatcgagaaccgggtggtgggcatcaagagccgggagatctacgaaacgccgggtttgcttctcttgatccaggcccaccaggaactggagagtctcacccttgccgccgatgtgctccgcaccaagcggcagctggagatgcagtgggctgatttggtgtatcaaggactttggtttggtccgctcaaggaggccctcgatggcttcatggaccgcacccagagcgaagtgaacggcgtggtgcggctgcgcctgcacaagggcaatgccatcgttactggacgggggtccagcgacagcagcctttacgtgcctgaaatggcctcctacggcagcgaagatcagtttgatcaccgggccgctgaaggcttcatttatgtctggggtctgcccattcgtctctggtcagccgcccgtcgccgttga

SEQ ID NO: 5242 - protein, 401 aa, Synechococcus sp. WH 7803
MGRAKKVVLAYSGGVDTSVCIPYLKQEWGVEEVITFAADLGQGDELEPIRRKALEAGASQSLVGDLIQPFIEEFAFPAIRANALYEGRYPLSTALARPLIARRLVEVAREVGADAVAHGCTGKGNDQVRFDVAIAALAPDLKVLTPAREWGMSREETIAYGERCGLPAPVSKKSPYSIDLNLLGRSVEAGPLEDPMQAPPEEVFAMTVSIDAAPSEAEEIEIAFEAGNPVSINGQRLDPVALIREANRLAGSHGIGRLDMIENRVVGIKSREIYETPGLLLLIQAHQELESLTLAADVLRTKRQLEMQWADLVYQGLWFGPLKEALDGFMDRTQSEVNGVVRLRLHKGNAIVTGRGSSDSSLYVPEMASYGSEDQFDHRAAEGFIYVWGLPIRLWSAARRR

SEQ ID NO: 5243 - DNA, 1341 bp, Acinetobacter sp. ADP1
  CDS (1)..(1341): transl_table=11
atgactgataatgcaaccattttgcagcatgtaccagtaggtaaaaaagtgggtattgccttctctggtggtctggatacttcagctgctttattgtggatgaaacaaaaaggcgcagaaccttatgcatatactgcaaacttaggtcagccagatgaagacgactacgatgcgattccaaaaaaagcagaacaatacggtgcagttaaagcccgtctgatcgattgtcgtttacagcttgcgcttgaaggtattgcagcaattcagtgtggtgcattccatatcagcacaggcggtgttccttatttcaatacgacaccacttggccgtgctgttacaggcacaatgcttgtgactgccatgaaagaagatgatgtcaatatctggggcgatggttcgacctataaaggaaatgacatcgaacgtttctatcgttatggtctactcaccaatccaaacctaaaaatttataagccttggcttgaccaaacgtttattgatgaattaggcggtcgtgcggaaatgtcacaatttctaatcgacaacggttttgactataaaatgtcaaaagaaaaagcgtattcaaccgattcaaacatgctgggtgcaactcacgaagccaaagatcttgaatacctcgatgcaggtatcaagattgtagatccaatcatgggtgttgctttctggaaagatgaggttgaaattcaaccagaacaagtcagcattacctttgaagaaggtatgcctgtggcattgaacggtcaacgtattgaagatccggttgagttcattcttgaagcaaaccgtattggtggtcgtcatggtttaggcatgtcagatcagatcgaaaaccgtatcatcgaagctaaatctcgtggtatttatgaagctccaggtatggcacttctgcatattgcctacgaacgtcttgtgacaggtattcacaatgaagataccatcgaacagtaccgtatcaatggcttacgtttaggtcgtttactttaccaaggtcgctggtttgattcacagtcacttatgcttcgtgaaactgcacagcgctgggttgcaaaagccattacaggtacagtaactctagagttacgtcgcggtaatgattacaccatcatgaacactgaatctccaaacctcacgtatgaagctgagcgtttaaccatggagaaaggtgactcaatgtttagtccaatggatcgtatcggtcaattaaccatgcgtaatctggatattaccgatactcgtgcaaaattaggtatctatacaaattctggtctgctttctattggtcacggttctgctgtacctcagttagagactaagaaataa

SEQ ID NO: 5244 - protein, 446 aa, Acinetobacter sp. ADP1
MTDNATILQHVPVGKKVGIAFSGGLDTSAALLWMKQKGAEPYAYTANLGQPDEDDYDAIPKKAEQYGAVKARLIDCRLQLALEGIAAIQCGAFHISTGGVPYFNTTPLGRAVTGTMLVTAMKEDDVNIWGDGSTYKGNDIERFYRYGLLTNPNLKIYKPWLDQTFIDELGGRAEMSQFLIDNGFDYKMSKEKAYSTDSNMLGATHEAKDLEYLDAGIKIVDPIMGVAFWKDEVEIQPEQVSITFEEGMPVALNGQRIEDPVEFILEANRIGGRHGLGMSDQIENRIIEAKSRGIYEAPGMALLHIAYERLVTGIHNEDTIEQYRINGLRLGRLLYQGRWFDSQSLMLRETAQRWVAKAITGTVTLELRRGNDYTIMNTESPNLTYEAERLTMEKGDSMFSPMDRIGQLTMRNLDITDTRAKLGIYTNSGLLSIGHGSAVPQLETKK

SEQ ID NO: 5245 - DNA, 1347 bp, Erwinia carotovora subsp. atroseptica SCRI1043
  CDS (1)..(1347): transl_table=11
atgacaacgattctcaagcatcttccggttggtcagcgtattggtattgcgttctcgggtggtctggataccagcgctgcactgctttggatgcgtcaaaagggcgcggttccttatgcgtataccgcaaatctggggcaaccagacgaggatgactacgatgaaatccctcgtcgtgcaatggaatacggcgcagaaaatgctcgccttatcgattgccgtaagcaattagtcgctgaaggtatcgctgcgattcagtgtggcgcattccacaatacgacagcgggcgttacctatttcaacaccacgccgctaggccgtgcggttaccggtacgatgctggttgcggcgatgaaagaagacggcgtgaacatctggggtgacggcagcacctataaaggcaacgatattgagcgtttctatcgctacggcctgctgaccaatgctgaactgaagatttacaagccgtggctggataccgacttcattgatgagctgggcggccgtcaggagatgtctgagtttatgtcgcaggcagggttcggctataaaatgtcggccgagaaagcctattctacagattccaacattctgggtgcgacgcacgaagcgaaggatctggaattcctgaattccagcgttaaaatcgttaacccgattatgggcgtgaaattctgggacgagaacgtcaaggttccggcagaagaagtgaccattcgttttgagcgtggacacccggttgcgctgaacggcaagacctttaccgatgacattgaactgatgctggaagcaaaccgcatcggcggtcgtcacggtctgggtatgagcgaccagatcgaaaaccgcatcattgaagcgaaaagccgcggcatctatgaagcgccgggaatggcactgctgcacattgcctatgagcgtctgcttactggtatccacaacgaagacaccatcgagcaataccatgctaatggccgtcagctgggtcgtttcctgtatcagggacgctggtttgattcccaggcattgatgctgcgtgattcttcgcagcgttggatcgccagtgctatcaccggcgaggttacgctggagctgcgtcgtggcaatgattactccatcatgaatactgtgtctgacaatctgacctataagccagaacgcttgaccatggagaaaggcgactcggtcttctcgccagatgaccgtattggccagctgaccatgcgtaatctggacatcacggatacgcgtgaaaaactgtttaactatgctgaaacgggcttgctctcttcctctgccagcacgggcttgccgcaggtagggcaattgcaggataaaacagagaaataa

SEQ ID NO: 5246 - protein, 448 aa, Erwinia carotovora subsp. atroseptica SCRI1043
MTTILKHLPVGQRIGIAFSGGLDTSAALLWMRQKGAVPYAYTANLGQPDEDDYDEIPRRAMEYGAENARLIDCRKQLVAEGIAAIQCGAFHNTTAGVTYFNTTPLGRAVTGTMLVAAMKEDGVNIWGDGSTYKGNDIERFYRYGLLTNAELKIYKPWLDTDFIDELGGRQEMSEFMSQAGFGYKMSAEKAYSTDSNILGATHEAKDLEFLNSSVKIVNPIMGVKFWDENVKVPAEEVTIRFERGHPVALNGKTFTDDIELMLEANRIGGRHGLGMSDQIENRIIEAKSRGIYEAPGMALLHIAYERLLTGIHNEDTIEQYHANGRQLGRFLYQGRWFDSQALMLRDSSQRWIASAITGEVTLELRRGNDYSIMNTVSDNLTYKPERLTMEKGDSVFSPDDRIGQLTMRNLDITDTREKLFNYAETGLLSSSASTGLPQVGQLQDKTEK

SEQ ID NO: 5247 - DNA, 1425 bp, Propionibacterium acnes KPA171202
  CDS (1)..(1425): transl_table=11
gtggttgccgtgtccaaggtcatcactcagcttcccgtcggcgagcgcgtcggcatcgcattctccggaggactcgacacctccgtcgctgtcgcgtggatgcgcgaaaatggcgcggttccgtgcacctacaccgccgacattggtcagtacgacgagcccgacatcgcgtcagtgccgggtcgcgccctcgactacggcgctgagatctcccgacttgtcgactgcaaggcagcgctcgtcgaggagggactgagcgctatcgcgtgcggcgcgttcaacgttcgctccgccgggcgcccctacttcaacaccaccccaatcggtcgcgccgtcaccggcactctgttggtacgcgctatgcataccgacgacgtctccatttggggcgacggctccacctataagggcaacgacatcgagcggttctaccgctacggcttactcgccaacccgcagctgcgcatctataagccgtggctcgacgaaaacttcgtcgctgaactcggtggccgtgacgagatgagcgcctggcttaccgcccacaacctgccttatcgcgactccaaggaaaaggcctattccaccgacgccaacatctggggcgccacccacgaggccaagaaacttgaatccctgcacgtctccatcgagtccgtcaacccgatcatgggcgtcaagttctgggacccagacgtcaagatcgatactgaggaggtgacggtctccttcgagcagggcctgcccgtcgccatcaatggcaaggaatacgacgataaagtcgccctcgttctggaggccaacgccatcggcggtcgtcacggcctcggtatgagcgaccagatcgaaaatcgcattattgaggcgaaatcccgcggcatctatgaggccccgggcatggccctgctccacatcgcctacgaacgtctcgccaacgccatccacaacgaagacactctggagacttatcacaacgaggggcgtcgcctcgggcggctgctctacgagggacgttggctcgacccgcagtccctcatgatccgtgaatctctcacccactgggtcgccagcgccattactggatcggtcacgctcaagctgcgtcgtggctgggactactccatccttgacaccaccggaccgaacttctcgtaccactctgagaagttgtcgatggagcgcgttgagggggctgccttcggcccgaccgatcgcatcggccagctcacgatgcgcaacctcgatatcgccgatacccgcgaaaagcttgagctctactccgcgcaaggccagctcgccagccacgccgacctcgttgggcagcttgagaccggcggcgcatcagctatcgcgtccaacggcgacgatgacgacgacagccaaaagactctcgacgctgccgcaatggaagttggcgtcaactga

SEQ ID NO: 5248 - protein, 474 aa, Propionibacterium acnes KPA171202
MVAVSKVITQLPVGERVGIAFSGGLDTSVAVAWMRENGAVPCTYTADIGQYDEPDIASVPGRALDYGAEISRLVDCKAALVEEGLSAIACGAFNVRSAGRPYFNTTPIGRAVTGTLLVRAMHTDDVSIWGDGSTYKGNDIERFYRYGLLANPQLRIYKPWLDENFVAELGGRDEMSAWLTAHNLPYRDSKEKAYSTDANIWGATHEAKKLESLHVSIESVNPIMGVKFWDPDVKIDTEEVTVSFEQGLPVAINGKEYDDKVALVLEANAIGGRHGLGMSDQIENRIIEAKSRGIYEAPGMALLHIAYERLANAIHNEDTLETYHNEGRRLGRLLYEGRWLDPQSLMIRESLTHWVASAITGSVTLKLRRGWDYSILDTTGPNFSYHSEKLSMERVEGAAFGPTDRIGQLTMRNLDIADTREKLELYSAQGQLASHADLVGQLETGGASAIASNGDDDDDSQKTLDAAAMEVGVN

SEQ ID NO: 5249 - DNA, 1437 bp, Leifsonia xyli subsp. xyli str. CTCB07
  CDS (1)..(1437): transl_table=11
gtgtccaaagtcttgagcagtcttccggtcggtgagcgagtcggcatcgcgttctcgggaggtctcgacacctcctgcgcggtcgcctggatgcgcgagaagggcgccgtgccctgcgcctacacggcagacatcggccagtacgacgagccgaacatcgaggaggtccccggtcgcgccaccgagtacggcgcggagatcgcccggctcgtggacgccaagcgcgcactcgtggaggagggcctgatcgcgttgcagtgcggcgccttccacatccgttccggcgggaagacctacttcaacaccaccccgctcggccgggcggtcaccggcgtcatgctggtgcgcgcgatgagggacgacgatgtcgagatctggggcgacggctccacctacaagggcaacgacatcgagcgcttctaccgctacggcctcatcgccaacccgcgcctgcgcatctacaagccgtggctcgacaccgcgttcgtggaggagctcggcggccgcacggagataagcgaatggctcgtcgcgcgcggcttcccctaccgcgacgcgaccgagaaggcatactcgaccgacgcgaacatctggggcgcgacgcacgaggcgaagcgtctggaggagctggacgcgggcctggacatcgtggagccgatcatgggcgtcgccgcctggcgcgaggatatcgaggtcgcccccgagacggtgagcgtgtccttcgagtacggtcgcccggtcgccctcaacgggatcgagttcgccgacccggtcgccctggtgccggaagcgaacgctatcggcggacgccacggcctcggcgcgtccgaccagatcgagaaccgcatcatcgaggcgaagagccgcggcatctacgaagcgccgggcatggctctgctgcacatcgcctacgagcgactcctcaacgccatccacaacgaggataccgtcgccaactaccacaccgaaggccggcgcctcggccgcctgatgtacgagggccgctggctcgatccgcagtcgctcatgctccgcgagtccctgcaacgctgggtcggctccgccatcaccggcgaagtcaccctgcgcctgcgccgcggcgacgactacacgatcctcgacaccaccggcccggcgctcagctaccacccggacaagctctcgatggagcgggtgggcaacgccgccttcggcccggccgaccgcatcggccagctgacgatgcgcaatctcgacatcgcggactcgcgctcgcgtctcgaacagtacgcggccaccggcctcatcggcggcccgaccgccgagctggtgggcgagctacaggagggcagcgcccgcagcatcctggagctggacgtctcccccgaagatgacgccctctcgcgcgagatcgacgcttcctccgagggagccgccttcgacgccgggaccgactga

SEQ ID NO: 5250 - protein, 478 aa, Leifsonia xyli subsp. xyli str. CTCB07
MSKVLSSLPVGERVGIAFSGGLDTSCAVAWMREKGAVPCAYTADIGQYDEPNIEEVPGRATEYGAEIARLVDAKRALVEEGLIALQCGAFHIRSGGKTYFNTTPLGRAVTGVMLVRAMRDDDVEIWGDGSTYKGNDIERFYRYGLIANPRLRIYKPWLDTAFVEELGGRTEISEWLVARGFPYRDATEKAYSTDANIWGATHEAKRLEELDAGLDIVEPIMGVAAWREDIEVAPETVSVSFEYGRPVALNGIEFADPVALVPEANAIGGRHGLGASDQIENRIIEAKSRGIYEAPGMALLHIAYERLLNAIHNEDTVANYHTEGRRLGRLMYEGRWLDPQSLMLRESLQRWVGSAITGEVTLRLRRGDDYTILDTTGPALSYHPDKLSMERVGNAAFGPADRIGQLTMRNLDIADSRSRLEQYAATGLIGGPTAELVGELQEGSARSILELDVSPEDDALSREIDASSEGAAFDAGTD

SEQ ID NO: 5251 - DNA, 1335 bp, Mannheimia succiniciproducens MBEL55E
  CDS (1)..(1335): transl_table=11
atgtcaaacacaattctacaaaacctacctctaggtcaaaaagtggggatcgcattctccggcggtttggatacctctgcagccttattatggatgcgtcaaaaaggtgcggtgccttatgcttatacggctaacttaggccaaccggacgaagacgattataatgccattcctaaaaaagccatggcttacggtgcggaaaacgcccgtttaatcgattgccgtaaacaattggcgcaagaaggtatcgcggccatccaatgcggtgcattccatatttcaaccggcggcgttacttattttaatacaaccccgcttggccgtgccgtaaccggtaccatgctggttgccgccatgaaagaagatgacgtaaatatctggggtgacggttcaacattcaaaggtaacgatatcgagcgtttctatcgttacggtttattgaccaacccgaatcttaaaatctacaaaccttggttagacgatcaatttattgatgaattgggcggccgtttcgaaatgtcgcaattcttaattgccaacggttttgattacaaaatgtcggtggaaaaagcctattcgacagactccaatatgttgggtgcaacacacgaagcgaaagacttggaagatttaagcaccggcattaaaatcgtcaaacctattatgggcgttgcgttctgggacgaaagcgttgaaatcaaacctgaagtggttaccgttcgtttcgaagaaggcgtgccggtagaattaaacggtaaacgttttgacgatgtggtcgagttgtttatggaagccaaccgaatcggcggtcgtcacggtttaggaatgtcagaccaaattgaaaaccgtattatcgaagcaaaatcccgcggtatctatgaagcgccgggaatggcattgttccatatcgcttacgaacgtttggttaccggtattcacaacgaagataccatcgaacaataccgtatcaacggtttgcgtttaggccgcttattataccaaggacgttggtttgacccgcaagcgttaatgttgcgcgaaagttcgcaacgctgggtagccaaagcgattaccggcgaagtgaaacttgaattgcgccgcggtaacgattattcgattttggataccgtatcgccgaacttaacttacgaagcggaacgtctaagtatggagaaagtggaagatgcgccgtttgacccgatcgatcgtatcggtcagttaactatgcgtaacttagacgttacggatacgcgtaataagctcggtatctattcggaagcaggccttctcaccgccggtaaagatgccgtcgtaccgcaattaggtagtaaatag

SEQ ID NO: 5252 - protein, 444 aa, Mannheimia succiniciproducens MBEL55E
MSNTILQNLPLGQKVGIAFSGGLDTSAALLWMRQKGAVPYAYTANLGQPDEDDYNAIPKKAMAYGAENARLIDCRKQLAQEGIAAIQCGAFHISTGGVTYFNTTPLGRAVTGTMLVAAMKEDDVNIWGDGSTFKGNDIERFYRYGLLTNPNLKIYKPWLDDQFIDELGGRFEMSQFLIANGFDYKMSVEKAYSTDSNMLGATHEAKDLEDLSTGIKIVKPIMGVAFWDESVEIKPEVVTVRFEEGVPVELNGKRFDDVVELFMEANRIGGRHGLGMSDQIENRIIEAKSRGIYEAPGMALFHIAYERLVTGIHNEDTIEQYRINGLRLGRLLYQGRWFDPQALMLRESSQRWVAKAITGEVKLELRRGNDYSILDTVSPNLTYEAERLSMEKVEDAPFDPIDRIGQLTMRNLDVTDTRNKLGIYSEAGLLTAGKDAVVPQLGSK

SEQ ID NO: 5253 - DNA, 1344 bp, Neisseria gonorrhoeae FA 1090
  CDS (1)..(1344): transl_table=11
atgaaccaaaaccatactattttacaaaacctccccgtcggtcagaaagtcggcatcgccttctccggcggtcttgatacctctgccgcgctgttgtggatgaaactcaaaggcgcgctgccttatgcctacactgccaaccttggccagcccgacgaagacgattacaacgccattcccaaaaaagcaatggaatacggtgcggaaaacgcccgcctgatcgactgccgcgcacaactggcacacgaaggcatcgccgccatccaatgcggcgcgttccacgtttccaccggcggcatcgcctatttcaacaccacgcctctgggccgcgccgtgaccggcaccatgctcgtttccgccatgaaagaagacgatgtgaatatctggggcgacggcagcacctacaaaggcaacgacatcgagcgtttctaccgctacggcttgctcaccaatcccgcgctgaaaatctacaaaccctggctcgaccagcaatttatcgacgaactcggcggccgtcacgaaatgagcgaatttctgattgccaacggcttcaactacaaaatgtcggttgaaaaagcctactccaccgattccaatatgctcggcgcgacccacgaagccaaagacttggaatttttgaactcgggcatcaaaatcgttaagcccatcatgggcgttgccttctgggacgaaaacgtcgaaattgaacccgaagaagtcagcgtgcgctttgaagaaggcgtgccggttgcattgaacggcaaagaatacgccgaccccgtcgaactcttcctcgaagccaaccgcatcggcggccgccacggcttgggtatgagcgaccaaatcgaaaaccgcatcatcgaagccaaatcgcgcggcatctacgaagccccgggcatggcattgttccacatcgcctacgaacgcttggttaccggcatccacaacgaagacaccatcgaacaataccgcatcaacggcctgcgcctcggacgtttgctctaccaaggccgctggttcgacagccaagccttgatgttgcgcgaaaccgcccaacgctgggtcgccaaagccgttaccggcgaagttaccctcgaactgcggcgcggcaacgactactcgattctgaacaccgaatcgcccaacctgacctaccaacccgaacgcctgagtatggaaaaagtcgaaggtgcggcgttcacaccgctcgaccgcatcggacagctcacgatgcgcaacctcgacatcaccgacacccgcgccaaactgggtatttattcgcaaagcggtttgctctcgctgggcgaaggctcggtattgccgcagttgggcaataagcaataa

SEQ ID NO: 5254 - protein, 447 aa, Neisseria gonorrhoeae FA 1090
MNQNHTILQNLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEIEPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEGAAFTPLDRIGQLTMRNLDITDTRAKLGIYSQSGLLSLGEGSVLPQLGNKQ

SEQ ID NO: 5255 - DNA, 1206 bp, Bacteroides fragilis NCTC 9343
  CDS (1)..(1206): transl_table=11
atggaacagaaaaagaaagtagtggttgcattcagcggaggcctcgatacctctttcactgtaatgtacctggccaaggaaaaaggatatgaagtgtatgcagcgtgtgccaacacaggtggcttcagcgaagaacaactgaaacagaatgaagagaatgcctacaaactgggtgctgtgaaatatgtcacactcgacgtcactcaggaatattacgaaaaaagtttgaaatatatgatattcggtaacgtactacgtaacggtacctatcctatttctgtcagctccgaacgtattttccaggcattggccatcgcacgctatgcgaaagagattggtgcggaagccattgcacacggttcgacaggagccggtaacgaccagattcgtttcgacatgacattccttgtcatgactccgggcatagaaattattacgctgacccgcgatatggcactcagccgtcaggaagaaatcgactacttgaacaaaaatggcttcgaagcagactttacaaaactaaaatactcttataatgtcggactatggggtacttcaatctgcggcggagaaattctagacagtgcacaaggattgcccgaaacggcctacctgaagcaagtaacgaaagagggaagtgaacttctgcgccttgaatttaagaatggtgaacttcacgccgtgaatggagaagtgttcgaagataaaattgccgccatccaaaaagtggaagagataggtgctgcttacggtattggccgtgatatgcatgtaggtgatactatcatcggtatcaaaggacgtgtaggattcgaagccgccgctccaatgttgatcatcggtgcacaccgtttccttgagaaatacacattgagcaaatggcaacaatattggaaagatcaggtagctaactggtatggtatgttccttcatgaaagccaatacctggaaccggtgatgcgtgatatcgaagcaatgcttcaagaatcacaacgtaatgtgaacggtacagccatccttgagctccgtccgttgtcattctctactgtcggtgtagaatcacaagacgacctggtaaagaccaagtttggtgaatatggagaaatgcaaaagggttggacggccgaagatgcaaaaggcttcatcaaggtgacttctaccccactacgtgtttactatgctaaccataaggacgaagaggtatga

SEQ ID NO: 5256 - protein, 401 aa, Bacteroides fragilis NCTC 9343
MEQKKKVVVAFSGGLDTSFTVMYLAKEKGYEVYAACANTGGFSEEQLKQNEENAYKLGAVKYVTLDVTQEYYEKSLKYMIFGNVLRNGTYPISVSSERIFQALAIARYAKEIGAEAIAHGSTGAGNDQIRFDMTFLVMTPGIEIITLTRDMALSRQEEIDYLNKNGFEADFTKLKYSYNVGLWGTSICGGEILDSAQGLPETAYLKQVTKEGSELLRLEFKNGELHAVNGEVFEDKIAAIQKVEEIGAAYGIGRDMHVGDTIIGIKGRVGFEAAAPMLIIGAHRFLEKYTLSKWQQYWKDQVANWYGMFLHESQYLEPVMRDIEAMLQESQRNVNGTAILELRPLSFSTVGVESQDDLVKTKFGEYGEMQKGWTAEDAKGFIKVTSTPLRVYYANHKDEEV

SEQ ID NO: 5257 - DNA, 1326 bp, Ralstonia eutropha JMP134
  CDS (1)..(1326): transl_table=11
atgactaccatccttcagcacattcccaccggcgagcgcgtcggcattgcgttctctggcggcctggacaccagcgcggcgcttctctggatgcgccagaagggcgccatcccttacgcctacacggccaatctgggccagcccgacgagcctgactacgacgacatcccgcgccgcgccaaggcctacggcgccgaggaagcccgcctggtggactgccgcacgcagctcgtggccgagggcatcgctgcattgcagtgcggtgcgttccacatttccaccgccggcgtcacgtacttcaacaccaccccgatcggccgcgccgtcactggcaccatgttggttgccgcgatgaaggaagatggcgtcaatatctggggtgatggcagcacgttcaaaggcaatgatatcgagcgtttctaccgctacggcctcctgaccaacccgggcctgcagatctacaagccgtggctggaccagcagttcatcgacgaacttggcggccgcgccgagatgtccgagttcatgcgccagaacggcttcgactacaagatgtcggctgaaaaggcgtactcgacggattcgaacatgctgggcgccacccacgaggccaaggatctggagcacctggattcgggcatccgcatcgtgcagccgatcatgggcgtgcagttctggcgtgacgaagtcgaagtcaagcgcgaggaagtcaccgtgcgcttcgagcagggccagcccgttgcgctgaacggcaagaccttcgccaacagcgtcgagctgttcgccgaagccaacgtcatcggcggccgccatggcctgggcatgagcgaccagatcgagaaccgtatcatcgaagccaagagccgcggcatctacgaagccccgggcctggcactgctgttcatcgcgtacgagcgcctgattaccggcatccataacgaagacaccatcgagcagtaccgcgacaacggccgccgccttggccgccttctgtaccagggccgctggttcgacccgcaagccatcatgctgcgcgaaaccgcccagcgctgggtggcgggtgccgtgaccggcgaagtgaccattgaactgcgccgcggcaatgattactcgatcctgaacaccacctcgccgaacctgacctacaagccggaacggctgaccatggagaagggcgagtcgatgttcacgccgctggaccgtattggccagctgaccatgcgtacgctggatatcgtggatactcgcgagaagctgcagacgtatgcgaagacggggctgctgtcgtcggcggttagtgcttcgttgccgaagctggaagactga

SEQ ID NO: 5258 - protein, 441 aa, Ralstonia eutropha JMP134
MTTILQHIPTGERVGIAFSGGLDTSAALLWMRQKGAIPYAYTANLGQPDEPDYDDIPRRAKAYGAEEARLVDCRTQLVAEGIAALQCGAFHISTAGVTYFNTTPIGRAVTGTMLVAAMKEDGVNIWGDGSTFKGNDIERFYRYGLLTNPGLQIYKPWLDQQFIDELGGRAEMSEFMRQNGFDYKMSAEKAYSTDSNMLGATHEAKDLEHLDSGIRIVQPIMGVQFWRDEVEVKREEVTVRFEQGQPVALNGKTFANSVELFAEANVIGGRHGLGMSDQIENRIIEAKSRGIYEAPGLALLFIAYERLITGIHNEDTIEQYRDNGRRLGRLLYQGRWFDPQAIMLRETAQRWVAGAVTGEVTIELRRGNDYSILNTTSPNLTYKPERLTMEKGESMFTPLDRIGQLTMRTLDIVDTREKLQTYAKTGLLSSAVSASLPKLED

SEQ ID NO: 5259 - DNA, 1371 bp, Thiobacillus denitrificans ATCC 25259
  CDS (1)..(1371): transl_table=11
atggccgcgtcgtcggcatcgaaatcgaaaaggcgagccaggccgccaatctcgacattctcaagatcggcggcttcccgggccagatcgagatcatcgacacgaacacttccggctccacccattaatccagcgactcccatgagcgacatcaagaaagttgtactggcctattccggcggcctcgacacctcggtcatcctgaaatggctgcaggacacctaccaatgcgaggtggtgaccttcaccgccgacctcggccagggcgaggaactcgaaccggcgcggcagaaggcactgcagttcggcatcaaacctgaacagatctacatcgacgacctgcgcgaggaattcgtgcgcgacttcgtcttcccgatgttccgcgcgaataccgtgtacgaaggcgaatatctgctcggcacgtcgatcgcgcggccgctgatcgccaagcggctgatcgagatcgtcaacgcaaccggcgccgacgcgatctgtcacggcgccaccggtaagggcaacgaccaggtgcgcttcgaactcggcgcctacgcgctgaaacccgacgtcaaggtcatcgcgccgtggcgcgagtgggacctgctctcgcgcgagaagctgctcgcctacgcagaatcccatggcattccgatcgacatgaagcatcgccagggcggctcgccttattcgatggacgcgaacctgctgcatatttcctacgaaggccgccacctcgaggaccccagcgccgaagccgaagaagacatgtggcgctggaccgtgtcgcccgagaaggcgcccgacgcggccgaatacatcgaactgacctacgcgaaaggtgatgtcgtcgcgatcgacggccagcaaatgcctgcccacgaagtgctcgccaagctcaacgaactgggcggcaagcacggcatcggccggctcgacctcgtcgagaaccgctacgtcggcatgaagtcgcggggctgctacgaaacgcccggcggcaccatcctgctgaaggcgcaccgtgcgatcgagtcgatcacgctcgatcgcgaggtcgcgcatctgaaggacgacctgatgccgcgctacgccagcctgatctacaacggctactggtgggcgcccgagcggcgcgcgctgcaggtgctgatcgaccacacgcaggcgcacgtcaacggcacggtgcggctcaagctctacaagggcaacgtcatcgtcgtcggccgcgattcgaagaacgattcgctgttcgactcgaccatcgcaaccttcgaggacgacgcgggcgcctacgatcagaaggacgccggcggtttcatcaagctcaacgcgctgcgcatgcgcatcgccgcaaaactcgacgcacggagaaaataa

SEQ ID NO: 5260 - protein, 456 aa, Thiobacillus denitrificans ATCC 25259
MAASSASKSKRRARPPISTFSRSAASRARSRSSTRTLPAPPINPATPMSDIKKVVLAYSGGLDTSVILKWLQDTYQCEVVTFTADLGQGEELEPARQKALQFGIKPEQIYIDDLREEFVRDFVFPMFRANTVYEGEYLLGTSIARPLIAKRLIEIVNATGADAICHGATGKGNDQVRFELGAYALKPDVKVIAPWREWDLLSREKLLAYAESHGIPIDMKHRQGGSPYSMDANLLHISYEGRHLEDPSAEAEEDMWRWTVSPEKAPDAAEYIELTYAKGDVVAIDGQQMPAHEVLAKLNELGGKHGIGRLDLVENRYVGMKSRGCYETPGGTILLKAHRAIESITLDREVAHLKDDLMPRYASLIYNGYWWAPERRALQVLIDHTQAHVNGTVRLKLYKGNVIVVGRDSKNDSLFDSTIATFEDDAGAYDQKDAGGFIKLNALRMRIAAKLDARRK

SEQ ID NO: 5261 - DNA, 1335 bp, Burkholderia sp. 383
  CDS (1)..(1335): transl_table=11
atgagcacgattctcgaaagcctcccgaccggccagaaggtcggtatcgccttctccggcggcctggacaccagcgcagcgctgcactggatgaaactcaagggcgccgtcccgtacgcatacacggcgaacctcggccagcccgacgaagacgattacgacgcgatcccgaaacgcgcgatcgaatacggcgcagccggcgcccgcctgatcgactgccgcgcgcagctcgtcgccgaaggcatcgccgcgctgcaaagcggcgcgttccacatcacgacggcaggcgtcacgtacttcaacaccacgccgatcggccgcgccgtgacgggcacgatgctcgtcgccgcgatgaaggaagacggcgtcaacatctggggcgacggcagcacgtacaagggcaacgacatcgagcgcttctaccgctacggcctgctcgtgaacccggatctgaagatctacaagccgtggctcgaccagacgttcatcgacgagctcggcggccgtgccgaaatgtccgaattcatgaaccaggctggtttcgcgtacaagatgtcggccgagaaggcctactcgaccgattcgaacctgctcggcgcgacgcacgaagcgaaggatctcgaaagcctcgaaagcggcatcaagatcgtgaacccgatcatgggcgtcgcgttctggcgcgacgacgtgaagatcgccgcggaagaagtgacggtgcgcttcgaagccggccagccggtcgcactgaacggcgtcgagttctccgacccggtcgaactgctgctggaagcgaaccgcatcggcggccgccacggcctcggcatgagcgaccagatcgagaaccggatcatcgaggcgaagagccgcggcatctatgaagccccgggcctcgcgctgctgtacatcgcgtacgagcgtctcgtcaccggcatccacaacgaagacacgatcgagcagtaccgcgagaacggccgccgcctcggccgcctgctgtatcagggccgctggttcgacccgcaagcgatcatgctgcgtgaaaccgcgcaacgctgggtcgcacgcgcgatcaccggcgaagtgaagatcgaactgcgccgcggcaacgactactcgatcctgagcacgaagtcgccgaacctcacgtaccagccggaacgcctgtcgatggagaaggtggcgtcgacgttctcgccgcgcgaccggatcggccagctgacgatgcgcaacctcgacatcaccgatacgcgcgacaagctgcgcgtgtactcgcaagtcggcctgctgacgccgggtgagacgtcggcgctgccgcagatcaagggcgacgacaagtaa

SEQ ID NO: 5262 - protein, 444 aa, Burkholderia sp. 383
MSTILESLPTGQKVGIAFSGGLDTSAALHWMKLKGAVPYAYTANLGQPDEDDYDAIPKRAIEYGAAGARLIDCRAQLVAEGIAALQSGAFHITTAGVTYFNTTPIGRAVTGTMLVAAMKEDGVNIWGDGSTYKGNDIERFYRYGLLVNPDLKIYKPWLDQTFIDELGGRAEMSEFMNQAGFAYKMSAEKAYSTDSNLLGATHEAKDLESLESGIKIVNPIMGVAFWRDDVKIAAEEVTVRFEAGQPVALNGVEFSDPVELLLEANRIGGRHGLGMSDQIENRIIEAKSRGIYEAPGLALLYIAYERLVTGIHNEDTIEQYRENGRRLGRLLYQGRWFDPQAIMLRETAQRWVARAITGEVKIELRRGNDYSILSTKSPNLTYQPERLSMEKVASTFSPRDRIGQLTMRNLDITDTRDKLRVYSQVGLLTPGETSALPQIKGDDK

SEQ ID NO: 5263 - DNA, 1260 bp, Rhodospirillum rubrum ATCC 11170
  CDS (1)..(1260): transl_table=11
ttgggttccggctgcattcctcccatggtcaagaaggcgctttccatgaagaaaggtgacgtgaagaaggttgttctcgcctattccggcggtttggacacctcgatcatcttgcgttggctgcaagacgaatacgactgcgaggtggtgaccttcaccgccgatatcggtcagggcgaggaactggagccggcgcgccagaaggccgagatgatggggatcaaggagatctacatcgaggacctgcgcgaggaattcgtccgcgactacgttttcccgatgttccgcgccaataccctttatgaaggcgtctatctgctgggcacctcgatcgcccggccgctgatcggcaagcgtctggtcgagatcgccgaggcgaccggcgccgacgccgtcagccacggcgcgaccggcaagggcaacgatcaggtgcggttcgagctgaccgcctatgcgctcaagcccgacatcaagatcatcgcgccttggcgcacctgggatctgcacagccgcaccaagctgatcgaatacgccatgcgccaccagatccccgtgcccaaggacaagcacggcgaggcgccctattcgatggacgccaatcttctgcacatctcctatgaaggcaaggccctggagaacccctggaccgagcccagcgaggacatgttccgcctgacggtcagcccggaagccgcccccgacaaggcccagtacatcgaggtcgatttcgagcgcggcgatgccgtggccatcgatggcgaaaagctgaccccggccgccctgctcgccaagctcaacgagatcggcggccgccatggcgtgggccgtctggatctggtcgaaaaccgctatgtcggcatgaagtcgcgcggcgtttatgaaaccccgggcggcaccatcttgcaggtcgcccaccgcgccgtggaaagcctgacccttgatcgcgaggtcatgcacctgcgcgacgagctgatgccgcgctatgccaagctgatctacaacggcttctggttcgcccccgagcgcctgatgctgcaggccgccatcgatcagacccagcagacggtgaccggcaccgcccgcctgaagctctacaagggcaatgtcagcgtcgtcggccgcaaggcggcgaaaagcctctatcgcatggactatgtcaccttcgaggaagacaccgtctatgaccagcacgacgccgaaggcttcatcaaactgaacgccctgcgtctgcgtctgggcaagatggcccgcgacagctga

SEQ ID NO: 5264 - protein, 419 aa, Rhodospirillum rubrum ATCC 11170
MGSGCIPPMVKKALSMKKGDVKKVVLAYSGGLDTSIILRWLQDEYDCEVVTFTADIGQGEELEPARQKAEMMGIKEIYIEDLREEFVRDYVFPMFRANTLYEGVYLLGTSIARPLIGKRLVEIAEATGADAVSHGATGKGNDQVRFELTAYALKPDIKIIAPWRTWDLHSRTKLIEYAMRHQIPVPKDKHGEAPYSMDANLLHISYEGKALENPWTEPSEDMFRLTVSPEAAPDKAQYIEVDFERGDAVAIDGEKLTPAALLAKLNEIGGRHGVGRLDLVENRYVGMKSRGVYETPGGTILQVAHRAVESLTLDREVMHLRDELMPRYAKLIYNGFWFAPERLMLQAAIDQTQQTVTGTARLKLYKGNVSVVGRKAAKSLYRMDYVTFEEDTVYDQHDAEGFIKLNALRLRLGKMARDS

SEQ ID NO: 5265 - DNA, 1341 bp, Burkholderia thailandensis E264
  CDS (1)..(1341): transl_table=11
atgaccacgattcttgaaaatctcccggccggccagaaagtcggcatcgcgttctccggcgggctcgacacgagcgccgcgctgcactggatgcgcatcaagggggccgttccttacgcgtacacggccaatctcggccagcccgacgaagacgactacgatgcgatcccgaagcgcgcgatccagtacggcgccgagggcgcacgcctgattgactgccgcgcgcagctcgtggccgaagggatcgcggcgctccagtgcggcgcgttccacatctcgacggccggcgtcacgtatttcaatacgaccccgattggccgcgccgtgacgggcacgatgctcgtcgccgcgatgaaggaggacggcgtcaacatctggggcgacggcagcacgtacaagggcaacgacatcgagcgcttctaccgctacggcctgctcgtcaatccggatctgaagatctacaagccgtggctcgatcagcagttcatcgacgagctgggcggccgcgcggaaatgtccgaattcatgcgccaggccggcttcgagtacaagatgtcggcggagaaggcgtattcgaccgattcgaacctgctgggcgcgacgcacgaggcgaaggatctcgagagcctcgagagcggcatcaagatcgtcaatccgatcatgggcgtcgcgttctggcgcgacgacgtgaagatcgacaaggaagcggtgacggtccgcttcgaagagggccgccccgtcgcgctgaacggcgtcgagtacaaggatgcggtcgagctgctgctcgaggcgaaccggatcggcggccgccacggcctcgggatgagcgaccagatcgagaaccggatcatcgaggcgaagagccgcggcatctatgaagccccggggcttgcactgctgtacatcgcgtacgagcgcctcgtcaccggcatccacaacgaagacacgatcgagcagtaccgcgagaacggccgccgcctcggccgcctgctgtaccagggccgctggttcgatccgcaggcgatcatgctgcgcgagaccgcgcagcgctgggtcgcgcgcgcggtcacgggcgaggtgacggtcgagctgcgccgcggcaacgactattcgattctcgccacgcgctcgccgaacctgacgtaccagccggagcgcctgtcgatggagaaggtgcagtcgacgttctcgccgcgcgaccggatcggccagttgacgatgcgcaacctcgacatcaccgacacccgcgacaagctgcgcatctactcggaagtcggcctgctcacgccgggcgaatcgtcggcgctgccgaagctgaaggaagacgagagcggcaactga

SEQ ID NO: 5266 - protein, 446 aa, Burkholderia thailandensis E264
MTTILENLPAGQKVGIAFSGGLDTSAALHWMRIKGAVPYAYTANLGQPDEDDYDAIPKRAIQYGAEGARLIDCRAQLVAEGIAALQCGAFHISTAGVTYFNTTPIGRAVTGTMLVAAMKEDGVNIWGDGSTYKGNDIERFYRYGLLVNPDLKIYKPWLDQQFIDELGGRAEMSEFMRQAGFEYKMSAEKAYSTDSNLLGATHEAKDLESLESGIKIVNPIMGVAFWRDDVKIDKEAVTVRFEEGRPVALNGVEYKDAVELLLEANRIGGRHGLGMSDQIENRIIEAKSRGIYEAPGLALLYIAYERLVTGIHNEDTIEQYRENGRRLGRLLYQGRWFDPQAIMLRETAQRWVARAVTGEVTVELRRGNDYSILATRSPNLTYQPERLSMEKVQSTFSPRDRIGQLTMRNLDITDTRDKLRIYSEVGLLTPGESSALPKLKEDESGN

SEQ ID NO: 5267 - DNA, 1326 bp, Ralstonia metallidurans CH34
  CDS (1)..(1326): transl_table=11
atgactaccatcctgcagcacattccttccggccagcgcgtcggaatcgccttctcgggcggactcgataccagcgccgcgctcctctggatgcgccagaagggcgccattccctacgcctacacggcgaacctgggccagcccgacgaaccggattacgacgacatcccccgccgcgccatggcgtacggcgccgaggccgcccgtctggtggattgccgcacccaactggtggccgaaggtatcgccgcgctgcaatgcggcgcgttccatatctcgaccgccggcgtgacctacttcaacacgaccccgatcggccgtgccgtgaccggcacgatgctggtggcggccatgaaggaagacggcgtcaacatctggggcgacggcagcacgttcaagggcaacgacatcgagcgcttctaccgctacggcctgctgaccaacccgggtctgcagatctacaagccgtggctggaccagcagttcatcgacgaactgggtggccgcgccgaaatgtccgagttcatgcgccagcacggccatgcctacaagatgtcggcggaaaaggcgtactcgaccgattcgaacatgctcggcgccacgcacgaggccaaggatctggagcacctggattccggcatccgcatcgtccagccgatcatgggcgtgcagttctggcgcgatgacgtcgaagtgaagcgcgaggaagtgaccgtgcgcttcgaggaaggccagccggtggcgctgaatggcaagacgttcgccaatgccgtcgacctgctcatggaagccaatgtcatcggtggccgtcatggcctgggcatgagcgaccagatcgagaaccgcatcatcgaagccaagagccgcggcatctacgaagccccgggcctggcgctgctgttcatcgcttacgagcgcctgatcaccggtatccacaacgaagacaccatcgagcagtaccgcgacaacggccgccgtctgggccgcctgctgtaccagggccgctggttcgatccgcaagccatcatgctgcgcgaaaccgcccagcgctgggtggctggcgccgtgaccggcgaggtgacgatcgaactgcgtcgcggtaacgactactcgatcctgaacacgacgtcgccgaacctgacgtacaagcccgagcgcctgacgatggaaaagggcgagtcgatgttcacgccgctggaccgtattggccaactcacgatgcgtacgctcgacatcgtcgacacgcgcgagaagctgcagacgtacgccaagtccggcctgctgtcgaaccagaccagcgcggcgctgccaaagctcgaagactga

SEQ ID NO: 5268 - protein, 441 aa, Ralstonia metallidurans CH34
MTTILQHIPSGQRVGIAFSGGLDTSAALLWMRQKGAIPYAYTANLGQPDEPDYDDIPRRAMAYGAEAARLVDCRTQLVAEGIAALQCGAFHISTAGVTYFNTTPIGRAVTGTMLVAAMKEDGVNIWGDGSTFKGNDIERFYRYGLLTNPGLQIYKPWLDQQFIDELGGRAEMSEFMRQHGHAYKMSAEKAYSTDSNMLGATHEAKDLEHLDSGIRIVQPIMGVQFWRDDVEVKREEVTVRFEEGQPVALNGKTFANAVDLLMEANVIGGRHGLGMSDQIENRIIEAKSRGIYEAPGLALLFIAYERLITGIHNEDTIEQYRDNGRRLGRLLYQGRWFDPQAIMLRETAQRWVAGAVTGEVTIELRRGNDYSILNTTSPNLTYKPERLTMEKGESMFTPLDRIGQLTMRTLDIVDTREKLQTYAKSGLLSNQTSAALPKLED

SEQ ID NO: 5269 - DNA, 1191 bp, Myxococcus xanthus DK 1622
  CDS (1)..(1191): transl_table=11
atgagcaacaagaagaacgtggtgctggccttctccggcggactcgataccgctttctgtgccgtctacctgcgagagcagggctacgacgtcaccaccgtcacggtggacaccggcggcttcccgcccgagcagttggagcgcatcgccgcgctgtccaagcagttgggcgcggtggagcacgtgacggtggacgcgcgcgagacgctcttccagggctacctgcgctacctcatcgcgggcaacgtgctgcgcggccaggtctaccccctgagcgtgtccgcggagcgcgcgtgccaggcggcggaggtcgtccgcgtggcgcgcgagaagggcacccaggcgctggcgcacggcagcacgggcgcgggaaatgaccaggtgcgcttcgacgtggccttccgctcgctggcgccggagctggagctgctcacgcccatccgcacgctgtccctgagccggcagcaggagctgacctacctggccgagcgcggcgtccacatgccgccgaagctgggctcctactccgtcaacgagggcatgtggggcacctccgtgggcggcgccgagacgctggactcctggaaggcgctgcccgaggcggccttccccggcggcgagctgtcgcaggacctcaagccccgtcccctcacggtgtccttcgagaagggcgtcccggtggcgctggacggcgagaagctgggccccgtgaagctggtggaggcgctcaacgcgctggggcgcacctacggcatcggccggggcgtgcacctgggtgacacgattctgggcatcaagggccgcgtgggcttcgaggcgccggcggcgcacctgctcgtcaccgcgcaccgcgagctggagaagctggtgctctccggcaagcagctcttctggaaggagtcgatgggcaacctctacggctcgctgctgcacgaggggcacttcttcgacccgctggtgaaggacctggaggcgttcctcacctcgtcgcaggagcgcgtgacgggtgacgtgcggctggtgctgcacccgcgcacgcaggtggtggaaggcgtgcgttcgccgcactcgctgatggacgcgaaggtggcgacgtacggagaggccaacgtgttgtggaacggctcggaagccgcgggcttcgccaagctgtacggcgtcgcgcagatgctctcgcatcgcgcgaagtga

SEQ ID NO: 5270 - protein, 396 aa, Myxococcus xanthus DK 1622
MSNKKNVVLAFSGGLDTAFCAVYLREQGYDVTTVTVDTGGFPPEQLERIAALSKQLGAVEHVTVDARETLFQGYLRYLIAGNVLRGQVYPLSVSAERACQAAEVVRVAREKGTQALAHGSTGAGNDQVRFDVAFRSLAPELELLTPIRTLSLSRQQELTYLAERGVHMPPKLGSYSVNEGMWGTSVGGAETLDSWKALPEAAFPGGELSQDLKPRPLTVSFEKGVPVALDGEKLGPVKLVEALNALGRTYGIGRGVHLGDTILGIKGRVGFEAPAAHLLVTAHRELEKLVLSGKQLFWKESMGNLYGSLLHEGHFFDPLVKDLEAFLTSSQERVTGDVRLVLHPRTQVVEGVRSPHSLMDAKVATYGEANVLWNGSEAAGFAKLYGVAQMLSHRAK

SEQ ID NO: 5271 - DNA, 1260 bp, Mesorhizobium sp. BNC1
  CDS (1)..(1260): transl_table=11
atgcccgcgacacgaactcactcggaaaagacgatggcgacacataaagatgttaagaaggtcgtgctggcctattccggcggcctcgacacctcgatcatcctgaaatggctgcagacggaactcggcgccgaggtggtgaccttcaccgccgaccttggccagggcgaggagcttgagcccgctcgccgtaaggccgagatgctgggtatcaaggagatccacatcgaggatctgcgcgaggaattcgtccgcgatttcgtcttcccgatgttccgcgcaaatgcgctttacgaaggcacttatctgctcggcacttccattgcacggccgctgatcgccaagcgccttgtcgaaatcgccgccgaaacgggggcagacgccatcgctcacggcgcgacgggcaagggcaacgaccaggtccgcttcgaactcaccgcctatgcgctgaaccccgacatcaaggtgatcgctccgtggcgtgactggacgttcaagtcccgcacggaccttctgaacttcgcgcgcgaccatcagattccagtgcccagcgacaagcagggtgaggcgcccttctccgtcgacgccaatcttctgcactcttcctccgaggggaaagtgctggaagatccatggagcgagcccccggaatatgtccaccagcgcacggtttcgcccttcgatgcgccggaccgggcaacggagatcacgatcggcttcaagcgcggcgacgccgtgtcgctcaacggcgaggcggtgtcccccgccacgttgttggccaagctgaacgatcttggccgcgacaatggcatcggccgcatcgacctggttgaaaaccgctttgtcggcatgaaatcccgcggcgtctatgaaacgccaggaggcacgatccttcttgccgcccatcgcgcaatcgaatcgatcacgctcgaccggggcgccgcgcaccttaaggatgagctcatgccacgctatgccgagctcatttataacgggttctggtactcgcccgagcgtgagatgctccaggcgctcatcgacaagagccaggaggatgtcgagggcgaagtgcggctgaagctctataagggcaacgtcatcgtcacgggccgtcgttcggacaagtctctttattcggatgcgctcgtcactttcgaggatgatcgcggcgcctatgatcaaaaggatgcggcagggttcatccgcctcaatgcgctaagattgaggacgctcgcggcgcgcaagcggcttcaaggctga

SEQ ID NO: 5272 - protein, 419 aa, Mesorhizobium sp. BNC1
MPATRTHSEKTMATHKDVKKVVLAYSGGLDTSIILKWLQTELGAEVVTFTADLGQGEELEPARRKAEMLGIKEIHIEDLREEFVRDFVFPMFRANALYEGTYLLGTSIARPLIAKRLVEIAAETGADAIAHGATGKGNDQVRFELTAYALNPDIKVIAPWRDWTFKSRTDLLNFARDHQIPVPSDKQGEAPFSVDANLLHSSSEGKVLEDPWSEPPEYVHQRTVSPFDAPDRATEITIGFKRGDAVSLNGEAVSPATLLAKLNDLGRDNGIGRIDLVENRFVGMKSRGVYETPGGTILLAAHRAIESITLDRGAAHLKDELMPRYAELIYNGFWYSPEREMLQALIDKSQEDVEGEVRLKLYKGNVIVTGRRSDKSLYSDALVTFEDDRGAYDQKDAAGFIRLNALRLRTLAARKRLQG

SEQ ID NO: 5273 - DNA, 1335 bp, Haemophilus somnus 129PT
  CDS (1)..(1335): transl_table=11
atgtcaaatacaattttacaacatcttccaattggtcaaaaagtaggcattgctttttccggtggtttggataccagtgcagcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgttgaaaaagcttactcgacggattccaatatgttaggtgctactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctaggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagctcgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccgcaattggataaaaaatag

SEQ ID NO: 5274 - protein, 444 aa, Haemophilus somnus 129PT
MSNTILQHLPIGQKVGIAFSGGLDTSAALLWMRQKGAVPYAYTANLGQPDEEDYNAIPRKAMEYGAEKARLIDCRNQLAHEGIAAIQCGAFHISTGGVTYFNTTPLGRAVTGTMLVSAMKEDDVNIWGDGSTFKGNDIERFYRYGLLTNPSLRIYKPWLDNQFIDELGGRQEMSEFLIANGFDYKMSVEKAYSTDSNMLGATHEAKDLEYLNSGIRIVKPIMGVAFWRDDVTVKAEEVTVGFEDGVPVTLNGQSFSSAVELFLEANRIGGRHGLGMSDQIENRIIEAKSRGIYEAPGMALLHIAYERLVTAIHNEDTIEQYRINGLRLGRLLYQGRWFDPQALMLRETAQRWVARAVTGEVTLELRRGNDYSILNTVSPNMTYHPERLSMEKVENAPFDPSDRIGQLTMRNLDITDTRDKLGIYTHTGLLTVGKDSMLPQLDKK

SEQ ID NO: 5275 - DNA, 1221 bp, Oenococcus oeni PSU-1
  CDS (1)..(1221): transl_table=11
atggcagataaaattgttttagcttattcaggtggtctggacacgtccgtagcgatcccttggttaaaagataaaggatatgaagtaattgcggtctcattggatgttggccagcatggaaagcaaatcgagaatattcaaaaaaaggctttaaagatcggtgcaattcaatcattcataattgatggtaaagacgaattcgctgagaactatgtcagcaaagtaattaaatcaaacgctctctatgaaggagaatacccactcgtttcagctctctctcgaccgctgattatcgaaaaactggttcaaacagctcatgataataatgccgtcgccatagcccatggatcaactggtaaaggaaatgaccaggttcgcttcgaagcagcaattcacgcccttgatccggaaatgaaaattgaagctccaatccgtgatttccaatggtctcgtgaagaagaaatcgaatatgctcatcaacataatgttccggtaccgattaattttgattctccctattcaattgacgaaaatttatggggacgttccaacgaggccggaattctggaaaatccctggaatcaggctccggcggatgcctatgccttgacatcgccggttgaagatacacctgatgaagccgattttgttgatattgaatttaaaaatggtttaccaatttcagtaaatgatcaagaaatgaaaatggccgatctaattgtatatttgaataaattggccggaattcacggtattggccgaatcgatcacgtagaaaatcgtctaatcggtattaaatcacgcgaaatttatgaaacaccggcagcagccgtcatcatgaccgcccataaagatctagaggatatcactttagaacacgatgttgcccactttaaaccgattatcgagcaaaaaatcaccaacttaatttacaacgcaatgtggatttctccccttttcgatgctctgaataaatttatcgacgaaacgcaaaaagttgtcaacggtaccgttaaaatgaaactttataaaggcacagcgacagccgttgccagaaaatcagaaaataattcactctactctgaaaaactggcaacttatacttcggcaaattctttcgatgaacaagcagcagttggatttatgaaactttatactctgccagcaaccgtatatgagcaggtaaaccatatccattcaaaggaaaaagaagaaatctaa

SEQ ID NO: 5276 - protein, 406 aa, Oenococcus oeni PSU-1
MADKIVLAYSGGLDTSVAIPWLKDKGYEVIAVSLDVGQHGKQIENIQKKALKIGAIQSFIIDGKDEFAENYVSKVIKSNALYEGEYPLVSALSRPLIIEKLVQTAHDNNAVAIAHGSTGKGNDQVRFEAAIHALDPEMKIEAPIRDFQWSREEEIEYAHQHNVPVPINFDSPYSIDENLWGRSNEAGILENPWNQAPADAYALTSPVEDTPDEADFVDIEFKNGLPISVNDQEMKMADLIVYLNKLAGIHGIGRIDHVENRLIGIKSREIYETPAAAVIMTAHKDLEDITLEHDVAHFKPIIEQKITNLIYNAMWISPLFDALNKFIDETQKVVNGTVKMKLYKGTATAVARKSENNSLYSEKLATYTSANSFDEQAAVGFMKLYTLPATVYEQVNHIHSKEKEEI

SEQ ID NO: 5277 - DNA, 1227 bp, Leuconostoc mesenteroides subsp. mesenteroides ATCC 8293
  CDS (1)..(1227): transl_table=11
atgacagacacattagtattagcatactccggcggtttagatacttcagtagccattccttggttaaaggataaagggtacgatgttatcgcagttgttttggacgttgggcaacatggcaagaatttaaatgaaattcaagcaaaagccttaaaagttggtgccaaacaatcaatcgttatcgatgcaaaagctgaatttgcagataaatatgttgcaccagttattaaagctaacatgatgtatgaaggcgaatatccaatggtatcagccttgtctcgtccattaatcatcaaaaagttagttgatatcgcacatgaaaatgatgccgttgcgattgcgcatggctcaacgggtcatggtaacgatcaagtacgtttcgaggccgcaattcatgcattggaccctgacatgaagattgaagcacccattcgtgatttccagtggtcacgtgaagaagagattcaatatgcacaagaacatgatgttccggtacctattgatttagattcaccatactcaatcgatgagaacttatggggacgtgccaatgaagctggtatcttagaaaacccatggaaccaagcgccagaagatgcatttgcattaacaactgccattgaagatgcaccagatacaccagaatttatcgatgttactttcgaagctggtgtgccagttgcgcttaatggtgaagtattgtcattagaaaagctcattgtggcggttaatgagattgctggaaagcatggtattggccgtatcgatcatattgaaaatcgtttggttggcattaagtcacgtgagatttatgaagcaccagctgcagctgtactgatgacagcacataaggatttggaagatttaacactagagcgtgatgttgctcatttcaagccaattgtggaacaacagttagctaatttggtttatgaagcgaagtgggtatcaccattgtttgatagtttaatggcatttattgatagcacacaacaaaatgtcaatggtgtggttaagatgaagttgtttaaggggaatgccactgcggttgcccgtcaatctgaacacaactcactatacgatgaagatttggcaacatatacatcatcatcatcatttgaccaagcatctgcggtaggctttatcaaattgtggacactaagtaatacggtttatgaacaagtcaaccatgtccattcacaagcgaaaaagaacacagtgaaataa

SEQ ID NO: 5278 - protein, 408 aa, Leuconostoc mesenteroides subsp. mesenteroides ATCC 8293
MTDTLVLAYSGGLDTSVAIPWLKDKGYDVIAVVLDVGQHGKNLNEIQAKALKVGAKQSIVIDAKAEFADKYVAPVIKANMMYEGEYPMVSALSRPLIIKKLVDIAHENDAVAIAHGSTGHGNDQVRFEAAIHALDPDMKIEAPIRDFQWSREEEIQYAQEHDVPVPIDLDSPYSIDENLWGRANEAGILENPWNQAPEDAFALTTAIEDAPDTPEFIDVTFEAGVPVALNGEVLSLEKLIVAVNEIAGKHGIGRIDHIENRLVGIKSREIYEAPAAAVLMTAHKDLEDLTLERDVAHFKPIVEQQLANLVYEAKWVSPLFDSLMAFIDSTQQNVNGVVKMKLFKGNATAVARQSEHNSLYDEDLATYTSSSSFDQASAVGFIKLWTLSNTVYEQVNHVHSQAKKNTVK

SEQ ID NO: 5279 - DNA, 1362 bp, Solibacter usitatus Ellin6076
  CDS (1)..(1362): transl_table=11
atgggaaacattctgcagaacctgcccgccggcgaaaaggtcggtctggccttctccggcggcctcgataccagcgccgcgattcattggatgcgcgctaaaggcgcgatcccgtattcgtacaccgccaatctcggacagcccgacgagccggattacgacgagatcccccgccgcgcgctgctctacggcgccgagaaagcgcggctcatcgattgccgcaagcagcttgtggccgaaggcatcgccgccctgcaatccggcgctttccacatctcgaccgccggagtccactacttcaatacgacacccattggccgcgcggtcacgggcaccatgctggtgatcgcgatgaaggaggacgacgtccacatctggggcgatggcagcaccttcaagggcaacgatatcgagcgtttctaccgctacggcctgctggccaatcccgcgctgcgcatctacaagccgtggcttgaccagaccttcatcgacgaactcggcggccgcaaggaaatgtcggagtacatgatctcgcacgggctcacctataagatgagcgtggagaaggcttactcgaccgattccaacatctggggcgcaactcacgaagccaaggatctcgagcacctcgataagggcgtcaagatcgtggagcccatcatgggcgtcgcctcgtggcgcgaagacgtcgcgattaaacccgaaactgtcactatccgtttcgaagagggccagcccgtggcgctcaaccacgtgacgtatgacgacccggtgcaactcgtgctcgaagccaacgcgatcggcggccgccacggcctcggagtatccgaccagatcgagaatcgcatcatcgaagccaagagccggggcatatacgaagctcccggccttgcgctgcttttcattgcctacgagcgcctggtctccggcattcacaatgaggacacgatcgagcagtaccgcatcaacggccttcgcctggggcgcctgctgtatcagggccgctggttcgattcgcaatccatgatgctgcgggaaaccgcacagcgctgggtcgcgcgcgcgatcacgggcgaggtcacggtcgaactccgccgcggcaacgactactccatcctcgacaccaccagccccaacctcacctacaagcccgagcgcctcacgatggagaaaggcgaatcgactttctctccccaggaccgcatcggccagctcacaatgcgccacctggacatcaccgacacgcgcgacaagctcctgctgtatataaagaccggcctgctcggtccatccagcggcaattcgacgacgctgctccccgagcccgccgacagtgggacagagaagccgccgagccgttga

SEQ ID NO: 5280 - protein, 453 aa, Solibacter usitatus Ellin6076
MGNILQNLPAGEKVGLAFSGGLDTSAAIHWMRAKGAIPYSYTANLGQPDEPDYDEIPRRALLYGAEKARLIDCRKQLVAEGIAALQSGAFHISTAGVHYFNTTPIGRAVTGTMLVIAMKEDDVHIWGDGSTFKGNDIERFYRYGLLANPALRIYKPWLDQTFIDELGGRKEMSEYMISHGLTYKMSVEKAYSTDSNIWGATHEAKDLEHLDKGVKIVEPIMGVASWREDVAIKPETVTIRFEEGQPVALNHVTYDDPVQLVLEANAIGGRHGLGVSDQIENRIIEAKSRGIYEAPGLALLFIAYERLVSGIHNEDTIEQYRINGLRLGRLLYQGRWFDSQSMMLRETAQRWVARAITGEVTVELRRGNDYSILDTTSPNLTYKPERLTMEKGESTFSPQDRIGQLTMRHLDITDTRDKLLLYIKTGLLGPSSGNSTTLLPEPADSGTEKPPSR

SEQ ID NO: 5281 - DNA, 1224 bp, Magnetococcus sp. MC-1
  CDS (1)..(1224): transl_table=11
atgtccaacggtattgataaggttgtgctggcttactcggggggtttggatacctccatcattttgaagtggcttcaggatgagtatcagtgtgaggtggtcgctttctgtgcagacctgggtcaggcggaggagttggagcctgcgcgtgccaaggcggaaaagtttggggttaaagagatctacattgatgacctcaaagaggagtttgtgcgggattttgtctttcccatgtaccgcgccaacacattgtatgagggggtttaccacctgggtacctccattgcgcggcccttgattgccaaacgtcagattgaaattgccaatgccacaggtgcccaagcggtctctcacggggcgacgggtaagggtaatgatcaggtccgttttgagctgggttattatgcgttgcgtcccgatattcgcgtcattgcaccttggcgggagtgggacttgaccagccgtgacaagctgtttgcgtatgccgaaaagcatggtattccggtccccaccgacaagcgtggtgaggtcccttactcgatggaccgcaacctgctgcacatctcctttgagggcaaggcgctggaggatccatgggttgagcccgatgaagagatgtttgtcttatcggtttcaccggaaaaggcccccgatcaggccacctatgtggagctgaccttccgccagggcgatttggtcgccattgatgaccaggagatgagccccgccacgctgctggccaagctcaaccagttgggtgggcgcaacggcattggtcgcttggatctggtagaaaaccgctatgtgggcatgaaatcacggggagtttacgagaccccgggtggcaccattttgggggtggcacaccgtgcgatggagtcgctgacgttggatcgtgaagtggcccatatgaaagatgagttgatgccgcgctatgccaagttgatttacaacggctactggttttcgcccgagcgggccatgttgcagacgatgattgatgcctcgcagacctttgttaacggcaaggtgcgggtcaagctctacaagggcaatgtggttgtggtggggcgccaatcggaaaactcactgtttgatccggcaatcgctacctttgaagatgataaaggtgcctataatcaagcggatgcagatgggtttatcaaacttaatgcgctgcgcatgcgcattgcggcgatgctgcgcaacggccccaaggtttaa

SEQ ID NO: 5282 - protein, 407 aa, Magnetococcus sp. MC-1
MSNGIDKVVLAYSGGLDTSIILKWLQDEYQCEVVAFCADLGQAEELEPARAKAEKFGVKEIYIDDLKEEFVRDFVFPMYRANTLYEGVYHLGTSIARPLIAKRQIEIANATGAQAVSHGATGKGNDQVRFELGYYALRPDIRVIAPWREWDLTSRDKLFAYAEKHGIPVPTDKRGEVPYSMDRNLLHISFEGKALEDPWVEPDEEMFVLSVSPEKAPDQATYVELTFRQGDLVAIDDQEMSPATLLAKLNQLGGRNGIGRLDLVENRYVGMKSRGVYETPGGTILGVAHRAMESLTLDREVAHMKDELMPRYAKLIYNGYWFSPERAMLQTMIDASQTFVNGKVRVKLYKGNVVVVGRQSENSLFDPAIATFEDDKGAYNQADADGFIKLNALRMRIAAMLRNGPKV

SEQ ID NO: 5283 - DNA, 1197 bp, Mycobacterium avium 104
  CDS (1)..(1197): transl_table=11
atgtcagaacgcgtcatcctggcgtattccggcggtctggacacctcggtggccatcagctggatcggcaaggagaccggccgtgaggtcgtagcggtggcgatcgacctcggccagggcggcgaagacatggaggtcatccgccagcgcgccctggactgcggcgcggtggaggccgtcgtcgtggacgcccgcgacgaattcgccgagggctattgcctgcccaccatccgcaacaacgccctctacatggaccgctacccgctggtgtcggcgatcagccggccgctgatcgtcaagcacctggtggccgcggcccgcgagcacggcggcagcatcgtcgcgcacggctgcaccggcaagggcaacgaccaggtccgcttcgaggtcggattcgcttcgctggcaccggatctcgaggtgctggccccggtgcgcgattacgcgtggacgcgggagaaggcgatcgcgttcgccgaggagaacgccatcccgatcaacgtgaccaaacgctcgccattctccatcgaccagaacgtgtggggtcgcgcggtggaaaccggtttcctggaacacctttggaacgcgcccaccaaggacgtctacgcctacaccgaggaccccacgctgaactggagcacccccgacgaggtgatcgtcgggttcgagcgcggggttccggtgtccatcgacggcaagccggtgtcggtgctgggcgccatcgaggaactcaacgcccgcgccggcgcccagggggtggggcgcctggacgtcgtggaggaccggctggtgggcatcaagagccgcgagatctacgaggcgcccggcgccatggtgctcatcaccgcgcacaccgagctcgagcacgtcacgctggagcgggagctgggccggttcaagcggcacaccgatcagcgctgggccgagctggtgtacgacgggttgtggtattcgccgctgaaggctgcgctggaaagcttcgtcgacaagacccaggagcacgtcaccggcgagatccgaatggtgttgcacggcggccacattgccgtcaacggccggcgcagcgccgaatcgctctacgacttcaacctggccacctacgacgagggcgacagcttcgaccagtcggcggcgaagggtttcgtctacgtgcacgggctgtcgtcgaagatcgcctcccgccgggaccagcggtga

SEQ ID NO: 5284 - protein, 398 aa, Mycobacterium avium 104
MSERVILAYSGGLDTSVAISWIGKETGREVVAVAIDLGQGGEDMEVIRQRALDCGAVEAVVVDARDEFAEGYCLPTIRNNALYMDRYPLVSAISRPLIVKHLVAAAREHGGSIVAHGCTGKGNDQVRFEVGFASLAPDLEVLAPVRDYAWTREKAIAFAEENAIPINVTKRSPFSIDQNVWGRAVETGFLEHLWNAPTKDVYAYTEDPTLNWSTPDEVIVGFERGVPVSIDGKPVSVLGAIEELNARAGAQGVGRLDVVEDRLVGIKSREIYEAPGAMVLITAHTELEHVTLERELGRFKRHTDQRWAELVYDGLWYSPLKAALESFVDKTQEHVTGEIRMVLHGGHIAVNGRRSAESLYDFNLATYDEGDSFDQSAAKGFVYVHGLSSKIASRRDQR

SEQ ID NO: 5285 - DNA, 1200 bp, Mycobacterium smegmatis str. MC2 155
  CDS (1)..(1200): transl_table=11
atgtccgaacgcgtcatcctggcgtactccggaggtctcgatacctcggtggcgatcagctggatcggcaaggaaaccggcaaggaggtcgtcgccgtcgccatcgacctcggccagggcggcgaggatatggaagtggtgcgccagcgcgcactggactgcggtgccgtcgaggccgtcgtcgtcgacgcgcgcgacgagttcgccgaggaatactgccttcccaccatccagtccaacgcgctctacatggaccgctacccgctggtgtcggcgatcagtcgtccgctgatcgtcaagcacctcgtcaaggcggcccgcgagcacggcggcggcgtcgtcgcgcacggctgcaccggcaagggcaacgaccaggtgcgcttcgaggtcggattcgcttcgctggcaccggatctgcaggtgctcgccccggtccgcgattacgcctggacccgtgagaaggccatcgcgttcgccgaggagaacgcgatcccgatcaacgtgaccaagcgttcgccgttctcgatcgaccagaacgtgtggggtcgtgcggtggaaaccggcttcctggagcacctctggaacgcgcccaccaaggacgtctacgactacaccgaggaccccacggtccactggaacacccccgacgaggtcgtcatcggcttcgacaagggtgtgccggtctccatcgacggccgcccggtgagcgtgctgcaggccatcgaggaactcaaccgccgcgcgggagcgcagggtgtcggccgcctcgacgtggtcgaggaccggctggtcggcatcaagagccgcgagatctacgaggcccccggcgccatggtgctcatcaccgcccacaccgagctcgagcacgtcacgctcgagcgtgagctgggccggttcaagcggcacaccgaccagaagtggggcgagctggtgtacgacggcctgtggtactcgccgctcaagcgcgcgttggagtcgttcgtcgcgcacacccaggagcacgtctccggcgagatccggctcgtgctgcacggcggccacatctcggtcaacggccggcgcagcgcggagtcgctctacgacttcaacctcgccacctacgacgagggcgacagcttcgaccagtccgcagccaaggggttcgtgcacctgcacggcctcagctcgcggatctcggccaagcgcgacctgggcatctag

SEQ ID NO: 5286 - protein, 399 aa, Mycobacterium smegmatis str. MC2 155
MSERVILAYSGGLDTSVAISWIGKETGKEVVAVAIDLGQGGEDMEVVRQRALDCGAVEAVVVDARDEFAEEYCLPTIQSNALYMDRYPLVSAISRPLIVKHLVKAAREHGGGVVAHGCTGKGNDQVRFEVGFASLAPDLQVLAPVRDYAWTREKAIAFAEENAIPINVTKRSPFSIDQNVWGRAVETGFLEHLWNAPTKDVYDYTEDPTVHWNTPDEVVIGFDKGVPVSIDGRPVSVLQAIEELNRRAGAQGVGRLDVVEDRLVGIKSREIYEAPGAMVLITAHTELEHVTLERELGRFKRHTDQKWGELVYDGLWYSPLKRALESFVAHTQEHVSGEIRLVLHGGHISVNGRRSAESLYDFNLATYDEGDSFDQSAAKGFVHLHGLSSRISAKRDLGI

SEQ ID NO: 5287 - DNA, 1434 bp, Nocardioides sp. JS614
  CDS (1)..(1434): transl_table=11
gtgagcaaggtcctgacgtccctcccggtcggccagcgggtcggcatcgcgttctcgggaggcctggacacctcggtggcggtggcctggatgcgcgacaagggcgcgatcccgtgcacctacaccgccgacatcggccagtacgacgagcccgacgtctcgggcgtgcccgcccgggcccgcgagtacggcgccgagatcgcccgcgtggtcgactgccgggcgcagctggtcgaggaggggctggcggctctcgcctgcggcgccttccacatccgctcgggcggccggatctacttcaacaccacgccactcggccgcgccgtgaccggcaccatcctggtccgggcgatgcacgaggacggcgtcgacatctggggcgacgggtccaccttcaagggcaacgacatcgagcggttctaccgctacggcctgctggccaacccgcagctgcgcatctacaagccctggctggaccccgacttcgtccacgagctcggtggccgcaccgagatgagccagtggctgaccagccacggcctgccctaccgcgactcccaggagaaggcgtactccaccgacgcgaacatctggggcgccacccacgaggcgaagaccctcgagcacctggacacctcgctggaggtggtcacgccgatcatgggggtccgcttctgggacccggcggtcgacatcgccaccgaggacgtcaccgtcgcgttcgagcagggccgcccggtggcgctcaacggccgtcggttcgacgacccggtcgagctggtcgaggaggccaacgcgatcgggggccggcacggcctcgggatgtcggaccagatcgagaaccggatcatcgaggcgaagtcgcgcggcgtctacgaggcgcccggcatggccctgctgtggctcacctacgagcggctgatgaacgcgatccacaacgaggacacgctggcgaactaccagatcagcgggcgtcgcctcggccgcctgctgtacgaaggacggtggctcgacccgcaggcgctgatgctgcgcgagtcgatccagcgctgggtcgcgtcggtggtgaccggcgaggtgaccgtccggctgcgtcggggggaggactacacgatcgtgcggaccgagggcccggcgctgtcctaccaccccgagaagctctcgatggagcgcacctcgaactcggcgttcgggccgaccgaccggatcggccagctcacgatgcgcaacctcgacatcgccgactcgcgcgcgatgctcgagatgtacgccgggcagccactcgaccagggccaggtgctggtcgagaacggcacgctgttcggtgagctgccgtccggcgggttcgaccagatcaccgagaacccggaggtgcaggccgagccggaggaggaggccctcgacgcggccgcgatggaggccgggaccgactga

SEQ ID NO: 5288 - protein, 477 aa, Nocardioides sp. JS614
MSKVLTSLPVGQRVGIAFSGGLDTSVAVAWMRDKGAIPCTYTADIGQYDEPDVSGVPARAREYGAEIARVVDCRAQLVEEGLAALACGAFHIRSGGRIYFNTTPLGRAVTGTILVRAMHEDGVDIWGDGSTFKGNDIERFYRYGLLANPQLRIYKPWLDPDFVHELGGRTEMSQWLTSHGLPYRDSQEKAYSTDANIWGATHEAKTLEHLDTSLEVVTPIMGVRFWDPAVDIATEDVTVAFEQGRPVALNGRRFDDPVELVEEANAIGGRHGLGMSDQIENRIIEAKSRGVYEAPGMALLWLTYERLMNAIHNEDTLANYQISGRRLGRLLYEGRWLDPQALMLRESIQRWVASVVTGEVTVRLRRGEDYTIVRTEGPALSYHPEKLSMERTSNSAFGPTDRIGQLTMRNLDIADSRAMLEMYAGQPLDQGQVLVENGTLFGELPSGGFDQITENPEVQAEPEEEALDAAAMEAGTD

SEQ ID NO: 5289 - DNA, 1230 bp, Azoarcus sp. BH72
  CDS (1)..(1230): transl_table=11
atgagcgacgtgaagaaagtagtgttggcctactcgggcggcctcgatacctcggtgatcctgaagtggctgcaggatacctatcagtgtgaagtggtgacctttacggccgacctcggccagggcgaggaactcgagccggcgcgccagaaggcactcaagttcggcatcaagccggagaacatcttcatcgacgacctgcgcgaggaattcgtccgcgatttcgtgttcccgatgttccgcgccaacacgatctacgagggcgagtacctccttggcacctcgatcgcccgtccgctgatcgccaagcgtcagatcgagatcgcgcgcgccaccggcgccgacgccgtgtcgcacggtgccaccggcaagggcaatgaccaggtccgcttcgaactcggctattacgcgctgatgcccggcgtcaaggtgatcgcgccgtggcgcgagtgggacctgctgtcgcgcgagaaactgctggcgtacgccgagaagcacggcattcccatcgagatgaagcacaagcagggcggttcgccgtattcgatggacgccaacctgctgcacatctccttcgaaggccgccatctcgaaaacccggctgcggaagccgaagagtcgatgtggcgctggaccgtgtcgccggaagcagcgcccgatgcggcggagtacgtcgatctcgagttcgagaagggcgatctggtcgccatcaacggtcagcgcctgaaggcgcatgaactcctcgccaagctcaacgagctgggtggcaagcacggtatcggtcgcctggatctggtggaaaaccgctacgtcggcatgaagtcgcgcggttgctacgaaacgccgggaggcacgatcctgctgcgcgcccaccgcgccatcgaatcgatcacgctggaccgcgaggttgcccacctcaaggacgacctcatgccgcgctacgccagcatgatctacaacggctactggtggagcccggaacgccaggcactgcaggcgctggtcgatcacacgcagcaaacggttaacggctgggtgcgcatcaagctctacaagggcaacgtcatcgtcgttgcgcgcgactccaagaccgattcgctgttcgatccgacgattgccaccttcgaggacgatcagggcgcctacaaccagaaggacgcgcacggtttcatccgcctcaacgcgctgcgcatgcgcattgctgccaacgcgaagaccaagcggggttaa

SEQ ID NO: 5290 - protein, 409 aa, Azoarcus sp. BH72
MSDVKKVVLAYSGGLDTSVILKWLQDTYQCEVVTFTADLGQGEELEPARQKALKFGIKPENIFIDDLREEFVRDFVFPMFRANTIYEGEYLLGTSIARPLIAKRQIEIARATGADAVSHGATGKGNDQVRFELGYYALMPGVKVIAPWREWDLLSREKLLAYAEKHGIPIEMKHKQGGSPYSMDANLLHISFEGRHLENPAAEAEESMWRWTVSPEAAPDAAEYVDLEFEKGDLVAINGQRLKAHELLAKLNELGGKHGIGRLDLVENRYVGMKSRGCYETPGGTILLRAHRAIESITLDREVAHLKDDLMPRYASMIYNGYWWSPERQALQALVDHTQQTVNGWVRIKLYKGNVIVVARDSKTDSLFDPTIATFEDDQGAYNQKDAHGFIRLNALRMRIAANAKTKRG

SEQ ID NO: 5291 - DNA, 1344 bp, Neisseria meningitidis FAM18
  CDS (1)..(1344): transl_table=11
atgagccaaaaccatactattttacaaaacctccccgtcggtcagaaagtcggcatcgccttctccggcggacttgatacctccgccgcgctgttgtggatgaaactcaaaggcgcactgccttatgcctacactgccaacctcggtcagcccgatgaagacgactacaacgccattcccaaaaaagcgatggaatacggtgcggaaaacgcccgcttaatcgactgccgcgcgcagttggcacacgaaggcatcgccgccatccaatgcggcgcgttccacgtttccaccggcggcatcgcctatttcaacaccacgcctctgggccgcgccgtaaccggcacgatgcttgtttccgcaatgaaagaagacgacgtaaacatctggggcgacggcagcacctacaaaggcaacgacatcgagcgtttctaccgctacggtttgctcaccaatcccgcgctgaaaatctacaaaccctggctcgaccagcaatttatcgacgaactcggcggccgtcacgaaatgagcgaatttctgattgccaacggcttcaactacaaaatgtcggttgaaaaagcctactccaccgattccaatatgctcggcgcgacccacgaagccaaagacttggaatttttgaactcgggcatcaaaatcgtcaaacccattatgggcgttgccttttgggacgaaaacgttgaagtcagccccgaagaagtcagcgtgcgctttgaagaaggcgtgccggttgcactgaacggcaaagaatacgccgaccccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgaacgcttggtgaccggcatccacaacgaagacaccatcgaacaataccgcatcaacggcctgcgcctcggccgtttgctctaccaaggccgctggttcgacagccaagccttgatgttgcgcgaaaccgcccaacgctgggtcgccaaagccgttaccggcgaagttaccctcgaactgcggcgcggcaacgactactcgattctgaacaccgaatcgcccaacctgacctaccaacccgaacgcctgagtatggaaaaagtcgaaggtgcggcgtttaccccgctcgaccgcatcggacagctcacgatgcgcaacctcgacatcaccgacacccgcgccaaactgggcatctactcgcaaagcggtttgctgtcgctgggcgaaggctcggtattaccgcagttgggcaataagaaataa

SEQ ID NO: 5292 - protein, 447 aa, Neisseria meningitidis FAM18
MSQNHTILQNLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEVSPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEGAAFTPLDRIGQLTMRNLDITDTRAKLGIYSQSGLLSLGEGSVLPQLGNKK

SEQ ID NO: 5293 - DNA, 1347 bp, Acidovorax sp. JS42
  CDS (1)..(1347): transl_table=11
atggcaaccatcctgcaacacctccccgtcggccagaaggtcggcatcgccttctcgggcggcctcgacaccagcgccgcgctgcgctggatgaagaacaagggcgccctgccctacgcctacaccgccaacctgggccagcctgacgaagccgactacgatgagattccccgcaaggccatggaatacggcgccgagaaggcccgcctgatcgactgccgcacgcagctggcgcacgagggcattgccgccatccaggccggagcgttccacatcagcaccggtggcatcacctacttcaacaccacgccgctgggccgcgccgtgacgggcaccatgctggtggccgcgatgaaggaggacgacgtccacatctggggcgacggctccaccttcaagggcaacgacatcgagcgcttctaccgctacggcctgctcaccaaccccgcgctgaagatctacaagccctggctggaccagaagttcattgacgagctgggcgggcgcgccgagatgtcggccttcatgaccaaggaaggcttcggctacaagatgagcgccgaaaaggcgtacagcaccgacagcaacatgctgggcgccacgcacgaagcgaaggacctggagttcctcagcagcggcatccgcatcgtcaaccccatcatgggcgtggcgttctggaagcccgaagtcgacgtgccggccgaagaagtgtcggtcaccttcgacgaggggcaacccgtggccgtgaacggcaaggagatcgccgaccctgtggagctgttcctggaattgaaccgcatcggcggccgccacggcttagggatgagcgaccagatcgagaaccgcatcatcgaagccaagagccgcggcatctacgaagcccccggcatggcgctgctgcacatcgcctacgagcgcctggtcaccggcatccacaacgaagacaccatcgagcagtaccgcctgaacggcctgaagctcggccgcctgctgtaccagggccgctggttcgacccgcaggccatcatgctgcgcgagaccgcccagcgctgggtggcgcgcgccgtgaccggcaccgtgacgctcgagctgcgccgcggcaacgactactccatcctgaacaccgagtcgcccaacctgacctacgcgcccgagcgcctgtcgatggaaaaggtggaagacgcgccgttcagcccgctggaccgcatcggccagttgaccatgcgcaacctggacatctccgacacgcgcggcaagctgggcgtgtatgcacgcgccggcctgctgtcgctgggcggcaatgccgcgctggcgcagctggaagacggcggcgcgaagaaaaaataa

SEQ ID NO: 5294 - protein, 448 aa, Acidovorax sp. JS42
MATILQHLPVGQKVGIAFSGGLDTSAALRWMKNKGALPYAYTANLGQPDEADYDEIPRKAMEYGAEKARLIDCRTQLAHEGIAAIQAGAFHISTGGITYFNTTPLGRAVTGTMLVAAMKEDDVHIWGDGSTFKGNDIERFYRYGLLTNPALKIYKPWLDQKFIDELGGRAEMSAFMTKEGFGYKMSAEKAYSTDSNMLGATHEAKDLEFLSSGIRIVNPIMGVAFWKPEVDVPAEEVSVTFDEGQPVAVNGKEIADPVELFLELNRIGGRHGLGMSDQIENRIIEAKSRGIYEAPGMALLHIAYERLVTGIHNEDTIEQYRLNGLKLGRLLYQGRWFDPQAIMLRETAQRWVARAVTGTVTLELRRGNDYSILNTESPNLTYAPERLSMEKVEDAPFSPLDRIGQLTMRNLDISDTRGKLGVYARAGLLSLGGNAALAQLEDGGAKKK

SEQ ID NO: 5295 - DNA, 1473 bp, Magnetospirillum magnetotacticum MS-1
  CDS (1)..(1473): transl_table=11
atgaagggcgaagtcaagaaggtcgttctggcctattccggcggtctcgatacctccatcatcctgcgctggctgcaagatcagtacagttgcgaagtggtgaccttcaccgccgatctcggccagggcgaggaactggaaccggcccgcgccaaggcccgcctgatgggcatcaaggaagagaacatcttcatcgacgacctgcgcgaggaattcgtgaaggacttcgtcttccccatgttccgcgccaatgcgctgtacgagggcgtctatctgctgggcacctccatcgcccggccgctgatctccaagcgtcagatcgagatcgccaatctggtgggcgccgatgccgtgtcccacggcgccaccggcaagggcaatgatcaggtccgcttcgagatgggctattacgccttgaagcccgacatcaaggtcatcgcgccctggcgtctgtgggacctgaactcgcgcaccgccctgctggacttcgccgagaagcatcagattcccatcgccaaggacaagcgcggcgaggcgccttattccaccgacgccaatctgctgcacatctcctatgagggcaaggcgctggaagatccgtggatcgagcccaatgacgacatgtacacccgctcggtcagcccggagaacgcccccgacaagcccacttatgtggaaatcgagttcgagaagggcgacgccgtggccatcgacggcgtgcgcctgtcgcccgccgccctgctgaccaagctcaaccagttgggcggggccaacggcatcggccgtctggatctggtggaaaaccgcttcgtcggcatgaagagccgcggcgtctacgagacccccggcggctcggtgctgatcgtggcgcatcgcgccgtggaaagcctgacgctcgatcgcggcgaggcccacctcaaggacgagctgatgccccgttatgccgagctgatctataacggcttctggttcagccccgaacgtgtcgccatccagaccatgatcgacaaggtcagcgagaacgtctccggcaccgtgcggctcaagctttacaagggcgtcgcctcggtggtcggccgcaagtcgcccaggtcgctctatcgcatggactacgtcactttcgagaaagacagcgtctatgatcagcgcgacgcccaggggcttcatcaagctgaacgcactgcgcatgcgtctggccaagatggcgcgcggctaagcaataacacctactactctgcgaatattatgagggccccgccgcggcggggccctttgtttttgagcgatttgatctatccgctttacgcattccatgggcttttatactattggatagaatcgacgcaatctgcatggtcaaagctttgccttccgcctcccgccgctcttccgcctcggccgtccccatcaagtggtggcccctggtgttatggggtctggccatggggatcgtcgtggcctggacggccgtga

SEQ ID NO: 5296 - protein, 490 aa, Magnetospirillum magnetotacticum MS-1
MKGEVKKVVLAYSGGLDTSIILRWLQDQYSCEVVTFTADLGQGEELEPARAKARLMGIKEENIFIDDLREEFVKDFVFPMFRANALYEGVYLLGTSIARPLISKRQIEIANLVGADAVSHGATGKGNDQVRFEMGYYALKPDIKVIAPWRLWDLNSRTALLDFAEKHQIPIAKDKRGEAPYSTDANLLHISYEGKALEDPWIEPNDDMYTRSVSPENAPDKPTYVEIEFEKGDAVAIDGVRLSPAALLTKLNQLGGANGIGRLDLVENRFVGMKSRGVYETPGGSVLIVAHRAVESLTLDRGEAHLKDELMPRYAELIYNGFWFSPERVAIQTMIDKVSENVSGTVRLKLYKGVASVVGRKSPRSLYRMDYVTFEKDSVYDQRDAQGLHQAERTAHASGQDGARLSNNTYYSANIMRAPPRRGPLFLSDLIYPLYAFHGLLYYWIESTQSAWSKLCLPPPAALPPRPSPSSGGPWCYGVWPWGSSWPGRP

SEQ ID NO: 5297 - DNA, 1203 bp, Nostoc punctiforme PCC 73102
  CDS (1)..(1203): transl_table=11
atgggtcgcgccaaaaaggttgtcctggcatattctggtggagtggatacttccgtttgcatcccttacctcaaacaggagtggggtgtggaagaggtgattaccctagcagcagatttaggtcagggagatgaattagagccaattcgagaaaaagctctgaaatcgggtgcaagtgaatcactcgtggcggatgtcaaagacagcttcgttaaagattacgcttttggagcgattcaagccaacgcactttatgaaaatcgttatcctctaggaactgctcttgcccgtccactgatcgctaagatattagtagaaacggctgaaaaatatggtgctgatgcgatcgctcacggttgcactggcaaaggtaacgatcaggttcgctttgatgtctctgtgactgccctcaaccccaacctaaaaatcctcgcaccagccagagaatggggtatgagccgtgaggaaaccatcgcttatggtgagaagtttggtatcccctcaccagtcaaaaaatcttctccctacagcattgacaaaaatttgctcggtcgtagcattgaagctggtttactcgaagatccatcatttgagccaccagaagaaatttatgagatgactaaagcgatcgctgacactcccaacgagccagagtacatcaaaattggtttccacggtggtattcccacaaccctcaacggtatagctaaacagccagttgaactaattgaagaactcaatcagcttgtaggaaatcacggtgttggacggatagatatgattgaaaaccgtctggttggcatcaaatcgcgggaaatctacgaatcacccgcgatgttagtgctaattcaggcacatcgggatttagaaagcttgactttgacggcagatgtcacccattacaaacgtggcattgaagaaacttatagccaaatcgtttacaacggtttgtggtacagtccactcaaagttgcactagatgcctttattcaaaagacacaagagcgagtctctggaactgtgcgagtgaagctattcaagggtaactccacgatagttgggcgttcgagcgatagttccctctatactcctgatttggcaacctacggagccgatgaccaatttgaccataaagctgctgaaggttttatctatgtttggggactaccaactcgcatttggtcgcggcaaataaaaagttaa

SEQ ID NO: 5298 - protein, 400 aa, Nostoc punctiforme PCC 73102
MGRAKKVVLAYSGGVDTSVCIPYLKQEWGVEEVITLAADLGQGDELEPIREKALKSGASESLVADVKDSFVKDYAFGAIQANALYENRYPLGTALARPLIAKILVETAEKYGADAIAHGCTGKGNDQVRFDVSVTALNPNLKILAPAREWGMSREETIAYGEKFGIPSPVKKSSPYSIDKNLLGRSIEAGLLEDPSFEPPEEIYEMTKAIADTPNEPEYIKIGFHGGIPTTLNGIAKQPVELIEELNQLVGNHGVGRIDMIENRLVGIKSREIYESPAMLVLIQAHRDLESLTLTADVTHYKRGIEETYSQIVYNGLWYSPLKVALDAFIQKTQERVSGTVRVKLFKGNSTIVGRSSDSSLYTPDLATYGADDQFDHKAAEGFIYVWGLPTRIWSRQIKS

SEQ ID NO: 5299 - DNA, 1239 bp, Bifidobacterium longum DJO10A
  CDS (1)..(1239): transl_table=11
atggcagataacaagcgcattgttctggcctactccggcggtcttgacacctccgtcgccatctcgtacctgaaggagcgcaccggcaaggacgtcgtggccgtgtccctcgacgtcggccagggcggcgaaagcctcgagaccatcaagcagcgcgcccttgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagtcgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggtgccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcgcgcgacgtcaagttcggcaacggcatcgaggtcccggagaacaccgtcgagtaa

SEQ ID NO: 5300 - protein, 412 aa, Bifidobacterium longum DJO10A
MADNKRIVLAYSGGLDTSVAISYLKERTGKDVVAVSLDVGQGGESLETIKQRALACGAVESYVVDARDEFANEYCMKALKANAMYEGVYPLVSAISRPLISKHLVRAAHQFGADTISHGCTGKGNDQVRFEVSIASIDPTLKAISPIRDLSLTRDVEIAFAKEHKLPITQTEKSPYSIDQNVWGRAIETGFLEDPWNGPTKDCYSYTDDPAFPPVEDEVVIEFKEGVPVKIDGRDVTPLQAIEEMNRRAGAQGVGRIDLIEDRLVGIKSRELYEAPGAVALITAHQELENCCLEREQHRIKRDIDKRWGELVYDAQWFSPATQSLNAFIEDTQKYVSGEIRMVLHGGRAVVTGRRSDSSLYDYKLATYDSGDTFDQKSSNGFIDIYGLPSRVAAARDVKFGNGIEVPENTVE

SEQ ID NO: 5301 - DNA, 1335 bp, Haemophilus somnus 2336
  CDS (1)..(1335): transl_table=11
atgtcaaatacaattttacaacatcttccaattggtcaaaaagtaggcattgctttttccggtggtttggataccagtgcagcattactttggatgcgtcaaaaaggtgcagtaccttatgcttataccgctaatttaggtcaacctgacgaagaagattataatgctattcctcgtaaagcgatggaatatggtgcagaaaaagctcgtttaattgattgccgcaatcagcttgctcatgaaggtattgccgctattcaatgcggagcctttcatatttccacaggcggtgtaacgtattttaatactacgcctttaggtcgtgcggtaacaggtaccatgcttgtttcagctatgaaagaagatgatgttaatatttggggcgatggttccactttcaaaggcaatgatattgagcgtttttatcgctacgggttattaactaatccgagtttacgtatttataaaccttggttggataatcaatttattgatgagctgggtggccgtcaagaaatgtccgagtttttaatcgcaaacgggtttgattacaaaatgtctgctgaaaaagcttactcgacggattccaatatgttaggtgccactcatgaagcaaaagatttagaatatctcaatagcggtattcgtattgttaagcctattatgggtgttgccttttggcgtgatgatgtaactgtgaaagcggaagaagtgacggtcggatttgaagacggtgttcctgtcacattaaacggtcagtctttttcaagtgcggtcgaactctttttagaagccaatcgcatcggcggtcgtcatggtctgggaatgtccgatcaaattgaaaatcgtatcattgaagcgaaaagtcgtggcatctacgaagctccgggtatggcgttattgcatatcgcctatgagcgtttggttacggcgatccataatgaagatactattgaacaatatcgtatcaatgggttgcgtttagggcgtttattataccaaggacgttggtttgatccgcaagcattgatgttacgtgaaacagctcaacgttgggtagcccgtgcggtaaccggtgaagttacattagaattacgccgtggtaacgattattctattttaaatacagtgtcaccgaatatgacttatcatcctgaacgtttaagtatggaaaaagtggaaaatgcaccgtttgatccgtccgatcgtataggtcaacttaccatgcgtaatcttgatattacggatacgcgtgataaattgggtatttatacacataccggattactgactgtaggtaaagattcaatgttaccgcaattggataaaaaatag

SEQ ID NO: 5302 - protein, 444 aa, Haemophilus somnus 2336
MSNTILQHLPIGQKVGIAFSGGLDTSAALLWMRQKGAVPYAYTANLGQPDEEDYNAIPRKAMEYGAEKARLIDCRNQLAHEGIAAIQCGAFHISTGGVTYFNTTPLGRAVTGTMLVSAMKEDDVNIWGDGSTFKGNDIERFYRYGLLTNPSLRIYKPWLDNQFIDELGGRQEMSEFLIANGFDYKMSAEKAYSTDSNMLGATHEAKDLEYLNSGIRIVKPIMGVAFWRDDVTVKAEEVTVGFEDGVPVTLNGQSFSSAVELFLEANRIGGRHGLGMSDQIENRIIEAKSRGIYEAPGMALLHIAYERLVTAIHNEDTIEQYRINGLRLGRLLYQGRWFDPQALMLRETAQRWVARAVTGEVTLELRRGNDYSILNTVSPNMTYHPERLSMEKVENAPFDPSDRIGQLTMRNLDITDTRDKLGIYTHTGLLTVGKDSMLPQLDKK

SEQ ID NO: 5303 - DNA, 1335 bp, Haemophilus influenzae R2846
  CDS (1)..(1335): transl_table=11
atgtcaaatactattctacagaatttacctaaaggacaaaaagtggggatcgctttctctggtggtttagacactagcgcagcattactttggatgcgtcaaaaaggcgcagtgccttatgcctacaccgctaatttagggcaacccgatgaagatgattacaatgcaatccctaaaaaagccatggcgtatggtgcagaaaacgcgcgattaattgattgtcgtgctcagcttgctcatgaaggcattgccgcaattcaatgtggtgcattccatatttctacaggcggcattccttacttcaatacaacgcctcttggtcgcgcagtaacaggcacaatgctcgttgcagcaatgaaagaagatgatgtaaacatttggggcgacggctccactttcaaagggaatgatattgagcgtttctatcgttatggtttattaacaaacccaaatttaaaaatctataaaccttggttagatgcacaatttattgaagaacttggcggtcgtttagaaatgtctcaattccttatcgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcaccgtcacttttgaagaaggtgtccctgtggcattaaatggtaaacgttttgataatgcagttgatattattctggaagccaatcgtatcggtggtcgtcatggtttaggaatgtcagaccaaatcgaaaatcgtattattgaagccaaatctcgtggtatttatgaagcaccagggatggcattattacatatcgcttacgaacgtttagtcacaggtattcacaatgaagacaccatcgaacaatatcgtattaatggcattcgtttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccaattgatcgtatcggtcaattaacaatgcgtaatttagatgtatcagacacccgcggtaaacttagcatctatgcacaaacaggtttattaagcgcaattaaagattccgtattgccacaattaggcaaaaaataa

SEQ ID NO: 5304 - protein, 444 aa, Haemophilus influenzae R2846
MSNTILQNLPKGQKVGIAFSGGLDTSAALLWMRQKGAVPYAYTANLGQPDEDDYNAIPKKAMAYGAENARLIDCRAQLAHEGIAAIQCGAFHISTGGIPYFNTTPLGRAVTGTMLVAAMKEDDVNIWGDGSTFKGNDIERFYRYGLLTNPNLKIYKPWLDAQFIEELGGRLEMSQFLIENGFDYKMSVEKAYSTDSNMLGATHEAKDLEQLSTGMKIVKPIMGVAFWDEKVEIKPETVTVTFEEGVPVALNGKRFDNAVDIILEANRIGGRHGLGMSDQIENRIIEAKSRGIYEAPGMALLHIAYERLVTGIHNEDTIEQYRINGIRLGRLLYQGRWFDPQALMLRETAQRWVAKAITGTVTLELRRGNDFTILNTESPNLTYEAERLSMEKVEDAPFDPIDRIGQLTMRNLDVSDTRGKLSIYAQTGLLSAIKDSVLPQLGKK

SEQ ID NO: 5305 - DNA, 1215 bp, Listeria monocytogenes str. 1/2a F6854
  CDS (1)..(1215): transl_table=11
atggcgaaagaaaaaatcgtattagcttactcaggtgggttagatacttctgtggcaattcagtggttagtagaatcaggttatgaagttattgcatgttgcttggatgttggtgaaggcaaaaatttagattttattaaagaaaaagccattactgtcggagcaagtgaatcctacacgattgatgcgaaagaagaatttgccgaggattttgcgttaattgctcttcaagcccatgcttattatgaaggaaaatatccacttatttcagctttaagccgtccgttaattgcgaaaaaattagtagaagtcgctcgtcaagaaggcgcttctgctatcgctcatggttgtactggtaaaggaaatgaccaagttcggtttgaagtagcgattcatgcacttgctcctgatttaaaagtcgtttctcctgtccgtgattggaaatggtctagagaagaagaaatcaattacgccaaagaacatgacatccctgtcccaattgatctagataatcccttctcgattgaccaaaacttgtggggtagaagtaatgaatgtggtgtgcttgaaaacccatggacaacaccgccagaggcagcttacgacttaacagtgagtttagaagatgcaccagacacagcagatattgttgaaatcacctttgatgctggtattcctatttctcttaatggagaaaatatgagcctagctaatttaattcttactttaaatgaaattgctggaaaacatggtgttggtagaattgatcatatcgaaaatcgtttagttggtattaaatcacgtgaagtatacgaatgtccggccgcagtcactttgattacagcacataaggaattagaagatttaacctttgttcgtgaagtggcacatttcaaacctatcatcgaacaaaaaatcagtgaaacaatttacaatggcctatggttctctcctttaacagaagcattagttgccttcttaaaatctacacaaaaattcgtgaacggcaccatccgcgtcaaattatttaaaggtcatgccattgtagagggaagaaaatcgccaaattcactttatgatgaaaacttagcaacttacacgtcttccgatacatttgaccaagatgcagcagttggtttcatcaagctttggggattaccaacgaaagtaagcgcagaagttaattcaaaagtgacaataacaactgaggtgtga

SEQ ID NO: 5306 - protein, 404 aa, Listeria monocytogenes str. 1/2a F6854
MAKEKIVLAYSGGLDTSVAIQWLVESGYEVIACCLDVGEGKNLDFIKEKAITVGASESYTIDAKEEFAEDFALIALQAHAYYEGKYPLISALSRPLIAKKLVEVARQEGASAIAHGCTGKGNDQVRFEVAIHALAPDLKVVSPVRDWKWSREEEINYAKEHDIPVPIDLDNPFSIDQNLWGRSNECGVLENPWTTPPEAAYDLTVSLEDAPDTADIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALVAFLKSTQKFVNGTIRVKLFKGHAIVEGRKSPNSLYDENLATYTSSDTFDQDAAVGFIKLWGLPTKVSAEVNSKVTITTEV

SEQ ID NO: 5307 - DNA, 1206 bp, Bacillus cereus G9241
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcgcacacgttatacgaagggaaataccctctcgtttcggccctatcacgcccacttatcgcgaagaagttagtggaaattgcagaacaagaaggagcgactgcagttgcacacggatgtacagggaaaggaaatgatcaagttcgttttgaagtttctatccaagcattaaatccttacttagaagtgattgcacctgtacgtgaatggaaatggtcacgtgaagaagaaattgcctatgcaaaagaaaacaatgtaccaattccgattcatttagatagcccgttttcaatcgatcaaaacttatggggacgcagtaatgaatgtggtattttagaagatccatgggcagcgccgccagaagatgcatatgagatgacattggcattagaagatacaccgaataaaccagagtttgtagaaattggctttgaagcaggcgtgccgactactttaaatggcactgcatatccactttcagaactaattaaaacgttaaatgcacttgctggaaaacatggcgttggacgtatcgatcacgtagaaaatcgccttgtcggtattaaatcgcgtgaagtatacgaatgcccagcagcaatgacattaattacggcgcacaaggaacttgaagatttaacactcgtaaaagaagtagcgcattttaaaccgatgattgagcaaaaaataacagagcttatttataacggtttatggttctcacctttaaaacaagcgcttcatgctttcttacaagaaacgcaaaagaatgtaacaggcatggtgcgtgtgaaattatttaaaggtcatgcaattgtagaaggacgtaaatctgagtactctttatacgatgaaaaattagcaacgtatactgctcaggatgaatttaatcatgatgcagcagttggattcatttcattattcggtttaccgacgaaagtatacagccaagtgaatcaaaagaaggtggaagcgtga

SEQ ID NO: 5308 - protein, 401 aa, Bacillus cereus G9241
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPIHLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGMVRVKLFKGHAIVEGRKSEYSLYDEKLATYTAQDEFNHDAAVGFISLFGLPTKVYSQVNQKKVEA

SEQ ID NO: 5309 - DNA, 1203 bp, Crocosphaera watsonii WH 8501
  CDS (1)..(1203): transl_table=11
atgggtcgtgccaaaaaagtcgtgcttgcgtattctggtggggtagatacctccgtttgtattccctatctcaagcaggagtggggtgtggatgaggtaatcaccttagctgcggacttgggccaaggagatgaactcggtcccatccaagccaaagccttaaaatctggggctgtggagtctcttgtagaagatgctaccacagagtttgtcacagattatgccttcaaagctatcaaagctaatgcactgtatgagaatcgttatcccctctctactgccttagctcgtcctctcattgctaaactattagtagatgctgccgaaaaatatggggccgatgcagttgcccacggttgcaccgctaaaggtaatgatcaggtacgttttgatctgggaatcttagccttaaatcctaccttaaaagtgttggcccccgccagggaatggaatatgagtcgggaacaaaccattgcctacggtgagcagtttgggttagaattccccgtgaagaaatcttctcccttcagtatcgatcgcaacttgttaggccgtagtattgaagccgggcccctggaagatccgatgactgaacccccggaagaaatctatttgatgactaaagcgatcgccgatactccagacaccccggaatatgtggagatcggttttgagaagggtatccctgttagtctcaatggtcaaaccttagatcccgttgccctcattagtcaactcaatgatctggtgggtaaacacggtgttggccgcattgatatgatagaaaatagagtagttgggattaaatcacgggaaatttatgaagcccctgctttattagtgcttattgatgctcaccgagacttagaaagcttaaccttgactgctgatgtcacccagtacaaaaaaggcatagaagaaacctacagtcatttgatctatcaagggttatggtattctcctctaaaagaatctcttgatgctttcatcgatcatactcaagaaagagtcaccggaatggtacgcattaaactattcaaaggtaatgcgactattgttggtcgtcagtctgattattccatttatagcccccatttatccacctatggggaagacgatcaattcgatcataaagcagcagaaggctttatctatatttggggacttcctaccagagtttgggcagaaaaaaccaaaggttaa

SEQ ID NO: 5310 - protein, 400 aa, Crocosphaera watsonii WH 8501
MGRAKKVVLAYSGGVDTSVCIPYLKQEWGVDEVITLAADLGQGDELGPIQAKALKSGAVESLVEDATTEFVTDYAFKAIKANALYENRYPLSTALARPLIAKLLVDAAEKYGADAVAHGCTAKGNDQVRFDLGILALNPTLKVLAPAREWNMSREQTIAYGEQFGLEFPVKKSSPFSIDRNLLGRSIEAGPLEDPMTEPPEEIYLMTKAIADTPDTPEYVEIGFEKGIPVSLNGQTLDPVALISQLNDLVGKHGVGRIDMIENRVVGIKSREIYEAPALLVLIDAHRDLESLTLTADVTQYKKGIEETYSHLIYQGLWYSPLKESLDAFIDHTQERVTGMVRIKLFKGNATIVGRQSDYSIYSPHLSTYGEDDQFDHKAAEGFIYIWGLPTRVWAEKTKG

SEQ ID NO: 5311 - DNA, 1206 bp, Exiguobacterium sibiricum 255-15
  CDS (1)..(1206): transl_table=11
atgacaaaacaaaaattgattttagcgtattcgggtggactggatacttcagtcgccatcaaatggttaagcaaggactatgacgtcgtcgcattgtgcatggatgtcggcgaaggaaaagatttgtcggtcatcaaagaaaaagcgttactcgtcggtgcgatcgaatcgattgttcttgatgtcaaagatgaattcgcaaatgactttgttttgccggccctccaatatggtgcgcattacgaaggtgcgtatccattgatttccgctttatctcgcccgttgattgctgaaaaactggttgaagtggcacatgcccaaggtgccacagcagtcgcccacggatgtaccggaaaaggaaacgaccaagtccggttcgaagtttcggttgctgctcttgatccgtcgctcgaagtcatcgcaccggttcgcgaatggaaatggtcacgtgaagaagaaatcgcttatgcaaaagaaaacaacgttccgattccgattaatctcaacagcccgtattcaatcgacatgaacttatggggacgcagtaacgaatgtggtgtccttgaaaatccatggacagagccgccgcaagatgcatacgctttgacggtcgcaccggaagacgcaccggatcaagcggaagaagtcatcatcggttttgaagcaggtgttccggtttcgatcaacgggacagcgtatccgctggcgaagctgattacagaactgaatatcattgccggtgcacacggtgttggacggattgaccatgtcgaaaaccgtttggtcggcatcaagtcacgtgaagtgtatgagtgcccgggtgcgacagtcttactcaaagcccacgcagcacttgaaacgatcacattgacgaaagacgttgcccactttaaaccgattctcagcaaacaatatgcagaaacgatttacaacggattgttccatgccccgctgacaaaaggcctcaaagcgttcttgacggcaacgcaacaggacgtgaccggtgaagtccgtgtcaaactgtataaagggaacgcaaccgtcacaggacgtcagtcagcagtttcgctctacgatgagaaactcgcgacgtatacaaaagaagatgcctttgatcacgaagcagcgaaaggattcatcaaattacacggtcttgcgatttcgacacatgccagtgtccatcgtcaggaaggcgtgaaaaaatga

SEQ ID NO: 5312 - protein, 401 aa, Exiguobacterium sibiricum 255-15
MTKQKLILAYSGGLDTSVAIKWLSKDYDVVALCMDVGEGKDLSVIKEKALLVGAIESIVLDVKDEFANDFVLPALQYGAHYEGAYPLISALSRPLIAEKLVEVAHAQGATAVAHGCTGKGNDQVRFEVSVAALDPSLEVIAPVREWKWSREEEIAYAKENNVPIPINLNSPYSIDMNLWGRSNECGVLENPWTEPPQDAYALTVAPEDAPDQAEEVIIGFEAGVPVSINGTAYPLAKLITELNIIAGAHGVGRIDHVENRLVGIKSREVYECPGATVLLKAHAALETITLTKDVAHFKPILSKQYAETIYNGLFHAPLTKGLKAFLTATQQDVTGEVRVKLYKGNATVTGRQSAVSLYDEKLATYTKEDAFDHEAAKGFIKLHGLAISTHASVHRQEGVKK

SEQ ID NO: 5313 - DNA, 1206 bp, Prosthecochloris aestuarii DSM 271
  CDS (1)..(1206): transl_table=11
atgagcaaggaaaaaatcgctctcgcctattccggcggactcgacacctcggtgatgatcaaatggcttaaagacaaatatgatgccgagatcgtggctgtcacaggaaacctcggccaggaaaaagaggtggaaaacctcgaagaaaaagctatcgcaaccggagcatccagcttcgcttttctcgatcttcgcaaagaatttgtagaaagctgcatctggccggccctgaaagcaggtgcgctctacgaggatgtctatcccctggctacagcgctcggtcgcccgctgattgcaaaagcgctcgtcgatatcgcgctggaaaacaactgcaccatgctcgctcacggctgcaccggcaaaggcaatgatcaggttcgtttcgaggtcaccttcgcctcactcgctccacagcttgccgtgctggcaccgttgcgtgaatgggagttcacgtcacgcgaagcagaaatcgcctacgcaatggagcataacatcccggtttcagccaccaagaaaagcccatactctatcgatgaaaacatctggggaatcagcattgagtgcggtgttctcgaagatccgatgacgccggcccctgaagatgcctatcagatcacaacgtcacctgaaaaagcgccagacaaggctgctgtgattgacattgaatttgaacagggtgttcctgtcgcactggacggaaaagccatggagggtcttgacctcatcgttgagctcaacaaggtaggcgcagctcatggcgtaggccgtctcgatatggtcgaaaaccgtgttgtcggcatcaaatccagagagatctacgaagccccggcagcaaccatcctgcacttcgcacaccgtgagctcgaacgcctgaccctggaaaaatcggtcttccagtacaagaaaaacgtcagtcaggattacgccaacctgatctacaacggcacctggttttcgccgatgcgtgaagcgcttgacggatttatcgaagctacacagaaaacggtcaccggccttgttcgcgtcaaactcttcaaaggctcggtaacattgctcggcagaacctcgccatggtcactctacaatgaggatctggcaacctatacggaagccgataccttcaaccacaaagcagccgaaggcttcatccacctctacggtctcggtctgaaaacatggagtgaagtcaaagccaataacagctga

SEQ ID NO: 5314 - protein, 401 aa, Prosthecochloris aestuarii DSM 271
MSKEKIALAYSGGLDTSVMIKWLKDKYDAEIVAVTGNLGQEKEVENLEEKAIATGASSFAFLDLRKEFVESCIWPALKAGALYEDVYPLATALGRPLIAKALVDIALENNCTMLAHGCTGKGNDQVRFEVTFASLAPQLAVLAPLREWEFTSREAEIAYAMEHNIPVSATKKSPYSIDENIWGISIECGVLEDPMTPAPEDAYQITTSPEKAPDKAAVIDIEFEQGVPVALDGKAMEGLDLIVELNKVGAAHGVGRLDMVENRVVGIKSREIYEAPAATILHFAHRELERLTLEKSVFQYKKNVSQDYANLIYNGTWFSPMREALDGFIEATQKTVTGLVRVKLFKGSVTLLGRTSPWSLYNEDLATYTEADTFNHKAAEGFIHLYGLGLKTWSEVKANNS

SEQ ID NO: 5315 - DNA, 1686 bp, Kineococcus radiotolerans SRS30216
  CDS (1)..(1686): transl_table=11
gtgggaggcggcctgcgcggtgttcgacctcgccctggccctgggcgggacgctgaccggcgagcacggcgtcgggctgctcaagcgcacctggctgcaccgcgagctcggcgaggactccctggcgctgcagcgcgggatcaaggcggtgttcgacccgctggggatcctcaacccgggcaaggggatctgagaccccggccgccgcccggaccgctcgcgcgacccggaccctgtttgcatgttcatgcagtgcggtgcatgattcaccgcatgtccaaggtgctcacgtccctgcccgccggcgaacgcgtcggcatcgccttctccggcggtctcgacacctccgtcgccgtggcgtggatgcgggagaagggcgcggtgccctgcacctacaccgccgacatcgggcagtacgacgaacccgacatcgactccgtgcccggccgcgccggggcctacggcgcggaactggcccggctggtggactgccgcgcggcgctcgtcgaggagggcctggccgccctgaccaccggcgcgttccacatccgctccgcggggcgcagctacttcaacaccacgcccctgggccgcgccgtcaccggcaccctgctggtgcgcgcgatgctggaggacgacgtccagatctggggcgacgggtccacctacaagggcaacgacatcgagcggttctaccgctacggcctgctcgccaacccctccctgcggatctacaagccgtggctggacgccgggttcgtcgccgagctcggcgggcgcaaggagatgtcggagtggctgcaggcgcgcgacctgccctaccgcgcgagcaccgagaaggcgtactccaccgacgcgaacatctggggcgccacccacgaggccaagcggctggagcacctcgacgtcggcgtcgagctcgtcgagcccatcatgggcgtgcggttctgggaccccgaggtcgagatcgcccccgaggacgtgagcatcgggttcgagcagggccggccggtctcgatcaacggcgcgaccttcgagagcgccgtcgacctcgtcctggaggccaacgccatcggcggccggcacgggctcggcatgtccgaccagatcgagaaccgcatcatcgaggccaagagccgcggcatctacgaggccccgggcatggcgctgctgcacgccgcctacgagcgcctcgtcaacgccatccacaacgaggacaccgtcgccagctaccacaacgagggccgtcgcctcgggcgcctcatgtacgagggccgctggctggacccgcaggccctcatgctccgggagtccctgcagcgctgggtcggcaacgccgtcaccggcaccgtcaccctgcgcctgcgccgcggggaggactactcgatcctcgacacgcagggcccggcgttcagctaccaccccgacaagctgtccatggagcgcaccgaggactccgccttcggccccgtggaccgcatcggccagctgacgatgcgcaacctcgacatcgccgactcccgcgccaagctggagcagtacgccgggatgggcatggtcggcagttcccaggtcagcctcatcggcgccctggagtccgggggcgcggaggcgatcgcctcgcgcggggagagcagcggggacgaactgctggaccgcgccgcgatggagtccggcaccgactga

SEQ ID NO: 5316 - protein, 561 aa, Kineococcus radiotolerans SRS30216
MGGGLRGVRPRPGPGRDADRRARRRAAQAHLAAPRARRGLPGAAARDQGGVRPAGDPQPGQGDLRPRPPPGPLARPGPCLHVHAVRCMIHRMSKVLTSLPAGERVGIAFSGGLDTSVAVAWMREKGAVPCTYTADIGQYDEPDIDSVPGRAGAYGAELARLVDCRAALVEEGLAALTTGAFHIRSAGRSYFNTTPLGRAVTGTLLVRAMLEDDVQIWGDGSTYKGNDIERFYRYGLLANPSLRIYKPWLDAGFVAELGGRKEMSEWLQARDLPYRASTEKAYSTDANIWGATHEAKRLEHLDVGVELVEPIMGVRFWDPEVEIAPEDVSIGFEQGRPVSINGATFESAVDLVLEANAIGGRHGLGMSDQIENRIIEAKSRGIYEAPGMALLHAAYERLVNAIHNEDTVASYHNEGRRLGRLMYEGRWLDPQALMLRESLQRWVGNAVTGTVTLRLRRGEDYSILDTQGPAFSYHPDKLSMERTEDSAFGPVDRIGQLTMRNLDIADSRAKLEQYAGMGMVGSSQVSLIGALESGGAEAIASRGESSGDELLDRAAMESGTD

SEQ ID NO: 5317 - DNA, 1206 bp, Xylella fastidiosa Dixon
  CDS (1)..(1206): transl_table=11
atgagtaagaaaaacattgtcttggccttctccggtggactcgacaccagcttttgcatcccctacctgaaagaacagggctatgccgtacacaccgtatttgccgacaccggcggtgtcgacgaagatgagcgtgacttcattgaaaaacgtgctgccgaattaggcgtagctagccacctcaccgtggatggcggccctgctatctgggatggtttcgtaaaacagcttgtctgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctctacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaattcgttgaaggcgaagccgtcgccgtagatgggaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccgcacatagcccgtaaatgggttgaactggtgtacgaaggatttttccatgaccccttgaagactgacctagagaccttcttaaaatcctcccaagccaacgtgaatggtgaaatcgtccttgaaacccgaggtggtcgagtcgatgccgtcgcagtgcgctcaccgcacatcctcactagcaaaggcgtcacctacgcccaaaccgctgactggggtattgaagaagccgaaggatttatcaaactctttggcatgagctccaccctatacgctcatgtaaatcgttccctgcgctcatga

SEQ ID NO: 5318 - protein, 401 aa, Xylella fastidiosa Dixon
MSKKNIVLAFSGGLDTSFCIPYLKEQGYAVHTVFADTGGVDEDERDFIEKRAAELGVASHLTVDGGPAIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAHVNRSLRS

SEQ ID NO: 5319 - DNA, 1206 bp, Xylella fastidiosa Ann-1
  CDS (1)..(1206): transl_table=11
atgagtaagaaaaacattgtcttggccttctccggtggactcgacaccagcttttgcatcccctacctgaaagaacagggctatgccgtacacaccgtatttaccgacaccggcggtgtcgacgaagatgagcgcgacttcattgaaaaacgtgctgccgaattaggcgtagctagccacctcaccgtggatggcggcccttccatctgggatggtttcgtaaaacagcttgtttgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctgtacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaattcgtcgaaggcgaagccgtcgccgtagatggaaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccgcacatagcccgtaaatgggttgaactggtgtacgaaggatttttccatgaccccttgaagactgacctagagaccttcttaaaatcctcccaagccaaggtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgctcatgtaaatcgttccctgcgctcatga

SEQ ID NO: 5320 - protein, 401 aa, Xylella fastidiosa Ann-1
MSKKNIVLAFSGGLDTSFCIPYLKEQGYAVHTVFTDTGGVDEDERDFIEKRAAELGVASHLTVDGGPSIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQAKVNGEIVLETRGGRVDAVAVRSPHILTSKGVTYAQTADWGIEEAEGFIKLFGMSSTLYAHVNRSLRS

SEQ ID NO: 5321 - DNA, 1221 bp, Sulfitobacter sp. EE-36
  CDS (1)..(1221): transl_table=11
atgtccgcgcccaaaaaagttgtgctcgcctattctggtgggcttgatacctcgatcatcctgaaatggctgcaaaccgaatatggttgcgaggtggttacctttaccgctgacctcggccaaggcgaagagcttgagcccgcccgcgccaaagctgaaatgatgggcgcatccgagatttacgtggaagacgtgcgtgaagaattcgtgcgcgatttcgtcttccccatgttccgcgccaatgcggtctatgaaggcctatacctgttgggcacctccatcgcgcgccctctgatttccaagcgccttgttgaaatcgccgccgaaaccggtgccgatgccgttgcgcacggcgcgacaggcaagggcaacgatcaggttcgtttcgaattggcggcctacgcgctgaaccccgacatcaaggtgatcgcgccatggcgggaatgggacctgtccagccggactaaattgatcgaatttgccgaaaaacatcagatccctgtggcgaaggacaaacgtggtgaagcgccgtttagcgtggacgcgaacctgctgcacacctcttcggaaggcaaagtgcttgaggatccggccgtggacgcgcccgactatgtgtaccagcgcacggtctcgccagagcaagcaccagatacgcccgagtatgtggaaatcgggtttgaacgtggcgatgcggtaagcatcaacggcgaagccatgtcgcccgcgacacttctggctaaattgaacgaacttggcggcaaacatggctgcgggcgccttgaccttgtcgagggtcgttttgtcgggatgaaatcccgcggtatttacgaaacgccgggcggcaccttgctgcttgaagcacaccgcgggatcgaatcgatcaccctcgaccgtggggcgatgcacctgaaggacgagctgatgccgcgctatgcggagctgatctataacggtttctggtacagccccgagcgcaccatgctgcaagcggcgattgatgcctcgcaaacccatgtaaccggtacagttcgactgaaattgtacaaaggccacgtgcgtaccgtcggccgctggtcggatcattcgctgtattccgaagcccacgtgacatttgaagatgatgctggggcctatgatcaaaaagacgcggcgggcttcattcagctgaacgcgctgcgtctcaagctcttggccgcacgcgataagcgcctcaaagggtaa

SEQ ID NO: 5322 - protein, 406 aa, Sulfitobacter sp. EE-36
MSAPKKVVLAYSGGLDTSIILKWLQTEYGCEVVTFTADLGQGEELEPARAKAEMMGASEIYVEDVREEFVRDFVFPMFRANAVYEGLYLLGTSIARPLISKRLVEIAAETGADAVAHGATGKGNDQVRFELAAYALNPDIKVIAPWREWDLSSRTKLIEFAEKHQIPVAKDKRGEAPFSVDANLLHTSSEGKVLEDPAVDAPDYVYQRTVSPEQAPDTPEYVEIGFERGDAVSINGEAMSPATLLAKLNELGGKHGCGRLDLVEGRFVGMKSRGIYETPGGTLLLEAHRGIESITLDRGAMHLKDELMPRYAELIYNGFWYSPERTMLQAAIDASQTHVTGTVRLKLYKGHVRTVGRWSDHSLYSEAHVTFEDDAGAYDQKDAAGFIQLNALRLKLLAARDKRLKG

SEQ ID NO: 5323 - DNA, 1227 bp, Roseovarius nubinhibens ISM
  CDS (1)..(1227): transl_table=11
atgtccgcgcccaaaaaagtcgttctggcctattccggtggcctcgatacctcgatcatcctgaaatggctgcaaaccgaatacggttgcgaagtggtgaccttcaccgccgatctcggccagggtgaagagcttgatcccgcccgcaagaaggcagagctgctcggcatcaatcccgacaatatctatatcgaggacatccgcgaggaattcgtccgcgatttcgtcttcccgatgttccgcgccaatgcgctctacgagggccagtatctgctcggcacctccatcgcccgcccgctgatctccaaacgtctggtcgagattgccgccgaaaccggcgccgatgccgtggcccatggcgccaccggcaagggcaatgatcaggtccggttcgaactcgcggcctatgcgctcaaccccgacatcaaggtgatcgccccctggcgcgaatgggatctcacctcgcggaccaagctgctggaatttgccgaggcgaaccagatcccgatcgccaaggacaagcgcggcgaagcccccttctcggtcgatgccaacctcctgcacacctcctccgagggcaaagtgctcgagaacccgggcgaagaggcccccgattacgtctatcagcgcaccgtctcccccgaggacgcgcccgacaccgccgagatcatcgagatcggctttgaacgcggcgacgcggtgagcatcaatggcgaggcgatgagccccgccaccctgctcacccgcctcaacgagctgggcggcaagcatggcatcggccgtctcgatttcgtcgaaaaccgctttgtcggcatgaaatcgcgcggcatctacgagaccccgggcggcaccgtgctgctcgaggcgcatcgcggcatcgaacagatcaccctcgacagcggcgcaggccatctcaaggacagcctgatgccccgctatgccgagctgatctacaacggtttctggtactcgcccgaacgcgaaatgctgcaggccgccatcgacaagagccaggaacatgtgaccggcaccgtccggatcaagctctacaaaggcgcggccacctgcatcgcccgctggtcggatcactcgctctattccgaggcccatgtgaccttcgaagaagacgccggtgcctatgatcagaccgacgcgcagggcttcattcagctcaacgcgctgcggctcaagcttctcgccgcccgcaagcgccgtctcggcagctaa

SEQ ID NO: 5324 - protein, 408 aa, Roseovarius nubinhibens ISM
MSAPKKVVLAYSGGLDTSIILKWLQTEYGCEVVTFTADLGQGEELDPARKKAELLGINPDNIYIEDIREEFVRDFVFPMFRANALYEGQYLLGTSIARPLISKRLVEIAAETGADAVAHGATGKGNDQVRFELAAYALNPDIKVIAPWREWDLTSRTKLLEFAEANQIPIAKDKRGEAPFSVDANLLHTSSEGKVLENPGEEAPDYVYQRTVSPEDAPDTAEIIEIGFERGDAVSINGEAMSPATLLTRLNELGGKHGIGRLDFVENRFVGMKSRGIYETPGGTVLLEAHRGIEQITLDSGAGHLKDSLMPRYAELIYNGFWYSPEREMLQAAIDKSQEHVTGTVRIKLYKGAATCIARWSDHSLYSEAHVTFEEDAGAYDQTDAQGFIQLNALRLKLLAARKRRLGS

SEQ ID NO: 5325 - DNA, 1224 bp, Oceanicola batsensis HTCC2597
  CDS (1)..(1224): transl_table=11
atgagcgcgccgaagaaagtcgtcctggcctattccgggggcctcgacacctcgatcatcctgaaatggctgcagaccgaatacggttgcgaggtcgtgaccttcaccgccgacctcggccagggcgaagagctcgaacccgcccgcaagaaggccgaattgctcggcatcagccccgagaacatctatatcgaagacatccgcgaggaattcacccgcgacttcgtcttcccgatgttccgcgccaatgccctctacgaggggctttacctgctgggcacctccatcgcccgccccctgatctccaagcggctggtcgagatcgccgaggaaaccggcgccgatgccgtcgcccacggggccaccggcaagggcaacgatcaggtgcggttcgagctttccgcctatgccctgaaccccgaaatcaaggtgatcgccccctggcgtgaatgggacctgacctcgcgcaccaggcttctggaatttgccgaggcgaaccagatcccgatcgccaaggacaagcgcggcgaggcgccgttctcggtcgatgcgaacctcctgcacacctcctccgagggcaaggtgctggaaaaccccgccgacgaggccccggattacgtcctgcagcgcatcacccgccccgaggacgcgccggaccagccggaattcgtcgagatcacgttcgagaagggggatgccgtcgccatcgacggtgaggccatgtcccccgccacgatcctgacgaagctgaacgagttgggcggcaagcacgggatcggcatcctcgacctggtcgagaaccgctttgtcggcatgaagtcccgtggcgtctacgagacccccggcggcaccgtcctgctcgaggcgcatcgcggcatcgaacagatcacgctcgacagcggcgcgggtcacctcaaggactcgatcatgccccgctacgcggaactcatctacaacggcttctggttctctcccgagcgcgagatgctgcaggccctgatcgacaagagccaggaacacgtctcgggcaccgtccggctgaagctctacaagggctccgcccgcaccgtcgcgcgctggtccgaccattcgctttattccgaagcccacgtgaccttcgaggaagacgccggcgcctacgaccagaaggacgcccagggcttcattcagctcaacgcgctgcgcttgaagcttctggccgcccgggaccggcggttgaaatag

SEQ ID NO: 5326 - protein, 407 aa, Oceanicola batsensis HTCC2597
MSAPKKVVLAYSGGLDTSIILKWLQTEYGCEVVTFTADLGQGEELEPARKKAELLGISPENIYIEDIREEFTRDFVFPMFRANALYEGLYLLGTSIARPLISKRLVEIAEETGADAVAHGATGKGNDQVRFELSAYALNPEIKVIAPWREWDLTSRTRLLEFAEANQIPIAKDKRGEAPFSVDANLLHTSSEGKVLENPADEAPDYVLQRITRPEDAPDQPEFVEITFEKGDAVAIDGEAMSPATILTKLNELGGKHGIGILDLVENRFVGMKSRGVYETPGGTVLLEAHRGIEQITLDSGAGHLKDSIMPRYAELIYNGFWFSPEREMLQALIDKSQEHVSGTVRLKLYKGSARTVARWSDHSLYSEAHVTFEEDAGAYDQKDAQGFIQLNALRLKLLAARDRRLK

SEQ ID NO: 5327 - DNA, 1203 bp, Prochlorococcus marinus str. MIT 9211
  CDS (1)..(1203): transl_table=11
atggaagttaaaaaagttgttcttgcttactctggaggcgtagacaccagttcctgtataccttatttgattaatgaatatggtgtcgaggaagtagtcgcttttgctgcagatcttggacaaggtgatgaacttgagccaattcgagaaaaagccctttctgcaggggcttctgaatgtttagtcgatgatttagtaaaaccctttattgaagattttgcctttccagcaattcgagctaatgccctttacgaagggaaataccctctttctacagctttagcaagaccattaatttctaaacgtttggtagatatagcaaaagagttggaagcagatgctgttgctcatggatgtactggcaaaggtaatgatcaagttcgttttgatatcgcgatagctacacttgcacctgaattaaaagttttaacgccagctagacaatggggtatgagccgtgaggaagttattgcctatggagagaggtatggcataccagctccagtcagtaagaaatctccttattcgatagatttaaatcttttaggaagaagtgttgaagctggtcctttggaagatatttcgttgagtcctcctgaagaggtttatcaaattacttcttctattgaaaatacgcctgatcaatcccaggaaatcgagattatttttgaaggtggtaaccctattgcaattgatggggttgaactagatcccctttctcttattgttcttgctaatcaattggcaggaaagcatggatttggtcgcatcgatatgattgaaaatagagttgttggaataaaaagtagagagatttatgaaactccaggcttacttttattaattaaagcgcatcaagaactggagagtttgactttgccagcggatgttttacgcacaaagtctacccttgaaacacaatgggctgacttggtatatcagggattatggtttagtcccttaaagaatgcattagatggatttatagatcgtactcaagatgaggttaatggctctgtaaaagtcaaattgcataaaggcaatgcaactattacgggacgaagctcttctcaaaatagtttatacttacccgatttttcaacttatgggagtcaagataaatttaaacatgacaatgctgaaggtttcatttatatatggggtttaccaagtaggttatgggctcaatctaaaaataaataa

SEQ ID NO: 5328 - protein, 400 aa, Prochlorococcus marinus str. MIT 9211
MEVKKVVLAYSGGVDTSSCIPYLINEYGVEEVVAFAADLGQGDELEPIREKALSAGASECLVDDLVKPFIEDFAFPAIRANALYEGKYPLSTALARPLISKRLVDIAKELEADAVAHGCTGKGNDQVRFDIAIATLAPELKVLTPARQWGMSREEVIAYGERYGIPAPVSKKSPYSIDLNLLGRSVEAGPLEDISLSPPEEVYQITSSIENTPDQSQEIEIIFEGGNPIAIDGVELDPLSLIVLANQLAGKHGFGRIDMIENRVVGIKSREIYETPGLLLLIKAHQELESLTLPADVLRTKSTLETQWADLVYQGLWFSPLKNALDGFIDRTQDEVNGSVKVKLHKGNATITGRSSSQNSLYLPDFSTYGSQDKFKHDNAEGFIYIWGLPSRLWAQSKNK

SEQ ID NO: 5329 - DNA, 1224 bp, Erythrobacter sp. NAP1
  CDS (1)..(1224): transl_table=11
atgtccgacatcaagcgcgtagtccttgcctattccggcggccttgacacttccgtcatcgccaagtggctgagtgtcgagcgcgggctcgaggtggtcaccttcaccgccgaccttggacagggcgaggagatcgagcctgcccgcgaaaaggcgcgcgccatgggcatcccggacgagcacatcttcatcgaggacctgcgcgaggagttcgtgcgcgatttcgtcttcccgatgatgcgcgcaaacgcccggtatgagggcgactacctgctcggcaccagcatcgcccgtccgctcatttccaagcgtctggtcgagatcgcgcatgagacgggcgccgacgccatcgctcacggcgcgaccggcaagggcaacgaccaggttcgctttgaactctccgcctacgcgctcgacccgagcatcaaggtcatcgctccctggcgcgaatgggacctcaccagccggaccgctctcatcgcatgggccgaagcgcatcagatcgcggtgcccaaggacaagcgaggcgaggcacctttctcgaccgacgcgaacctcttgcacacctcgtccgaaggcaaggtactcgaggatccgtgggaggagaccccggactacgtctactcgcgtaccgaccacccagagaacgcacccgacacgcctgaacacatcgagatcggcttcgagcgcggcgatggagtgtcgctgaacggtcaagcgatgagccctgcaaccctcctcaccgctttgaacgaccttggccgcaagcatggtatcggccggctcgacctcgtcgaaaaccgcttcgtcggtatgaagtcgcgcggcatgtacgagacaccgggcggcgagatctatgcccgcgcccatcgcggtatcgagcagatcactctcgaccgcggcgctgctcacctcaaggacgagctgatgccgaaatatgcggagctcatctacaatggcttctggttcgcgcccgagcgcgagatgctgcaggcggcaatcgacctcagccaggagaaggtgaccggcaccgtccgcctcaagctctacaaggggcaggccagcgtcgtgggccgcaagtcgccgcattcgctctattccgaagcgcacgtgacgttcgaggacgatgcgggcgcatacgaccagcacgatgccgaaggcttcattaagctcaatgcgctgcgcctcaagcttctggcaggccgggatcgcaagcgggactga

SEQ ID NO: 5330 - protein, 407 aa, Erythrobacter sp. NAP1
MSDIKRVVLAYSGGLDTSVIAKWLSVERGLEVVTFTADLGQGEEIEPAREKARAMGIPDEHIFIEDLREEFVRDFVFPMMRANARYEGDYLLGTSIARPLISKRLVEIAHETGADAIAHGATGKGNDQVRFELSAYALDPSIKVIAPWREWDLTSRTALIAWAEAHQIAVPKDKRGEAPFSTDANLLHTSSEGKVLEDPWEETPDYVYSRTDHPENAPDTPEHIEIGFERGDGVSLNGQAMSPATLLTALNDLGRKHGIGRLDLVENRFVGMKSRGMYETPGGEIYARAHRGIEQITLDRGAAHLKDELMPKYAELIYNGFWFAPEREMLQAAIDLSQEKVTGTVRLKLYKGQASVVGRKSPHSLYSEAHVTFEDDAGAYDQHDAEGFIKLNALRLKLLAGRDRKRD

SEQ ID NO: 5331 - DNA, 1206 bp, Synechococcus sp. RS9917
  CDS (1)..(1206): transl_table=11
atggggcgcgcgaagaaggtggtgctcgcctattcgggtggggtggataccagcgtctgcattccctacctgaagcaggagtggggcgtcgaggaggtgatcaccttcgctgccgatctcggacagggggatgaactggagcccatccggatcaaagcgctggaggccggggccagtcagtcgctggtgggcgatctgatcgatcccttcatccgcgagttcgcgtttccggccatccgtgccaatgcgctctatgaagggtgctatcccctctccaccgccctggcccgtcccttgatcgcccgccgactggtggaggtggcccgggaggtgggtgccgatgcggtggcccatggctgcaccgggaagggcaacgatcaggtgcggtttgatgtggcgatcgccgctctggctcccgatctcaaggtgctgactccggcgcgtgagtggggcatgagccgcgaggaaacgatcgcctacggcgagcgctgtggcatcccggcaccggtcagtaaacagtcgccctactcgatcgatctcaacctgctgggccgcagcgttgaggccggtcccctggaggatccgatggtggcaccgccggaggaggtgttcgcgatgacgcggccggtggccgacacccccgatgccgctgaggagattgagatcagttttgaggccggcaaccccgtggccatcaatggccagcgtctcgaccctgtggcgctgatccgggaggcgaatcgccttgccggccttcatggcatcggccgtctcgacatgatcgagaaccgggtcgtggggatcaagagccgcgagatctacgagaccccggggctgttgttgctgatccaggcccatcaggagctggaaagcctcaccctggcggcggatgtgctgcgcaccaagcgccagctggaaatgcagtgggcggatctggtgtatcaggggctctggttcggaccgctgaaagaagccctggatggcttcatggatcgcacccaggagcatgtgcacggagtggtgcggctgcgattgcacaagggctcggccatggtcaccggccgtgcctcctcaaccagcagcctctacgtgccggcgatggcgtcctacggcagtgaggatcagttcgaccatcgtgccgctgaggggttcatctatgtgtggggcctgccgatccggctctgggccgcagcgcgtcggcgttga

SEQ ID NO: 5332 - protein, 401 aa, Synechococcus sp. RS9917
MGRAKKVVLAYSGGVDTSVCIPYLKQEWGVEEVITFAADLGQGDELEPIRIKALEAGASQSLVGDLIDPFIREFAFPAIRANALYEGCYPLSTALARPLIARRLVEVAREVGADAVAHGCTGKGNDQVRFDVAIAALAPDLKVLTPAREWGMSREETIAYGERCGIPAPVSKQSPYSIDLNLLGRSVEAGPLEDPMVAPPEEVFAMTRPVADTPDAAEEIEISFEAGNPVAINGQRLDPVALIREANRLAGLHGIGRLDMIENRVVGIKSREIYETPGLLLLIQAHQELESLTLAADVLRTKRQLEMQWADLVYQGLWFGPLKEALDGFMDRTQEHVHGVVRLRLHKGSAMVTGRASSTSSLYVPAMASYGSEDQFDHRAAEGFIYVWGLPIRLWAAARRR

SEQ ID NO: 5333 - DNA, 1224 bp, Synechococcus sp. WH 5701
  CDS (1)..(1224): transl_table=11
atggcacaggagcagggcgccagggcaaagcgggtggtgctcgcctactccggcggggtggataccagtgtctgcattccctacctcaagcaggaatggggcgtggaggaggtgatcaccttcgccgccgatctcggccagggcgacgagttggagccgatccgccagaaggcgctcgactccggcgccagccagtcgatcgtgggggatctgatcgatcccttcatccgcgagttcgcgttccccgccatccgcgccaatgctctctacgaggggcgctatcccctctccacagccctggcccgtcccctgatcgcccgccggttggtggaggtggcgcgggagcagggcgccgatgccgttgcccatggctgcacgggcaaaggcaatgatcaggtgcgtttcgatgtggcgatcggtgccctggctcccgatctgaaggtgctcaccccggcgagggaatgggccatgagccgtgaggaaacgattgcctacggcgagcgctgcggcatcccggcgccggtgagcaagaagaatccctattcgatcgatctgaacctgctgggccgcagcatcgaggcgggtccgctggaggatccgatggtggagcctcccgaagaggtgtttgccatgacccgctcgatccgcgacaccccggatgagccccaggtggtggagatcagcttcgagcagggcaatccggtggcgattgatggcgtcagcctcgatccggtcggtgtgatccgccgcgcgaatgagcttgctggcctccatggcttcggccgcctcgacatcatcgagaacagggtggtggggatcaagtcaagagagatctatgaaacgccaggcctgctgctgctgatccgtgcccaccaggagctggagagcctcaccctggctgctgacgtggtgcgttacaagcgccagatcgaatccagctgggctgatctcgtctatcagggtctctggttcggtccactcaagcaggcccttgatggtttcctggattgcacccaggccacggtcaacggcgtggtgcgtctgcgcctgcacaagggcaatgcggtggtgatcggtcgtgccagcagcagcgacagcttgtatgtgcccgccatggccacctatggcagtgacgatcgcttcgatcaccgggccgccaagggattcatctatgtgtgggggatgcccacgcgcctctgggcggccagtcggcgtcaggcttga

SEQ ID NO: 5334 - protein, 407 aa, Synechococcus sp. WH 5701
MAQEQGARAKRVVLAYSGGVDTSVCIPYLKQEWGVEEVITFAADLGQGDELEPIRQKALDSGASQSIVGDLIDPFIREFAFPAIRANALYEGRYPLSTALARPLIARRLVEVAREQGADAVAHGCTGKGNDQVRFDVAIGALAPDLKVLTPAREWAMSREETIAYGERCGIPAPVSKKNPYSIDLNLLGRSIEAGPLEDPMVEPPEEVFAMTRSIRDTPDEPQVVEISFEQGNPVAIDGVSLDPVGVIRRANELAGLHGFGRLDIIENRVVGIKSREIYETPGLLLLIRAHQELESLTLAADVVRYKRQIESSWADLVYQGLWFGPLKQALDGFLDCTQATVNGVVRLRLHKGNAVVIGRASSSDSLYVPAMATYGSDDRFDHRAAKGFIYVWGMPTRLWAASRRQA

SEQ ID NO: 5335 - DNA, 1206 bp, Synechococcus sp. WH 7805
  CDS (1)..(1206): transl_table=11
atgggacgcgccaagaaggttgtgcttgcttattccggcggcgtggatacgagtgtctgcattccgtatctcaagcaggagtggggtgtcgaggaggtgatcacgtttgcagctgatctcggccagggcgatgagctggagccgattcggcgcaaggctctcgatgccggtgccagtcagtctcttgtgggcgatctcattcggccgttcatcgaagaattcgcctttcccgccatcagggccaatgccctctatgagggtcgctatcccttgtcgaccgctttggcacgtccgttgatcgcccggcggcttgtggaggtggcgcgcgaggtcggtgcggatgcagtagcccatggatgcaccggtaagggcaatgatcaggtgcggtttgatgtggcgattgccgctttggctcccgatctgaaggtgctcacgccggccagggaatggggaatgagcagggaggaaacaattgcctatggcgaacgttgcggccttccagcgccggtgagcaagaaatctccctactcaatcgatctcaatcttctcggccgcagtattgaagccggtcctttggaagatccgatgcaggctcctccagaagaggtgttcgccatgacggtgtcgattgatgcggcaccctcagcggcagaggagatcgagatcgcattcgaagctggtgatccggtgagcatcaacggccagcgtttggatcctgtcgccttgatccgagaagccaaccgtttggctggatcccatggcatcggtcgcctcgacatgatcgagaaccgggtggtgggcatcaagagtcgggagatttatgaaacgcccggtttgcttttgctgatccaggcccatcaggaactggagagtctcaccctcgcagctgatgtgctccgcaccaagcgacaactggagatgcagtgggctgatctggtgtatcagggactgtggttcggtccgctcaaggacgccctcgatggcttcatggaccgcacccagacccatgtgaacggtgtggtccggctgcgtctgtataagggcaatgccattgtcaccggcagggggtccagcgatagcagcctctacgctccagaaatggcgtcctacggcagcgaggatcagttcgatcatcgcgctgccgaagggtttatctacatctggggtcttcccattcgtctctggtcagcagcccgccgtcgttga

SEQ ID NO: 5336 - protein, 401 aa, Synechococcus sp. WH 7805
MGRAKKVVLAYSGGVDTSVCIPYLKQEWGVEEVITFAADLGQGDELEPIRRKALDAGASQSLVGDLIRPFIEEFAFPAIRANALYEGRYPLSTALARPLIARRLVEVAREVGADAVAHGCTGKGNDQVRFDVAIAALAPDLKVLTPAREWGMSREETIAYGERCGLPAPVSKKSPYSIDLNLLGRSIEAGPLEDPMQAPPEEVFAMTVSIDAAPSAAEEIEIAFEAGDPVSINGQRLDPVALIREANRLAGSHGIGRLDMIENRVVGIKSREIYETPGLLLLIQAHQELESLTLAADVLRTKRQLEMQWADLVYQGLWFGPLKDALDGFMDRTQTHVNGVVRLRLYKGNAIVTGRGSSDSSLYAPEMASYGSEDQFDHRAAEGFIYIWGLPIRLWSAARRR

SEQ ID NO: 5337 - DNA, 1209 bp, Pseudoalteromonas tunicata D2
  CDS (1)..(1209): transl_table=11
atgagttcaattaaaaaggtcgttttagcgtattcaggcggtttagatacatcggcgattgtaccttggttaaaagagaactatcactgtgaagtaattgcatttgttgccgacgttggccaaggcgcagaagaattagaaggcgttgaagcaaaagctatcgcctctggtgcttcagagtgttatatcgtcgatttaaaagaagaaatggtcgcagagtatatttacccaaccttaaaaaccggtgcaatttacgaaggaacctatttattagggacttcaatggcgcgtccaattattgccaaagcacaagttgaaattgcgcgtaaagtgggcgctgatgctcttgctcatggttgtacaggtaaagggaatgatcaggttcgttttgaagggtgttttgcggctttagctcctgatttaaaagtaatagctccttggcgtgaatgggatttaaccagtcgtgagtcgctgcttgattatttagctgagcgaaatattccatgcgcagcatcggcaaccaaaatttatagtcgagatgccaatgcatggcatatttcacatgaaggtggtgagcttgaaaatccttggaatcaaccaagtgagcaagtttggatgtggactaactcaccagagcaagcgccaaatgaagcccaatacgtgacattaagtgttgaaaaaggtcaagttgtcgcggttaatggtgaatcactcagcccatatcaatgtgtagttaaactcaatgaaattgcttcggtgcatggcgtaggcagggttgatatcgttgaaaaccgtttagtgggcatgaaatcacgcggctgttatgaaaccccaggtggcacagttattatggctgcacttcaagcaattgatgaattggtacttgataaagcaagccgtaaatggaaagccacgttaggcggcgagttttcacatttagtatatgatggtcgttggtttacgccgctaaaagattcggtacttgcaggtgctgaggcactagcccaatgtgctactggcgaagtggttcttaaactttacaagggccaagtcacagcggtacaaaaacaatctccaaatagtctttatagcgaagcatttgccacctttggtgctgatgatgtgtatgaccaatctcacgcagaaggttttattcgtttgtattcgttagcaagtcgtatttcggcgttaaacaaaagcacgaaataa

SEQ ID NO: 5338 - protein, 402 aa, Pseudoalteromonas tunicata D2
MSSIKKVVLAYSGGLDTSAIVPWLKENYHCEVIAFVADVGQGAEELEGVEAKAIASGASECYIVDLKEEMVAEYIYPTLKTGAIYEGTYLLGTSMARPIIAKAQVEIARKVGADALAHGCTGKGNDQVRFEGCFAALAPDLKVIAPWREWDLTSRESLLDYLAERNIPCAASATKIYSRDANAWHISHEGGELENPWNQPSEQVWMWTNSPEQAPNEAQYVTLSVEKGQVVAVNGESLSPYQCVVKLNEIASVHGVGRVDIVENRLVGMKSRGCYETPGGTVIMAALQAIDELVLDKASRKWKATLGGEFSHLVYDGRWFTPLKDSVLAGAEALAQCATGEVVLKLYKGQVTAVQKQSPNSLYSEAFATFGADDVYDQSHAEGFIRLYSLASRISALNKSTK

SEQ ID NO: 5339 - DNA, 1209 bp, Photobacterium sp. SKA34
  CDS (1)..(1209): transl_table=11
atgagcaagattaataaagttgtattagcctattctggcggtttagatacatcggctatcattccatggttgaaagaaaactatgattgtgaagttgtcgcattcgtagctgatgtgggtcaaggcgaagaagagctggttggtattgaagaaaaagcattggcttcaggagcttcatcttgttacatcgccgatcttaaagaagagatggtgaaagattatatctacccatccttaaaaaccggtgctgtgtacgaaggtaaatacctactgggtacttcaatggcgcgtccaattattgctaaagcacaagttgaatgtgcattggaatttggtgcagatgcgttatgtcatggatgtactggtaaaggtaacgatcaggtacgttttgaaggtgcatttgccgcactagcaccacagcttaaagtaattgctccttggcgtgaatgggatctacgtagtcgtgaagcgctattagattaccttgctgagcgtgatattccatgtacggcatcgcttgaaaaaatttactctcgtgatgcgaatgcatggcacgtatcaacagaaggtggggtgttagaagatacatggaatgcacccaacgatttatgttgggtatggacaaaagatccagaacaagcgccggatcaagcggaaacagtcacgctactgattgaacaaggtgaagtcgttgcggttgatggtgaagcgatgacgccatacaacgtgctaacgtacctgaatgaaaaaggtatcgatcacggtgttggtcgtatcgatattgtagaaaaccgtctagtcggtatgaagtctcgtggttgttatgaaacacccggagggacgattatgatggaagcgctacgtgcggtagagcagctagtactcgataaagaatcgttcgatttccgtcaaacattgggtcttaaagcgtcacaccttatctatgatggtcgttggttcacgccattatgtcagtcattaattgcagctgctgatgagttagcaaaagatgtgagtggtgaagtggtcgttaagctgtacaaaggtcaagcaaccgtgactcagaagcgctcaactaacagcttatattctgaagagtttgcgacctttggtgaagatgatgtttatgatcacagccatgctggcggtttcattcgtctttactcactagcaagtcgtattcgtgctttaaatagccaaaagaaataa

SEQ ID NO: 5340 - protein, 402 aa, Photobacterium sp. SKA34
MSKINKVVLAYSGGLDTSAIIPWLKENYDCEVVAFVADVGQGEEELVGIEEKALASGASSCYIADLKEEMVKDYIYPSLKTGAVYEGKYLLGTSMARPIIAKAQVECALEFGADALCHGCTGKGNDQVRFEGAFAALAPQLKVIAPWREWDLRSREALLDYLAERDIPCTASLEKIYSRDANAWHVSTEGGVLEDTWNAPNDLCWVWTKDPEQAPDQAETVTLLIEQGEVVAVDGEAMTPYNVLTYLNEKGIDHGVGRIDIVENRLVGMKSRGCYETPGGTIMMEALRAVEQLVLDKESFDFRQTLGLKASHLIYDGRWFTPLCQSLIAAADELAKDVSGEVVVKLYKGQATVTQKRSTNSLYSEEFATFGEDDVYDHSHAGGFIRLYSLASRIRALNSQKK

SEQ ID NO: 5341 - DNA, 1227 bp, Oceanospirillum sp. MED92
  CDS (1)..(1227): transl_table=11
atgtccgagatcaaaaaggtcgttctggcctactccggtggattggatacttccgttatcgttcgctggttacaagatgaatacaacgcagaagttgttacttttactgctgacctgggtcagggtgaagaggttgagcctgcgcgtgccaaagcagaagctctgggtgtaaaagaaatttacatcgaagacctgcgtgaagagtttgtacgtgatttcgtattcccaatgttccgtgcaaacacaatctatgaaggcgagtaccttctgggtacttctatcgcacgcccgttaattgcaaaacgtctgattgaaattgcaaacgaaacgggtgctgatgcgatttctcacggtgcaacaggtaaaggtaatgaccaggttcgcttcgagttgggtgcttatgcgctgaaaccgggtgtacacgtgattgcgccatggcgtgaatgggatctgacttcccgtgagacgctgatgaaatactgtgaagatcataatatcccagttgatttctcaagcagcaagaagaaatctccgtactcaatggatgctaacctgcttcatatctcttatgagggtgatattcttgaagatccatggcaggaagctgaagaggatatgtggcgctggtccgtttctcctgagcaagctccagatgaacctacttatctggaactgacttacgagaagggtgatatcgttgcgatcaatggcgagaaaatgagcccggctactgttcttgaatacctgaacaaggtgggtggcgagaatggtatcggtcgtttggatatcgttgaaaaccgcttcgttggcatgaaatctcgtggttgttatgaaacaccgggcggaacgattatgctgcgtgctcaccgcgctatcgaatcaatcacgcttgaccgtgaagcagcgcacctgaaagatgagctgatgccacgctacgcgaaagtaatctacaacggcttctggtggtcagaagagcgtaagatgctgcagaagatgatcgatgagtcccagcaggttgttaacggtgatgttcgcctgaagctgtacaaaggcaatgtggttgtcgtgggtcgtcgttctgaagatagcttgtttgatgaaaacattgcgacttttgaagatgatgcgggttcttacgaccagaaagatgccgctggctttatcaagctgaacgcattgcgtatgcgtattgctgctggcaaagggcgtaatcttctcgacgattaa

SEQ ID NO: 5342 - protein, 408 aa, Oceanospirillum sp. MED92
MSEIKKVVLAYSGGLDTSVIVRWLQDEYNAEVVTFTADLGQGEEVEPARAKAEALGVKEIYIEDLREEFVRDFVFPMFRANTIYEGEYLLGTSIARPLIAKRLIEIANETGADAISHGATGKGNDQVRFELGAYALKPGVHVIAPWREWDLTSRETLMKYCEDHNIPVDFSSSKKKSPYSMDANLLHISYEGDILEDPWQEAEEDMWRWSVSPEQAPDEPTYLELTYEKGDIVAINGEKMSPATVLEYLNKVGGENGIGRLDIVENRFVGMKSRGCYETPGGTIMLRAHRAIESITLDREAAHLKDELMPRYAKVIYNGFWWSEERKMLQKMIDESQQVVNGDVRLKLYKGNVVVVGRRSEDSLFDENIATFEDDAGSYDQKDAAGFIKLNALRMRIAAGKGRNLLDD

SEQ ID NO: 5343 - DNA, 1230 bp, Xanthobacter autotrophicus Py2
  CDS (1)..(1230): transl_table=11
atggcgcgtgacgtgaagaaggtggtgctggcctattccggtggcctcgacacctccgtgatcctgaaatggctccagaccacctacaagtgcgaggtgatcaccttcaccgccgatcttgggcagggcgaggagctggagccggcgcgcaagaaggcgcagctgctcggcatcaaggacgaaaacatcttcatcgaggacgtgcgcgaggaattcgtcgccgagtacgtcttccccatgttccgcgccaatgcggtctatgaagggctgtaccttctgggcacctccatcgcccggcccctgatcgccaagaagcagatcgagatcgcccgcaagatgggcgccgacgccgtctcccacggcgccaccggcaagggcaacgaccaggtacgcttcgagctcggctattatgcgctggagccggagatcaccgtcatcgccccctggcgcgagtgggatctgacctcccgcacccgcctgctggagttcgccgagcagcaccagatcccgatcgccaaggacaagcgcggcgaggccccgttctcggtggacgcgaacctcctgcactcctcctccgagggcaaggtgctggaagacccggccgaggacgcgccggaatacgtctaccagcgcaccatttcccccgaggccgcccccgacgagcccaccatcatcaccatcgccttcgacaagggcgatgcggtggccatcaacggcgaggcgctctcccccgccaccctgctgaccaagctcaacgagctgggcaaggccaacggcatcggccggctcgacctcgtggaaaaccgcttcgtgggcatgaagagccgcggcgtctacgagacccccggcggcaccatcctgctcgccgcccatcgcggcatcgagagcatcacgctcgatcgcggcgcggcccacctcaaggacgagctgatgccccgctatgcggagctgatctacaacggcttctggttctcccccgagcgggagatgctgcaggccgccatcgaccactcccaggcctatgtgaccggcgaagtgacggtgaagctctacaagggcaacaccacggtcatcggccgcaaaagcccctattcgctctacaatcaggaactggtcaccttcgaggaaggcgcggtcgcctacgaccaccgcgacgcggcgggcttcatcaagctcaacgccctgcgcctgcgcaccctcggcagccgggcccgcaagatctcggagtga

SEQ ID NO: 5344 - protein, 409 aa, Xanthobacter autotrophicus Py2
MARDVKKVVLAYSGGLDTSVILKWLQTTYKCEVITFTADLGQGEELEPARKKAQLLGIKDENIFIEDVREEFVAEYVFPMFRANAVYEGLYLLGTSIARPLIAKKQIEIARKMGADAVSHGATGKGNDQVRFELGYYALEPEITVIAPWREWDLTSRTRLLEFAEQHQIPIAKDKRGEAPFSVDANLLHSSSEGKVLEDPAEDAPEYVYQRTISPEAAPDEPTIITIAFDKGDAVAINGEALSPATLLTKLNELGKANGIGRLDLVENRFVGMKSRGVYETPGGTILLAAHRGIESITLDRGAAHLKDELMPRYAELIYNGFWFSPEREMLQAAIDHSQAYVTGEVTVKLYKGNTTVIGRKSPYSLYNQELVTFEEGAVAYDHRDAAGFIKLNALRLRTLGSRARKISE

SEQ ID NO: 5345 - DNA, 1197 bp, Flavobacteria bacterium BBFL7
  CDS (1)..(1197): transl_table=11
atgaacaataataaaaaattagtaatagcatatagtggcggactggacacctcatattgtgccgtatacctttcacaagatctaggttatgaggttcatgcggtgtgtgtaaatacaggtggttttactcaagaagatcttaaaactatagaatctaacgcttataaaatgggcgtgagcacttttaaagccatagacgcagtaagcactttttatgataaagtcgttaagtatttgatttatggaaatgtattaaagaataatacctatccgctatcggtaagtgcagagcgtattgtgcaagccattgagattatagaatatgcaaaaaccatagacgcacaatttatagctcatggaagtactggtgcaggaaatgatcaagtgcgttttgatatgatttttcaaactctagcaccacatatagaaattattacacctataagagatggtaaactatcacgtaaacaagagatagattatctcaaagaaaatggaatagccatgtcttgggaaaaatctcaatattctgtaaataaaggactgtggggaactagtgtaggtggtgcagaaacactgacctcgctcaaggcattaccagaagaagcttatccatcacaacttcaaaaagaaggaaaggaacaagtaaaactggcctttaaaaaaggagaattaattgcagtaaatgggaaagagcaatcttcagaattggtgatacaacaactcaatgaccttgcttcttcatatgctataggtagagatatccatgtaggcgataccatagtaggtatgaaaggtagagtcggttttgaagccgcagcagcgttgattactataaaagcacaccatttattagaaaaacacacacttactaagtggcagttacaacacaaagattatctgtctagtttttacggtatgcacctgcatgaaggtcagtacctcgatcctgtaatgcgtgacatagagacttttctagaaagtagtcagtctaaggttactggagatgtttatgtcactttacaaccttatcactttactctggacggtatagaatcggtaaacgatttaatgaatgcaaaattcggtacttatggagaggagaataaagcatggacagcaagtgaggccataggttttatcaagatcataggaaacagcaataagatttataaccagatacatcaagaatcatga

SEQ ID NO: 5346 - protein, 398 aa, Flavobacteria bacterium BBFL7
MNNNKKLVIAYSGGLDTSYCAVYLSQDLGYEVHAVCVNTGGFTQEDLKTIESNAYKMGVSTFKAIDAVSTFYDKVVKYLIYGNVLKNNTYPLSVSAERIVQAIEIIEYAKTIDAQFIAHGSTGAGNDQVRFDMIFQTLAPHIEIITPIRDGKLSRKQEIDYLKENGIAMSWEKSQYSVNKGLWGTSVGGAETLTSLKALPEEAYPSQLQKEGKEQVKLAFKKGELIAVNGKEQSSELVIQQLNDLASSYAIGRDIHVGDTIVGMKGRVGFEAAAALITIKAHHLLEKHTLTKWQLQHKDYLSSFYGMHLHEGQYLDPVMRDIETFLESSQSKVTGDVYVTLQPYHFTLDGIESVNDLMNAKFGTYGEENKAWTASEAIGFIKIIGNSNKIYNQIHQES

SEQ ID NO: 5347 - DNA, 1218 bp, gamma proteobacterium HTCC2207
  CDS (1)..(1218): transl_table=11
gtgtcatcagttaataaagttgttttagcctactccggtggattagatacctcggttatcgtcaaatggttgcaggaagaatataactgcgaagtcgttaccttcactgccgatatcggccagggtgaagaagtcgaacccgctcgcgccaaggctgaagctttgggcgtaaaagaaatttatattgatgatctacgcgaagaatatgctcgcgattttgtcttccccatgttccgtgccaacacaatttatgagggcgagtatctgctcggcacctctattgcccgtccgttgattgccaagagactgatcgaaattgccaatgaaactggcgccgacaccatatcccatggcgctactggcaagggcaatgatcaggtgcgttttgaactgggtgcctatgcgctaaagccaggcattaaagtgattgccccgtggcgagagtgggatctgaattcccgcgacaagctaatggaatactgtgaaaagcacagcattccggttgagatgaagcgtggcaaaaaatcccccttctccatggacgcgaacttgctgcacatctcctacgagggtggcaacttggaagacccttggtccgaagctgaagacgatatgtggcgttggacggttgctccagagcaggcccccgatgaagcttgttatatgaatatcagctatgagaagggcgatatagttgctattgatggcgaagccatgtctccggccacggttattgaatacttaaataaggttgccggcgctcacggtgttggccgtctagatatagttgagaaccgctatgtgggtatgaagtcacgcggctgttacgagacaccagcaggcactgtgatgatgaaggcgcaccgcgctatcgaatccatcacccttgatcgcgaagtggcgcatatgaaagatgagttgatgccgcgctacgccaagttaatttataacggttactggtgggcacctgagcgtctgatgttgcaaaccgctatagatcaaagtcaggatgttgttaacggtgatgtgcgcattaagctctacaaaggcagtgtgagtgttgttggccgcaagtcagatgacagtctgttcgatgccaatatagccacctttgacgatgatggcggtgcctataaccaagccgacgctgaaggctttattaagcttaatgcactgcgtttgcgtattgctgctaataagggtcgcgatattctgtaa

SEQ ID NO: 5348 - protein, 405 aa, gamma proteobacterium HTCC2207
MSSVNKVVLAYSGGLDTSVIVKWLQEEYNCEVVTFTADIGQGEEVEPARAKAEALGVKEIYIDDLREEYARDFVFPMFRANTIYEGEYLLGTSIARPLIAKRLIEIANETGADTISHGATGKGNDQVRFELGAYALKPGIKVIAPWREWDLNSRDKLMEYCEKHSIPVEMKRGKKSPFSMDANLLHISYEGGNLEDPWSEAEDDMWRWTVAPEQAPDEACYMNISYEKGDIVAIDGEAMSPATVIEYLNKVAGAHGVGRLDIVENRYVGMKSRGCYETPAGTVMMKAHRAIESITLDREVAHMKDELMPRYAKLIYNGYWWAPERLMLQTAIDQSQDVVNGDVRIKLYKGSVSVVGRKSDDSLFDANIATFDDDGGAYNQADAEGFIKLNALRLRIAANKGRDIL

SEQ ID NO: 5349 - DNA, 1212 bp, delta proteobacterium MLMS-1
  CDS (1)..(1212): transl_table=11
atgctacctaaagtcaacaaaatcgtcctggcctactccggtggtctggatacctcggttattctgcgctggctcaaggagacctgccagtgcccggtgatcgcctacgccgccgatatcggccagaccgaagactgggaggcggtgcgggccaaggggttggccaccggcgccgacgaggtggtgatcgccgatctcaaggaagagtttgtccgcgattatgtcttcccggccttccgggccaacgccatctatgaaggttcctacctgctgggcacctccctggcccggccggtgatcgccaaggagcaggtgcggttggccgaagtccatggggccgatgcggtcagccacggcgccaccggcaagggcaacgaccaggtccgcttcgagcttggctacatggctttgaaccccgatttgcagatcatcgccccctggcgcgtctgggatctcaattcccgccgcaagttgatggcctatgccgaaaagcatggtatcccggtgccggtgagccacgaaaaaccttacagttccgatgaaaatctgctgcatatcagctttgaaggcggggtattggaagatccctggcaggagccggaagagaggatgtttcagctctcggtttccccggagcaggccccggataagcccacctatatcgagctggagtttgccggcggcaacccggtggccatcgacggggaaagactggcgccggccgccatgctggcccggctcaaccaattgggggggcaaaacggcatcggccggctggatatggtggagaatcgctttgtcggcatgaagtcccgtggcgtttatgaaaccccgggcgggaccatcctgcgctgcgcccatcgcgatctcgagaccatcaccctggatcgcgaggtgatgcggatccgtgattccctggtgccccgctattcggagttgatctacaacggcttctggttcgccccggagatgcaactgctgcaaagcaccatggaccagacccaggccacggtcaacggggtggtacggctcaagctctacaagggcaactgcctgccggtgggtcgcaagtccgacaactccctgtatcaggagagcttcgccacctttgaagaggacagcgtctatcaccaggccgacgccgaaggttttatccgcctgcaggggctacgcctcaggatgcaggccctgcggggggagattaacaggtga

SEQ ID NO: 5350 - protein, 403 aa, delta proteobacterium MLMS-1
MLPKVNKIVLAYSGGLDTSVILRWLKETCQCPVIAYAADIGQTEDWEAVRAKGLATGADEVVIADLKEEFVRDYVFPAFRANAIYEGSYLLGTSLARPVIAKEQVRLAEVHGADAVSHGATGKGNDQVRFELGYMALNPDLQIIAPWRVWDLNSRRKLMAYAEKHGIPVPVSHEKPYSSDENLLHISFEGGVLEDPWQEPEERMFQLSVSPEQAPDKPTYIELEFAGGNPVAIDGERLAPAAMLARLNQLGGQNGIGRLDMVENRFVGMKSRGVYETPGGTILRCAHRDLETITLDREVMRIRDSLVPRYSELIYNGFWFAPEMQLLQSTMDQTQATVNGVVRLKLYKGNCLPVGRKSDNSLYQESFATFEEDSVYHQADAEGFIRLQGLRLRMQALRGEINR

SEQ ID NO: 5351 - DNA, 1218 bp, Oceanobacter sp. RED65
  CDS (1)..(1218): transl_table=11
atgtcagacatcaataagatcgtattggcttactctggtggattggacacttcggtcatcgcgaaatggctacaagaagagtacaacgccgagattgttacttttaccgcagaccttggtcagggtgaagagttggagccagcccgcaaaaaagccgaagccatgggcattaaagagatctttattgatgacttgcgagaagaattcgcacgtgacttcgtatttccaatgttccgcgcaaacgcaatctatgaaggtgagtattacttaggtacttctattgctcgccctttaattgcgaagcgtttaattgaaatcgcaaatgaaacgggtgcggatgccatcgctcacggtgctactggtaaaggtaatgaccaagtgcgtttcgagctgggtgcgtatgcattgtcacctaacatccaggtaattgcgccttggcgcgagtgggatttgaattcccgtgaaaaactcatggcctattgtgaagagcacaatattccagttgagaacaagcaaggtaaaaagtcgccgtattccatggacgcgaacctgcttcatatctcctatgagggtgatttaattgaagatccttgggctgagcctgaggaagatatgtggttatggaccaagtcgccagaggcggcgccagatgagccaacttacattgaattgacatacaagcagggcgatatcgtggcgattgatgataaagccatgtccccagcggaagtcatggaacacttaaacaaagtggcgggtgaaaatggtatcggtcgtaccgatattgtagaaaatcgctatgtgggtatgaaagcgcgtggttgttacgagacgccagcgggttttgtaatgcttaaagcacaccgtgctatcgagtcgattactctggaccgagatgccgcgcacttgaaagatgaaatgatgcctcgctatgcagagttgatctacaacggttactggtggagccctgagcgcaagatgcttcaagcggcaatcgatcaaacccaggaaaacgttaacggtaaagttcgtttgaagctgtacaaaggcaatatcattgttgtgggtcgtaccagtgacgagtctttatttgatgagaagattgcaacgtttgaagatgatgcaggttcttatgatcaaaaagacgctgcgggctttatcaagttaaacgcattgcgtttgcgtgttgctgctaagaagggccgcaaactactataa

SEQ ID NO: 5352 - protein, 405 aa, Oceanobacter sp. RED65
MSDINKIVLAYSGGLDTSVIAKWLQEEYNAEIVTFTADLGQGEELEPARKKAEAMGIKEIFIDDLREEFARDFVFPMFRANAIYEGEYYLGTSIARPLIAKRLIEIANETGADAIAHGATGKGNDQVRFELGAYALSPNIQVIAPWREWDLNSREKLMAYCEEHNIPVENKQGKKSPYSMDANLLHISYEGDLIEDPWAEPEEDMWLWTKSPEAAPDEPTYIELTYKQGDIVAIDDKAMSPAEVMEHLNKVAGENGIGRTDIVENRYVGMKARGCYETPAGFVMLKAHRAIESITLDRDAAHLKDEMMPRYAELIYNGYWWSPERKMLQAAIDQTQENVNGKVRLKLYKGNIIVVGRTSDESLFDEKIATFEDDAGSYDQKDAAGFIKLNALRLRVAAKKGRKLL

SEQ ID NO: 5353 - DNA, 1206 bp, Desulfitobacterium hafniense DCB-2
  CDS (1)..(1206): transl_table=11
atgaaaaaggtagtgcttgcgtattccggaggattagatacctcgatcatcatcccttggctgaaagagaattatggctatgaagtcattgctatggccgctgacctgggacaaggagaagagctggagcctctccacgaaaaagcgattaagagcggagccagtaaattatatatcgaagatctgcaagaagaattcgttactgatttcatctaccccaccctaaaagccggagctgtctatgaaggcaaatatcttttgggaacctcctttgcccgtcccctgattgcccaacgtttagtagagattgcggcaaaagagggagctgtggccattgctcacggtgccacgggaaaaggaaacgaccaggttcgctttgagctggctgtcaaagccttaaatcctgatctggagatcatagctccttggcggatttgggatatcaagtcccgggaagatgctattgactatgctgttgagaggggaattcctgtccctgtaacgaaagatcgcccttacagtatggaccgcaatgtctggcatctcagccatgaaggaggcgatttagaagatccttggaatgagcccaaaaaggatctctatctccttggggtttcaccggaagatgctcccgacgaagccgagtacctggaactggattttgaacaaggtattcctgtttctttaaacggagaaaagttaggtcctgttcagcttttggagactctcaatgaggttggcggcaaacacggcattggcattgtggacatggtggaaaaccgcttagtaggaatgaaatcccggggggtttatgagactcccggtggtaccattctctatacagctcatcaagccctggaacatttgaccttggatcgtttgacccttcattataaggagcaaatcgccctgaaatacgctgaattggtttacgacggcgtttggcattctcctttgcgggaagccctggatgccttcgtggatgttacccagaaaaatgtcaccggaacggtacgcctgaagctttataaaggcaattgcagcttagccggtgtgaaatccccctactccctctatagtgaagaatttgctaccttcggacgggatggggtctataaccaaaaggatgctgaaggtttcatcaatctcttcggtcttcctcttaaagtaagagcgttaatggaaaagaaatcagggttgagataa

SEQ ID NO: 5354 - protein, 401 aa, Desulfitobacterium hafniense DCB-2
MKKVVLAYSGGLDTSIIIPWLKENYGYEVIAMAADLGQGEELEPLHEKAIKSGASKLYIEDLQEEFVTDFIYPTLKAGAVYEGKYLLGTSFARPLIAQRLVEIAAKEGAVAIAHGATGKGNDQVRFELAVKALNPDLEIIAPWRIWDIKSREDAIDYAVERGIPVPVTKDRPYSMDRNVWHLSHEGGDLEDPWNEPKKDLYLLGVSPEDAPDEAEYLELDFEQGIPVSLNGEKLGPVQLLETLNEVGGKHGIGIVDMVENRLVGMKSRGVYETPGGTILYTAHQALEHLTLDRLTLHYKEQIALKYAELVYDGVWHSPLREALDAFVDVTQKNVTGTVRLKLYKGNCSLAGVKSPYSLYSEEFATFGRDGVYNQKDAEGFINLFGLPLKVRALMEKKSGLR

SEQ ID NO: 5355 - DNA, 1206 bp, Synechococcus sp. RS9916
  CDS (1)..(1206): transl_table=11
atgggccgtgcgaagaaggtcgtgctcgcctattccggtggagtggatacgagtgtctgcattccttatctgaagcaggaatggggcgtcgaggaggtgattaccttcgctgcagacctcggccagggcgatgagctcgagcccatccgtctgaaggctctggaggctggtgcgagccagtcgctggtcggcgatctgattgagcccttcattcaggagttcgcgttccctgcgattcgggccaatgctctgtacgaagggcgttatcccctgtcgacagccctggctcgtcccttgattgcccgtcgattggtggaggtggcccgcgaggtgggtgctgatgccgttgcccatggctgcactggtaagggcaacgaccaggtgcgttttgatgtggcgatcgcggcactcgcccctgacctcaaggtgctgaccccagcccgggagtggggcatgagccgtgaggagacgatcgcttacggcgagcgttgtggcattcccgcgccggtcagcaagaaatctccttattccatcgatttgaacctgctgggccgcagcatcgaggccggccccctggaagatcccatggtggcgccgccggaagaggtgtttgccatgacccgctcggtggctgacactcccgatgcttcggaagagattgaaatcagcttcgagggcggtaatcccgttgccatcaatggtcagcgtctagaccctgttgctctgatccgtgaggccaatcgtctggcgggaacccacggcattggccgtctcgacatgatcgagaaccgtgtggtggggatcaagagccgcgagatttacgaaaccccaggcctgttgctgctgattcaggcgcaccaggagctggagagcctcacgcttgccgctgatgtgctgcgcagtaagcgtcagttggagatgcaatgggctgacctggtgtatcagggcctctggttcggtccgctcaaggacgctctcgacggcttcatggaccgcacccaggtgcacgtcaacggtgttgtccgtctgcgtctgcacaagggcacagccaccgtcatcggtcgcgcatcagccgagagcagcctgtacgtgccggccatggcgtcctatggcagcgaggatcagtttgatcaccgtgcggctgagggcttcatctacgtctggggattgcccacccgtctctgggctgcaacccaccgcggctga

SEQ ID NO: 5356 - protein, 401 aa, Synechococcus sp. RS9916
MGRAKKVVLAYSGGVDTSVCIPYLKQEWGVEEVITFAADLGQGDELEPIRLKALEAGASQSLVGDLIEPFIQEFAFPAIRANALYEGRYPLSTALARPLIARRLVEVAREVGADAVAHGCTGKGNDQVRFDVAIAALAPDLKVLTPAREWGMSREETIAYGERCGIPAPVSKKSPYSIDLNLLGRSIEAGPLEDPMVAPPEEVFAMTRSVADTPDASEEIEISFEGGNPVAINGQRLDPVALIREANRLAGTHGIGRLDMIENRVVGIKSREIYETPGLLLLIQAHQELESLTLAADVLRSKRQLEMQWADLVYQGLWFGPLKDALDGFMDRTQVHVNGVVRLRLHKGTATVIGRASAESSLYVPAMASYGSEDQFDHRAAEGFIYVWGLPTRLWAATHRG

SEQ ID NO: 5357 - DNA, 1215 bp, Vibrio sp. Ex25
  CDS (1)..(1215): transl_table=11
atgagcaaagtgaacgtaaataaagtggtagtcgcatactcaggcggtctagatacctcagtaattatcccgtggctaaaagagaactacgattgtgaagtcgttgctttcgttgccgatgttggtcaaggcgcagaagagctagaaggtattgaagagaaagcaaaagcttcaggtgcttctgagtgttacatcgctgatctgaaagaagagatggtggcggattacatttacccaacgctaaaaaccggcgcgtactacgaaggtaagtacctgctgggtacatcaatggcgcgtccaattattgctaaagcacaggttgaagtcgcacgtaaagtgggcgcggacgcattgtgtcacggctgtacaggtaaaggtaatgaccaagttcgtttcgaaggcgcattcgcagcactagcaccagatctacaagtgattgcaccttggcgtgaatgggacctagtgagccgtgaagaatgtttagattacctagctgagcgtaacattccttgttcagcgtctcttactaagatctactcacgtgatgcaaatgcatggcacatttccactgaaggtggcgtcctagaagatacgtggaacgcaccaaacgaagattgctgggtatggactgtagacccagagcaagcaccaaacgaagcggaatacgtcacgctgaaagtagaaaaaggtgaggtggtcgaagttgatggtgaagcgatgacaccatacaacgcgttggtttatctaaacgaaaaaggttcgaagcacggtgttggtcgtatcgatatcgttgaaaaccgtctagtaggaatgaaatctcgtggctgctacgaaacaccgggaggcaccatcatgatggaagcgctacgtgccgttgaacagctcgtgctagataaatcatcattcgaattccgtgaagagctgggtctaaaagcgtctcaccttgtgtacgatggccgttggtttacgccactatgtaagtcgatccttgccgcttcagaagagctagcgcaagacgtgaatggcgaagtggttgttaagctctacaaaggccaagccacggtaacgcaaaaacgttctgacaacagcttgtactcagaagagttcgcgacttttggtgaagatgaggtttacgaccaaagccatgcgggtggtttcatccgtctttactcgctatcaagccgtatccgtgcgttgaacagccagaagaaataa

SEQ ID NO: 5358 - protein, 404 aa, Vibrio sp. Ex25
MSKVNVNKVVVAYSGGLDTSVIIPWLKENYDCEVVAFVADVGQGAEELEGIEEKAKASGASECYIADLKEEMVADYIYPTLKTGAYYEGKYLLGTSMARPIIAKAQVEVARKVGADALCHGCTGKGNDQVRFEGAFAALAPDLQVIAPWREWDLVSREECLDYLAERNIPCSASLTKIYSRDANAWHISTEGGVLEDTWNAPNEDCWVWTVDPEQAPNEAEYVTLKVEKGEVVEVDGEAMTPYNALVYLNEKGSKHGVGRIDIVENRLVGMKSRGCYETPGGTIMMEALRAVEQLVLDKSSFEFREELGLKASHLVYDGRWFTPLCKSILAASEELAQDVNGEVVVKLYKGQATVTQKRSDNSLYSEEFATFGEDEVYDQSHAGGFIRLYSLSSRIRALNSQKK

SEQ ID NO: 5359 - DNA, 1203 bp, Alteromonadales bacterium TW-7
  CDS (1)..(1203): transl_table=11
atgagttcaattaaaaaagtcgttttagcctattcaggtggtctagatacatcggctatcgtgccatggttaaaagaaaattacggctgtgaagtaatcgcgtttgttgccgatgtaggccaaggcgcagaagagcttgaaggcgttgaagaaaaagccatcgcatcaggtgcatcagagtgttacgtagttgacttaaaagatgaaatggttagtgaatacatttaccctacgcttaaaacgggctctatttacgaaggtacttacttactaggtacctcaatggcgcgtccaatcattgctaaagcgcaagttgaaattgcacgtaaagtaggtgccgatgcgctgtcgcatggttgtactggtaaaggtaacgaccaggtacgttttgaatcgtgctttgcagcgcttgcacctgatttaaaagtcattgcaccatggcgtgagtgggacttatcaagccgtgaatcactactcgattacttagccgagcgcgatattccgtgttctgcttcagcaacaaaaatttacagccgtgatgctaacgcgtggcatatttctcacgaaggtggcgagcttgaagatccatggtgtgagcctagcgatcaagtatggacttggactaactctcctgagcaagcacccgataaagccgagctagtaacattaaaagtttttgaaggtgaagtggttgccgtcaatggcgaagagcttaaaccttatgattgtttagttaaattaaacgacattgcatcaccgcatggtgttggccgtgttgatatagtagaaaaccgtttagttggcatgaaatcgcgtggttgttacgaaaccccaggtggtaccgtgatcatggcggcccttcaagcaatagacgagctagtacttgataaatcaagccgtaagtggaaagaagtattaggcggcgaattttcgcacctagtgtacgacggacgttggtttacgccgcttaaagactctattttagcgggcgccgaggcgttatccacattagcaacgggtgaagtggtacttaagctttataaaggccaagtgactgcggttcagaaaaaatcacctaacagcctatacagcgaagactttgcgacctttggcgaagatgatgtgtatgaccaatcacatgctgaaggttttattcgtttattctcgctttcaagcagaatttcggcgttgtctaaaaagtaa

SEQ ID NO: 5360 - protein, 400 aa, Alteromonadales bacterium TW-7
MSSIKKVVLAYSGGLDTSAIVPWLKENYGCEVIAFVADVGQGAEELEGVEEKAIASGASECYVVDLKDEMVSEYIYPTLKTGSIYEGTYLLGTSMARPIIAKAQVEIARKVGADALSHGCTGKGNDQVRFESCFAALAPDLKVIAPWREWDLSSRESLLDYLAERDIPCSASATKIYSRDANAWHISHEGGELEDPWCEPSDQVWTWTNSPEQAPDKAELVTLKVFEGEVVAVNGEELKPYDCLVKLNDIASPHGVGRVDIVENRLVGMKSRGCYETPGGTVIMAALQAIDELVLDKSSRKWKEVLGGEFSHLVYDGRWFTPLKDSILAGAEALSTLATGEVVLKLYKGQVTAVQKKSPNSLYSEDFATFGEDDVYDQSHAEGFIRLFSLSSRISALSKK

SEQ ID NO: 5361 - DNA, 1221 bp, marine gamma proteobacterium HTCC2143
  CDS (1)..(1221): transl_table=11
atgtctgatatcaagaaagttgttttagcttattctggcggtttagatacatcggtcatcgtgcgttggttgcaagatacctatcagtgcgaagtggtcacgtttaccgctgatattggtcagggtgaagaagtagagcccgcccgcaagaaagcggaagcgctgggtgtaaaagaaatttacattgacgatctcaaggaagaatttgtccgtgatttcgtctttccgatgttccgtgccaacacgatttacgaaggtgaatatctgctcgggacgtcaatcgcccgtccactgattgccaagcggcttattgaaattaccaatgaaaccggcgccgacgcgatatctcatggagcgacgggtaaaggcaacgatcaggttaggtttgagctaggtgcttacgcactgaaacccggtattcaggttatagcgccttggcgtgagtgggatctcacctctcgggaaacattaatggcctattgtgaaacgcacaatattcccgttgattatgctagcaacaagaaaaaatcaccgtattcgatggatgctaatctactacatatttcctatgaaggcggcattttagaagatccatgggcggaagcagaagaagatatgtggcgctggagtgtgtctcctgaaaatgcaccggaccaacctacttacatggaattgacctatcgtggcggtgatatcgtcgccatcgatggtaaaataatgagcccggcaacggtgctggcctatttaaataaagtgggtggcgataatggtatcggtcgtttggatattgtcgaaaatcgctacgtggggatgaaatcccggggctgttatgaaactccagggggcactattatgatgcgcgctcatcgggctattgaatcaataacgcttgaccgtgaagttgctcatcttaaagatagtttgatgccaaaatatgccgagctagtttacaacggctactggtgggcaccggagcgacatatgctgcaaacagcgattaatgaatcccagcaatacgttaacggagaagtgcagctcaagttgtacaaaggcaacgtgattgttgtcggacgtaagtctgagcagtcgctgtttgatgagagtattgctacctttgaggacgatgccggagcctataaccaacaggacgccgaagggtttattaaattgaatgcactacgtatgcgtatcgccgccgataaaggacgttcttctttatag

SEQ ID NO: 5362 - protein, 406 aa, marine gamma proteobacterium HTCC2143
MSDIKKVVLAYSGGLDTSVIVRWLQDTYQCEVVTFTADIGQGEEVEPARKKAEALGVKEIYIDDLKEEFVRDFVFPMFRANTIYEGEYLLGTSIARPLIAKRLIEITNETGADAISHGATGKGNDQVRFELGAYALKPGIQVIAPWREWDLTSRETLMAYCETHNIPVDYASNKKKSPYSMDANLLHISYEGGILEDPWAEAEEDMWRWSVSPENAPDQPTYMELTYRGGDIVAIDGKIMSPATVLAYLNKVGGDNGIGRLDIVENRYVGMKSRGCYETPGGTIMMRAHRAIESITLDREVAHLKDSLMPKYAELVYNGYWWAPERHMLQTAINESQQYVNGEVQLKLYKGNVIVVGRKSEQSLFDESIATFEDDAGAYNQQDAEGFIKLNALRMRIAADKGRSSL

SEQ ID NO: 5363 - DNA, 1218 bp, marine gamma proteobacterium HTCC2080
  CDS (1)..(1218): transl_table=11
atgtctgtcaataaagtcgtacttgcctactctggcggtctcgatacctcggttattgttcgttggctacaagagacctacgactgtgaggtcgttacttttacagctgatattggtcaaggcgaggaggtcgagcctgctcgggcaaaggcgcaggcattgggaattgaggagatttatattgatgatcttcgagaagaatttgtccgtgattttgtctatcccatgtttcgtgcaaataccatctacgaaggggaatacctgcttggaacgtctatcgcgcgcccccttattgccaaacgcctcgttgagattgccaatgagactggtgcagatgctatttcccacggtgccaccggtaagggcaatgaccagattcgattcgaattgggcgcctatgctttaaagccaggtatcaagattatcgctccttggcgggagtgggatttaggctcacgagaatcattaatggcctactgtgagcaaagggcgataccggttgatttttcaggagcctcaaaaaagtcgccctattctatggacgccaatctcctgcacatttcctatgagggcggtgtacttgaagatccttgggctgatgctgaagaatcgatgtggcgctggaccgttagccccgagtcggcacctgatcagggtgaggagattattcttagctttagttgtggtgatattacggctattgacggtgtggcgcacacacccgcggaggttcttgaaatcctcaatcaacgcggcggcgcacacggcatcggacgtgcagatatcgttgagaaccgttacgtgggcatgaagtccaggggctgctacgagaccccgggcggcacaattatgctgcgcgctcaccgggcgatggagtcgattacgctcgatcgcgaggcaatgcaccttaaagacgaactgatgcctcgatacgctaaacttatttacaacggttactggtggtcaccagaacgacttatgttgcagtcagcgatcaatgacagccagcgctgggtcaacggcgaagtacggctacgcctgtacaaaggtaacgttactgtcttagggcggcgctctgacgattcgctatttgatgagagtattgccacctttgaggacgatgctggggcgtataatcaacaggacgccgaaggatttataaaactgaatgcactccggatgcggattgcagcgcagaggggccgatcacagcactag

SEQ ID NO: 5364 - protein, 405 aa, marine gamma proteobacterium HTCC2080
MSVNKVVLAYSGGLDTSVIVRWLQETYDCEVVTFTADIGQGEEVEPARAKAQALGIEEIYIDDLREEFVRDFVYPMFRANTIYEGEYLLGTSIARPLIAKRLVEIANETGADAISHGATGKGNDQIRFELGAYALKPGIKIIAPWREWDLGSRESLMAYCEQRAIPVDFSGASKKSPYSMDANLLHISYEGGVLEDPWADAEESMWRWTVSPESAPDQGEEIILSFSCGDITAIDGVAHTPAEVLEILNQRGGAHGIGRADIVENRYVGMKSRGCYETPGGTIMLRAHRAMESITLDREAMHLKDELMPRYAKLIYNGYWWSPERLMLQSAINDSQRWVNGEVRLRLYKGNVTVLGRRSDDSLFDESIATFEDDAGAYNQQDAEGFIKLNALRMRIAAQRGRSQH

SEQ ID NO: 5365 - DNA, 1200 bp, Candidatus Desulfococcus oleovorans Hxd3
  CDS (1)..(1200): transl_table=11
ttgtcggacattaaaaaagtggtgcttgcctattcgggcgggctggatacgtcggtgattttaaaatggctcatcgagacccatgattgcgaggtgatcaccttttccgcggatatcggccaggaagaggagctggattatattgacgacaaggcacgggccaccggggccaccggggtctacatcgacgacctgaaagaagagtttgtaaaagagtacgtgttcccggcgtttcgggccaatgccatttacgagggccagtacctgctgggcacctccctggcccggcccctgatcgccaaacggcagatcgagatcgccgtggccgaaggggccgatgccgtaagccacggcgccacgggcaagggcaacgaccaggtgcggttcgagctgacctatttcgcgctcaagcccgatattcgcatcgtggcgccctggcgggagtgggacctcaagtcccgcaccgcgctgatggattttgccgtaaagcacggcattccggtgcccaccacaccggccaagccctacagcacggaccggaacctgctgcacatcagctatgaaggcggcattctggaagacccgtggaatccaccctcagacgatatgtttaccctttctgtttccccccggcaggcaccggacgagcccgagatcgtggacatcgcctttgaacagggcaacccggtctccatcaacggccaggccatgagcccggccaatctgctggcggcgttgaacaagctgggtggtaaacatggcatcggccgggccgatattgttgaaaaccggtttgtgggcatgaagtcccggggcgtgtacgagacgccggggggcaccattctgcgggccgcccacatggccatggagtccatcaccatggaccgggaggtgatgcacctgcgggattcgctgattccccggtacgcggagatgatctattacgggttctggttttcgccggagatgaaggtgatgcagcagatgatcgaccagacccaggtgtatgtgtccggtgaggtgcgcctggaactttacaagggcaacagccgggtcctgggccgccggtcggataactccctttacagtgccgactttgccacttttgaggacgacagcgtttaccaccagaaggacgccgaaggcttcatccggctcaatgccctgcggctgcggctgcatgcattgctcggacgatag

SEQ ID NO: 5366 - protein, 399 aa, Candidatus Desulfococcus oleovorans Hxd3
MSDIKKVVLAYSGGLDTSVILKWLIETHDCEVITFSADIGQEEELDYIDDKARATGATGVYIDDLKEEFVKEYVFPAFRANAIYEGQYLLGTSLARPLIAKRQIEIAVAEGADAVSHGATGKGNDQVRFELTYFALKPDIRIVAPWREWDLKSRTALMDFAVKHGIPVPTTPAKPYSTDRNLLHISYEGGILEDPWNPPSDDMFTLSVSPRQAPDEPEIVDIAFEQGNPVSINGQAMSPANLLAALNKLGGKHGIGRADIVENRFVGMKSRGVYETPGGTILRAAHMAMESITMDREVMHLRDSLIPRYAEMIYYGFWFSPEMKVMQQMIDQTQVYVSGEVRLELYKGNSRVLGRRSDNSLYSADFATFEDDSVYHQKDAEGFIRLNALRLRLHALLGR

SEQ ID NO: 5367 - DNA, 1218 bp, Pseudomonas putida GB-1
  CDS (1)..(1218): transl_table=11
atggcggacgtaaaaaaggtcgtactggcgtattccggcggccttgatacttcggtgattctcaagtggctgcaggatacctataactgcgaagtggtgaccttcaccgctgacctgggtcagggcgaagaggtcgagccggcccgtgccaaggcccaggcaatgggcgttaaagagatctacatcgacgatctgcgcgaagagttcgtgcgtgatttcgtattcccgatgttccgcgccaacaccgtctacgaaggcgagtacctgctgggtacttccatcgcccgtccgctgatcgccaagcgcctgatcgaaatcgccaatgcaaccggtgctgacgccatttcccatggcgccaccggcaaaggcaacgaccaggtacgtttcgagctgggtgcctatgcgctgaagccaggcgtcaaggtcatcgctccatggcgcgagtgggacctgctgtcccgcgagaaactgatggactacgccgaaaagcacggcatcccgatcgagcgtcacggcaagaagaagtcgccgtactcgatggacgccaacctgttgcacatctcctacgaaggcggtgtcctggaagatacctggaccgagcacgaagaagagatgtggcgctggagcgtctcgcccgaaaacgccccagaccaggctacctacatcgagctgacctaccgcaacggtgacatcgttgccatcaacggcgtcgagaaatccccggccaccgtgctggccgacctgaaccgtattggtggtgccaacggcatcggccgcctggacatcgtcgaaaaccgttacgtcggcatgaagtcgcgtggctgctacgaaacccctggcggcaccatcatgctcaaggcccaccgtgccatcgagtcgatcacgctggaccgcgaagttgctcacctgaaagatgagctgatgccgaaatacgccagcctgatctacaccggctactggtggagcccggagcgtctgatgctgcagcagatgatcgacgcttcgcaggtcaacgtgaatggcgttgtgcgcctgaaactgtacaagggcaatgttaccgtggttggccgcaagtcggacgattcgctgttcgatgccaacatcgccaccttcgaagaagatggcggcgcctacaaccaggcggacgctgccggcttcatcaagctcaacgcgctgcgtatgcgcattgctgccaacaagggccgttcgctgctctga

SEQ ID NO: 5368 - protein, 405 aa, Pseudomonas putida GB-1
MADVKKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANATGADAISHGATGKGNDQVRFELGAYALKPGVKVIAPWREWDLLSREKLMDYAEKHGIPIERHGKKKSPYSMDANLLHISYEGGVLEDTWTEHEEEMWRWSVSPENAPDQATYIELTYRNGDIVAINGVEKSPATVLADLNRIGGANGIGRLDIVENRYVGMKSRGCYETPGGTIMLKAHRAIESITLDREVAHLKDELMPKYASLIYTGYWWSPERLMLQQMIDASQVNVNGVVRLKLYKGNVTVVGRKSDDSLFDANIATFEEDGGAYNQADAAGFIKLNALRMRIAANKGRSLL

SEQ ID NO: 5369 - DNA, 1212 bp, Marinobacter sp. ELB17
  CDS (1)..(1212): transl_table=11
atgtctgatattaacaaagtagtactggcctattccggtggcctggatacctcggttatcgttcggtggctgcaagacacctacggttgtgaagtggttacctttacggctgacatcggccagggcgaagaagtagaaccggcgcgggtcaaagccaaggcgctgggcgtaaaagaaatctacattgaagatctgcgcgaagagttcgtgcgcgactacgtattccccatgttccgcgctaacaccgtttatgaaggcgagtacctgctgggcacgtccattgcccgcccgctgattgccaagcgcctgattgaaatcgccaactccaccggtgccgatgccatttcccacggcgcaaccggtaaaggtaatgaccaggttcgtttcgagctcggcgcttatgctctgaagcccggcgtgaaagtgatcgccccttggcgtgagtgggatctgaattcccgcgaaaaactgttggcctactgcgccgaacgcgacattccggtcgacatgaaaaaaggcaaatcgccttattctatggacgccaacctgctgcatatttcctacgaaggcatgaacctggaagacccctggtgcgaagccgaagacgacatgtggcgttggagcgtatcgccggaagaagccccgaataccgcgacctacattgaagtcacctacgccaaaggcgacattgttgccgtagacggcaaggcgatgaaagcccacgaggtgctggagcacctgaacaaggttggcggcgacaacggcattggccgcctggacatcgtagagaaccgttatgtgggcatgaagtcccgcggctgttacgaaaccccgggtggcacgattatgctgcgcgctcaccgcgccattgagtccctgactctggaccgcgaagtagcgcacctgaaagacagcttgatgccgcgctatgccgaggtaatctacaacggttactggtggtcgccagagcgcgaagccctgcaggcgctgattgaccagacccaagcctatgtcaacggcaccgtgcgcctgaaattgtacaagggcaacgtagacgtagtcggccgtaagtcagacgactccctgtttgacgagaagattgccacctttgaagaagacgaaggcgcttacaatcagaaagacgccgaaggcttcatcaagctgaacgccctgcgcctgcgcattgcggccagcaagggccgtaagctttaa

SEQ ID NO: 5370 - protein, 403 aa, Marinobacter sp. ELB17
MSDINKVVLAYSGGLDTSVIVRWLQDTYGCEVVTFTADIGQGEEVEPARVKAKALGVKEIYIEDLREEFVRDYVFPMFRANTVYEGEYLLGTSIARPLIAKRLIEIANSTGADAISHGATGKGNDQVRFELGAYALKPGVKVIAPWREWDLNSREKLLAYCAERDIPVDMKKGKSPYSMDANLLHISYEGMNLEDPWCEAEDDMWRWSVSPEEAPNTATYIEVTYAKGDIVAVDGKAMKAHEVLEHLNKVGGDNGIGRLDIVENRYVGMKSRGCYETPGGTIMLRAHRAIESLTLDREVAHLKDSLMPRYAEVIYNGYWWSPEREALQALIDQTQAYVNGTVRLKLYKGNVDVVGRKSDDSLFDEKIATFEEDEGAYNQKDAEGFIKLNALRLRIAASKGRKL

SEQ ID NO: 5371 - DNA, 1335 bp, Herbaspirillum seropedicae
  CDS (1)..(1335): transl_table=11
atgtccaacatcctgcaatccgtcccggtcaatcaaaaagtcggcatcgccttctccggcggcctcgataccagcgccgcgctgacctggatgcgccagaagggcgccatcccctacgcctacaccgccaacctgggccagccggatgagccggactacgacgccatccccaagaaggccatgcaatacggcgcccagcaggcgcgcctgatcgactgccgcgaacagctggccaatgaaggcatcgccgcgctgcaaagcggcgccttccacatctccaccgccggcatcacctacttcaacaccaccccgctgggccgcgccgtgaccggcaccatgctggtgtcggccatgcgtgaagacaacgtcgacatctggggcgacggcagcacctacaagggcaacgacatcgagcgcttctaccgctatggcctgctggtgaaccccaacctgaagatctacaagccctggctggacagcaccttcatcgacgaactgggcggccgcaaggaaatgtccgagttcatgatcaagtccggcttcgactacaagatgtcggtggaaaaggcctactcgaccgactccaacatgctgggcgcgacccacgaagccaaggacctggaattcctcaacagcggcatcaagatcgtgcagcccatcatgggcgtggcgttctggcgcgatgacgtggaagtcaaggccgagaccgtcaccgtgcgcttcgaagaaggccgtccggtggccctgaacggcaagaccttcgccagcatgaccgagctgatcctggaagccaaccgcatcggtggccgccatggcctgggcatgagcgaccagatcgagaaccgcatcatcgaagccaagagccgcggcatctacgaagctccgggcctggccctgctgttcatcgcctacgagcgcctggtcactggcatccacaacgaagacaccatcgaacagtatcgcgacaatggccgcaagctgggccgcctgctgtaccaaggccgctggttcgattcgcaggccatcatgctgcgcgagaccgcccagcgctgggtggcgcgcgccatcaccggcgaagtcacggtggaactgcgtcgcggcaatgactactcgatcctcaacaccgagtcgcccaacctgacctaccacccggaacgcctgaccatggaaaagggcgaaggcagcttctccgccatcgaccgtatcggccagctgaccatgcgcaacctggacatcgccgacacccgccagaagctggcgatctatcagaacaccggcctgctggagtccagcactgcggtgtcgctgccgctgctgggcaaggacgagaagtaa

SEQ ID NO: 5372 - protein, 444 aa, Herbaspirillum seropedicae
MSNILQSVPVNQKVGIAFSGGLDTSAALTWMRQKGAIPYAYTANLGQPDEPDYDAIPKKAMQYGAQQARLIDCREQLANEGIAALQSGAFHISTAGITYFNTTPLGRAVTGTMLVSAMREDNVDIWGDGSTYKGNDIERFYRYGLLVNPNLKIYKPWLDSTFIDELGGRKEMSEFMIKSGFDYKMSVEKAYSTDSNMLGATHEAKDLEFLNSGIKIVQPIMGVAFWRDDVEVKAETVTVRFEEGRPVALNGKTFASMTELILEANRIGGRHGLGMSDQIENRIIEAKSRGIYEAPGLALLFIAYERLVTGIHNEDTIEQYRDNGRKLGRLLYQGRWFDSQAIMLRETAQRWVARAITGEVTVELRRGNDYSILNTESPNLTYHPERLTMEKGEGSFSAIDRIGQLTMRNLDIADTRQKLAIYQNTGLLESSTAVSLPLLGKDEK

SEQ ID NO: 5373 - DNA, 1215 bp, Magnetospirillum gryphiswaldense
  CDS (1)..(1215): transl_table=11
atgaagggcgaagtcaagaaggtcgtgctggcgtattccggcggcctggatacctcgatcatcctgcgctggttgcaggaccaatatcaatgcgaagtggtgaccttcaccgccgatctgggccagggcgaagagctggagccggcgcgcaagaaggcccagctgatgggcatcaaggacgagaacatcttcatcgacgatctgcgtgaagaattcgtccgcgatttcgtcttccccatgttccgcgccaatgcgctttatgaaggcgtctatctgctgggcacctccatcgctaggccgctgatttccaagcgtcagatcgagatcgccaatcaggtcggcgccgacgcggtgtcgcacggtgccaccggcaagggcaacgatcaggtccgcttcgagttgggttattatgccctgaagccggacatcaaggtgatcgcgccctggcgtctgtgggatctgaccagccgcaccaagctgttggacttcgccgagaagcaccagattcccatcgccaaggacaagcgcggcgaggcgccttattccaccgacgccaacctgctgcacatctcgtacgagggcaaggcgctggaagacccgtggaccgagccggacgaggacatgttcacccgttcggtcagcccggaaaaggcccctgataagccgacctatgtggaaatccagttcgagaagggcgacgcggtggccgtcgatggcgtgcggctgagcccggcgcaattgctgaccaagctgaacgaactgggcggcgccaacggcatcggtcgtctggatctggtggaaaaccgcttcgtcggcatgaagagccgcggcgtctacgagacccccggcggctcggtgctgatcgtcgcccatcgcgccatcgaaagcctgacgctggatcgcggcgagtcgcacctgaaggacgacatcatgccgcgctatgccgagttgatctacaacggcttctggttcagcccggaacgcatcgcgttgcagcagatgatcgaccatatcagccagaacgtctgcggtgtggtgcggttgaagctctacaagggcaacgtcaccgtcgtcggccgcaagtcggaaaagtcgctctatcgcatggattacgtcaccttcgaggaagacagcgtctatgaccagcgcgacgcccagggcttcatcaagttgaacgctctgcgcatgcggctggccaagatggcgcgcggctga

SEQ ID NO: 5374 - protein, 404 aa, Magnetospirillum gryphiswaldense
MKGEVKKVVLAYSGGLDTSIILRWLQDQYQCEVVTFTADLGQGEELEPARKKAQLMGIKDENIFIDDLREEFVRDFVFPMFRANALYEGVYLLGTSIARPLISKRQIEIANQVGADAVSHGATGKGNDQVRFELGYYALKPDIKVIAPWRLWDLTSRTKLLDFAEKHQIPIAKDKRGEAPYSTDANLLHISYEGKALEDPWTEPDEDMFTRSVSPEKAPDKPTYVEIQFEKGDAVAVDGVRLSPAQLLTKLNELGGANGIGRLDLVENRFVGMKSRGVYETPGGSVLIVAHRAIESLTLDRGESHLKDDIMPRYAELIYNGFWFSPERIALQQMIDHISQNVCGVVRLKLYKGNVTVVGRKSEKSLYRMDYVTFEEDSVYDQRDAQGFIKLNALRMRLAKMARG

SEQ ID NO: 5375 - DNA, 1356 bp, Ostreococcus tauri
  CDS (1)..(1356)
atgatcaccatgaacaaactctcgtgctccgctcgatcgagcgtcgcgcaccgacgctcgaccgcgtccaagacgaccaaagcggtcgcccgcgtcacccatcgaaacaccgctcggtcctccgtcaaggctcgcgcggggccgtccggggacgtgaagaaggttgtcctggcgtactccggcggtttggacacctccatcatcttgaagtggctccaagacacgtacgggtgcgaggtggtgacgttcacggcggacttagggcagggtgaggagctcgagccggcgcgagcgaaggcgcaacaaatgggagtgaaggaaattttcatcgatgatttgcgcgaggagttcgtccgggattacgtgttcccgatgttccgtgcgaacgccgtgtacgagggcaagtacctgctcgggacgtccatcgcgcgaccgctcatctccaagcgacagattgaaatcgcgaagatggtcggcgccgatgccgtgtgccacggcgccacgggtaagggtaacgaccaggttcgatttgaactcggttactacggcctcaagccggacgtcaaggtgatcgcgccgtggagagagtgggatttgaactcgcgcacgaagttgttggcgtacgcggatgcgaacggcatcccggttgcgcagtccaagcgtcaagacgcgccgtattccaccgacgccaacttgttgcacatctcttacgaaggtaacgcgttggaagatccgtgggtcgagtattccgaggacatgttcacgcgctcggtgagcccggagaacgccccggatacgccgacgtacatcgaggtcgagtttgaaaagggtgacccggtggcgatcaacggtaagcggtactccccggccgaaatgctcaccgagctcaaccgacttggtggcgaaaacggcatcggacgtctggatatcgtcgagtctcgcttcgtcggcatgaagtcccgcggtgtgtacgagacaccgggcggtaccattttgctcgaaatccgacgcgcactcgaaaccgtgtgccttgaccgcggtgaaatgcactacaaggatgaaatgatgccgcgatacgctgagctcatttacaacggtttctggttctccccggagcgcgaaatgatgcaaagcgccattgacttgtgctcgcagaacgtcacaggtacggtgcgtgccaagctctacaagggtaacgtcatggtcgttgggcgcaaggctgacaactctctctacaacgacagactgtccacgttcgaagacgacggcggtgcgtacgaccaaaaagatgccgcgggcttcatcaagcttcaagcactccgcttgcgtacgctcaagactgctcgaggcgagtaa

SEQ ID NO: 5376 - protein, 451 aa, Ostreococcus tauri
MITMNKLSCSARSSVAHRRSTASKTTKAVARVTHRNTARSSVKARAGPSGDVKKVVLAYSGGLDTSIILKWLQDTYGCEVVTFTADLGQGEELEPARAKAQQMGVKEIFIDDLREEFVRDYVFPMFRANAVYEGKYLLGTSIARPLISKRQIEIAKMVGADAVCHGATGKGNDQVRFELGYYGLKPDVKVIAPWREWDLNSRTKLLAYADANGIPVAQSKRQDAPYSTDANLLHISYEGNALEDPWVEYSEDMFTRSVSPENAPDTPTYIEVEFEKGDPVAINGKRYSPAEMLTELNRLGGENGIGRLDIVESRFVGMKSRGVYETPGGTILLEIRRALETVCLDRGEMHYKDEMMPRYAELIYNGFWFSPEREMMQSAIDLCSQNVTGTVRAKLYKGNVMVVGRKADNSLYNDRLSTFEDDGGAYDQKDAAGFIKLQALRLRTLKTARGE

SEQ ID NO: 5377 - DNA, 1248 bp, Phaeosphaeria nodorum
  CDS (1)..(1248)
atgagcaagggacgcgtctgtttggcctactctggcggtcttgatacctccacgatcctgaaatggctcatcgaggaaggttatgaggtcgtgtgcttccttgccaacgttggccaggaagagccttgggatgaggtcgagaagaaggcgctcaagattggtgcgctgaagatggtcattctcgacctgcagaaggaattcgtcgaggagctctgcttccgcgctgtacaatgcaatgcctcatacgagggcagatacctgctcggaaccagcttggctcgtccagtcatcgcccgcgcacagatccgcgttgcccaacaagaaggctgcggcttcgtctcccacggctgcaccggcaagggcaacgaccaggttcgcttcgagcttgcattctacacacttcagcctaccatcaaggtcattgcgccatggaggctgccagagttctgcgaccgcttcaagggcaggcaggatctgttggactatgccgagaagcatggcatcccagtcacatccaccaaggcgaagccatggtccatggacgccaacctggctcactgcagttatgaggctggcatcctcgaggaccccgacgtgtctcctccagacgacatgtggaccatgaccgactcgcccctcaacgctcccaacgagcccaccgacatcaccgtacacttcgacaagggcattcccgtcaaagtcgtgaccccagagaagacctacaccgactcagtcgagctcttcgtcgcgctcaacaagctcggcttcacccacggcattgggcgcatcgacattgtcgagaaccgcttcatcggcctcaaatcccgcggctgctacgactcgcccgccatgaccatcctgcgcctcgcacatctcgacctcgagggcctcgtcatggacgcccaagtgcgcaacctgcgcgaccaattcgtctcgcataactggagctaccagctgtacaacggcatgtacttcagccccgagcgcgagttcatcgagaacagcctggtgttcagccagcgccgcgtcaacggcgaggtgcgcatgaagctgtacaagggcaatgcgtatgtgctgggccgctcgagtcagacggagaagctgtactcggaggaggaggcgagtatggacacgctggataacttcagcccaatggataccacgggcttcattgcgatccagagcattaggctcaagaagtatgggctgcagaaggccgaggagggtgcgaatatgagccgtgcttag

SEQ ID NO: 5378 - protein, 415 aa, Phaeosphaeria nodorum
MSKGRVCLAYSGGLDTSTILKWLIEEGYEVVCFLANVGQEEPWDEVEKKALKIGALKMVILDLQKEFVEELCFRAVQCNASYEGRYLLGTSLARPVIARAQIRVAQQEGCGFVSHGCTGKGNDQVRFELAFYTLQPTIKVIAPWRLPEFCDRFKGRQDLLDYAEKHGIPVTSTKAKPWSMDANLAHCSYEAGILEDPDVSPPDDMWTMTDSPLNAPNEPTDITVHFDKGIPVKVVTPEKTYTDSVELFVALNKLGFTHGIGRIDIVENRFIGLKSRGCYDSPAMTILRLAHLDLEGLVMDAQVRNLRDQFVSHNWSYQLYNGMYFSPEREFIENSLVFSQRRVNGEVRMKLYKGNAYVLGRSSQTEKLYSEEEASMDTLDNFSPMDTTGFIAIQSIRLKKYGLQKAEEGANMSRA

SEQ ID NO: 5379 - DNA, 1263 bp, Candidatus Kuenenia stuttgartiensis
  CDS (1)..(1263): transl_table=11
atgacgaaacaaagaaaaaaagtggttttggcgtattccggcgggcttgatacatctgtggccattaagtggattccggaaaaatatgatatggatgttattacggtgactgttgatctgggtgccgtaaaagatcttgaatcaattcgtcaaaaggctttgaaaataggggcaaagaaggccattgttgtcgatgcgaaagatacatttgtgaaatatttcgtcatgccggcattgcaggcgggcgcattatatgaaggggtgtatccgttggcaaccgccttgggcaggccgcttattgcgaaattactggcggatgcggcagaagatgaaaaggcggatgctgtcgcccatggttgcacaggtaaggggaatgatcaggttcgtttggatgtctcgttacaggtgttaaacccgagattacagattattgccccgttgcgtgagtggaagatgtccagggatgaagaaattcaatatgcggaagaacatggaatccatgttgaggcaaaagtaaatagtccgtacagcaccgatgaaaacctctgggggcgaagtgttgagtgcggcgtattggaagacccctggatggaaccgcctgcggatgtttataaatggacgagaaatattaaagacgtccctgacgaaccggcatatatagaaatcgattttgaaaaaggtatcccgatagcgttaaatggcaaaaaaacagaaggggttgcgcttattaatacgctaaacgcactggggggagagcatggcgttggccgcattgatcatatagaaaaccggctggtggggataaaatcgcgtgaaatttacgaggcgccggctgccattatacttcatgccgcacataaggcgctcgaaggcatgaatatgacaaaagatgctttgcgctttaaggaaatagtttcaagtcattatgctgatttgatttacaatggcctttggttttctgcctttcatcaggatcttgtcgcttatgtattgagcagtcagagaattgtgaatggaacgattcgcgtaaaattgtcaaaggggtcttgtgccgtagtcgggagaaaatcgcctcacgccctttatagtgaggaacttgctacttaccagaaaacggacgtctttgaccatgcggcttctcttggatttattaagatttacggtttgcctgtaaagacgcaatcgcagaaacagatgaatgttttgagcgggagggaggcgttgaatttggagtcaataatgccgccgaaattattgccgtga

SEQ ID NO: 5380 - protein, 420 aa, Candidatus Kuenenia stuttgartiensis
MTKQRKKVVLAYSGGLDTSVAIKWIPEKYDMDVITVTVDLGAVKDLESIRQKALKIGAKKAIVVDAKDTFVKYFVMPALQAGALYEGVYPLATALGRPLIAKLLADAAEDEKADAVAHGCTGKGNDQVRLDVSLQVLNPRLQIIAPLREWKMSRDEEIQYAEEHGIHVEAKVNSPYSTDENLWGRSVECGVLEDPWMEPPADVYKWTRNIKDVPDEPAYIEIDFEKGIPIALNGKKTEGVALINTLNALGGEHGVGRIDHIENRLVGIKSREIYEAPAAIILHAAHKALEGMNMTKDALRFKEIVSSHYADLIYNGLWFSAFHQDLVAYVLSSQRIVNGTIRVKLSKGSCAVVGRKSPHALYSEELATYQKTDVFDHAASLGFIKIYGLPVKTQSQKQMNVLSGREALNLESIMPPKLLP

SEQ ID NO: 5381 - DNA, 1398 bp, Medicago truncatula
  CDS (1)..(1398)
atggcgcagttgaatgcaattcttacatactcatccccagctattgctcctaccaaacatgcaaaagagcacctgctgcatcaccggttctgccaggcaaagccttcttcattaagagagttgagtccaagaagaagttttggtgctgcaagtaaacctcaagttataaaagctgtgctatataaagacgtagaaatttctgagaccaagaaggttgctggactaaaaggtaaattgaataaggttgttctggcttatagtggtggcttagacacatcggttgttgtcccctggctgagagagaactatggctgtgatgttgtttgcttcactgctgatctaggccaaggggcaagtgaattggaaggtttagaagagaaggcaaaagccagcggagcttctcagttagtcgtgaaggatttgaaggaggaatttgttagggattatgtattcccttgcctgcgtgccggtgcaatttatgagaggaagtatttgcttggaactgcaatagctcgccctgtaattgcaaaggctatggtggatattgccaatgaagttggagctgatgctgttcgatttgaactctccttttttgctctgaatcccaagttaaatgtcgtggctccatggagggagtgggatattacagggagagaagatgctattgagtatgctaagaagcatgatgtaccggttcctgtaaccaaaaaatccatatatagcagggataggaacctttggcacataactcatgagggtgatgttttggaagatccagcaaatgaacctaaaaaggatatgtacatgttgactgtagacccagaggatgctccaaacgagccagaatatgtggagattggatttgagttaggcattccagtatcgctgaacgggaagaggctttctccaggaaatttggttgctgagctgaatgagataggtggaaggcatggaataggccgtgtcgacttggttgaagaccgcattgtaggcatgaagagccgaggagtttacgaaactccaggtggcaccattctcttcactgcagcaagagacttagagactttgactcttgatcgtgaaacacttcagcttaaagactcattagcacttaaatatgcagagttagtgtatgctggaagatggtttgatccacttcgcgaatcgatggattcattcatggagaagatctcacagactacaacaggttcagtgagtttgaaactgtataaaggtagtgcttctgtgacgggtcggaagagtccttatagtttatatagggaagatatttcttcatttgagagtggggagatatataatcatgctgatgctgttgggtttataaagctttatggtcttccaatgaggatcagagccatgatggaacaaggcatttaa

SEQ ID NO: 5382 - protein, 465 aa, Medicago truncatula
MAQLNAILTYSSPAIAPTKHAKEHLLHHRFCQAKPSSLRELSPRRSFGAASKPQVIKAVLYKDVEISETKKVAGLKGKLNKVVLAYSGGLDTSVVVPWLRENYGCDVVCFTADLGQGASELEGLEEKAKASGASQLVVKDLKEEFVRDYVFPCLRAGAIYERKYLLGTAIARPVIAKAMVDIANEVGADAVRFELSFFALNPKLNVVAPWREWDITGREDAIEYAKKHDVPVPVTKKSIYSRDRNLWHITHEGDVLEDPANEPKKDMYMLTVDPEDAPNEPEYVEIGFELGIPVSLNGKRLSPGNLVAELNEIGGRHGIGRVDLVEDRIVGMKSRGVYETPGGTILFTAARDLETLTLDRETLQLKDSLALKYAELVYAGRWFDPLRESMDSFMEKISQTTTGSVSLKLYKGSASVTGRKSPYSLYREDISSFESGEIYNHADAVGFIKLYGLPMRIRAMMEQGI

SEQ ID NO: 5383 - DNA, 1254 bp, Aspergillus oryzae
  CDS (1)..(1254)
atggctaccgagaagccccgtgtctgtcttgcctactctggcggtctggataccagctgcattcttcgctggttgatcgaggagggctacgaggttgtctgcttcctcggcaatgtcggccaggaggaagactgggccgctgttgaggagaaggccctcaagatcggtgccaagaagatggtgattgaggatctgcgccgggagttcgtcgaggagctctgcttccctgccatccagtgcaatgccatctatgagggtcgctacctcctgggaaccagcttggctcgtcccgttatcgcccgcgcccagatgcgtgtcgctcagcgtgaaggctgccagtttgtcagccacggtgctaccggcaagggtaacgaccaggtccgtttcgaactggctttctatgccatccagccctccatcaagatcatcgccccttggcgtgatcccaagttcttcaagcgtttcgctggccgtaacgatctcctcgactatgccgcccagaccggcatccctgttacctccactaaggccaagccctggtccatggacgccaactccgcccactgcagttacgaggccggtgttctggaggaccccaaccacacccctcccgctgacatgtggaccatgaccgccgaccctctgaacgcccctaacgagcctgccgacatcaccatccagttcgagcagggtatccccactaagctcgtcactcccgagaagacatacaccgactccgttgagctcttcaacgctctcaacaagctcggctacacccacggtgttggccgtattgatattgtcgagaaccgcttcatcggtctcaagagccgtggctgctatgactcccctgctatgaccatcctccgcgccgcccatctcgacctcgagggtctcgtcctggacggccaggtccgctctctccgtgatcagttcgtcacccacaactggtccatcctcctctacaatggctactacttcagccccgagcgtgagttcatcgagaacagtctgaagttcagtcagaagcgcgtcaacggtgaggtccgtgtgcgcctctacaagggtagcccttacatccttggtcgctccagcagcaccgagaagctgtacgatgccgaggaggcttccatggactccctcgaggacttcgagcctaccgacaccaccggtttcattgccatcagctccatccgtctcaagaagtacggtctgcagaaggctgaggagggcgagaacctcagccgggcttag

SEQ ID NO: 5384 - protein, 417 aa, Aspergillus oryzae
MATEKPRVCLAYSGGLDTSCILRWLIEEGYEVVCFLGNVGQEEDWAAVEEKALKIGAKKMVIEDLRREFVEELCFPAIQCNAIYEGRYLLGTSLARPVIARAQMRVAQREGCQFVSHGATGKGNDQVRFELAFYAIQPSIKIIAPWRDPKFFKRFAGRNDLLDYAAQTGIPVTSTKAKPWSMDANSAHCSYEAGVLEDPNHTPPADMWTMTADPLNAPNEPADITIQFEQGIPTKLVTPEKTYTDSVELFNALNKLGYTHGVGRIDIVENRFIGLKSRGCYDSPAMTILRAAHLDLEGLVLDGQVRSLRDQFVTHNWSILLYNGYYFSPEREFIENSLKFSQKRVNGEVRVRLYKGSPYILGRSSSTEKLYDAEEASMDSLEDFEPTDTTGFIAISSIRLKKYGLQKAEEGENLSRA

SEQ ID NO: 5385 - DNA, 1278 bp, Agaricus bisporus
  CDS (1)..(1278)
atgcctgaaaacaaaggtcgtgttcttttagcctactctggtggtctagatacctcttgtatccttgcatggttgattgaagaaggatatgaagtctatgcattcatggcagatgtaggccaagaagaagactatgcagctgcagaacagaaagctttgaaagtcggagcaaagaaattcttcttggccgatctcaaacgagaattcgttactgaactcatttatcctgcagttcaagctaactgtatctacgaaaatgtttatctccttggtacatcacttgctcgacctgttattgcccgtggaatgattgaagttgcagacaaagagggttgcgattacgtctctcacggttgcactggaaaaggcaacgaccaagtccgatttgaactcgctttctacggtctcaaacctgatatcaaagttatcgctccttggcgaattcccgaattctacaaccgcttcgccggacgacaagcccttcttcaatatgccgccgaacaaaatattcctgtccaacaaactgttgcaaaaccatggtcaacagatgaaaatctcttccacatctcatacgaagctggtatcctcgaagatcccaacgtcactcctcccgacgacatgtggaaactcaccaccgctcccgaagatgcccccacctcacccgaacgtatcatcctcgaattccaaaacggtttacccaccaaagtcatcgttcctgaacaacaaaaagaatatacagatgctgtagaaattttcactgctctaaacactctcgcaaggaaacatggtataggtcgtatcgatatcgtcgaaaatcggtttataggagtcaaatctcgtggttgttacgaatcacctggagctactatccttcgtgtcgcccatatggatcttgaaggtcttaccctcgatcgtaatgtgcgagctcttcgagaccaatttacaactatcgctctgagtcgaatcttgtataacggtcattacttctcgcctgaacgcgagttcgttactagctctattccttcgagtcaacgaactgtgaatggcatcgttagactgaaactttacaagggtaacactattgttgaaggccgtgaatccagtgaaggtctgtatgatgctgctcagtcctccatggacgaacttggtggtttcgagcctacagatactaccggattcatttctatcgagtctatcagactcaaaaaatgggctcaatcaaaggcagccaaaggtcagtctggcgtcacggccaaggatgtctatggtagctcttag

SEQ ID NO: 5386 - protein, 425 aa, Agaricus bisporus
MPENKGRVLLAYSGGLDTSCILAWLIEEGYEVYAFMADVGQEEDYAAAEQKALKVGAKKFFLADLKREFVTELIYPAVQANCIYENVYLLGTSLARPVIARGMIEVADKEGCDYVSHGCTGKGNDQVRFELAFYGLKPDIKVIAPWRIPEFYNRFAGRQALLQYAAEQNIPVQQTVAKPWSTDENLFHISYEAGILEDPNVTPPDDMWKLTTAPEDAPTSPERIILEFQNGLPTKVIVPEQQKEYTDAVEIFTALNTLARKHGIGRIDIVENRFIGVKSRGCYESPGATILRVAHMDLEGLTLDRNVRALRDQFTTIALSRILYNGHYFSPEREFVTSSIPSSQRTVNGIVRLKLYKGNTIVEGRESSEGLYDAAQSSMDELGGFEPTDTTGFISIESIRLKKWAQSKAAKGQSGVTAKDVYGSS

SEQ ID NO: 5387 - DNA, 1194 bp, Streptomyces griseus subsp
  CDS (1)..(1194): transl_table=11
gtgaccgagcgcgtcgttctcgcttactcgggcggcctggacacctccgtcgccatcggctggatcgccgaggagacgggtgccgaggtcatcgccgtcgccgtggacgtcggccagggcggcgaggacctggacgtcatccgcaagcgcgcgctcgcctgcggtgccgtcgaggccgaggtcgcggacgcgagggacgagttcgccgaggagtactgcctcccggcgatcaaggccaacgccctctacatggaccgctatccgctggtctcggccctctcccggccgacgatcgtcaagcacctcgtcgccgccgcccgcaagcacggcgccgggaccgtcgcccacggctgcaccggcaagggcaacgaccaggtccgtttcgaggccggcatctccgcgctcggtcccgacctgaagtgcatcgccccggtccgcgactacgcgatgacccgggaccgggcgatcgccttctgcgaggagaagaacctcccgatcgcgaccaccaggaagtccccgtactccatcgaccagaacgtcttcgggcgcgccgtcgagacgggcttcctggaggacatctggaacgccccgatcgaggacatctacgagtacaccgccgaccccgccgtcccgcgcgaggccgacgaggtggtcatctccttcaaggagggcgtgcccgtggccgtcgacggccgtcccgtcaccgtcctccaggcgatccagcagctcaacgagcgggccggcgcccagggcgtcggccggatcgacatggtcgaggaccggctcgtgggcatcaagtcccgcgaggtgtacgaggcgcccggcgccatcgcactgatcaccgcccaccaggagctggagaacgtcaccgtcgagcgcgaactggcccgctacaagcggcaggtcgagcagcggtggggcgagatggtctacgacggcctgtggttctccccgctgaagcgcgccctggacggcttcatcaacgaggccaaccagcacgtcaccggcgacatccggatgaccctgcacgccggccgagccgtcgtcaccggccggaagtccgaggagtcgctgtacgacttcaacctcgcgacctacgactcgggcgacaccttcgaccagtccaaggcgcagggcttcatcgagatcttcggtctctccgccaagatcgccgccaggcgcgacctcgcctga

SEQ ID NO: 5388 - protein, 397 aa, Streptomyces griseus subsp
MTERVVLAYSGGLDTSVAIGWIAEETGAEVIAVAVDVGQGGEDLDVIRKRALACGAVEAEVADARDEFAEEYCLPAIKANALYMDRYPLVSALSRPTIVKHLVAAARKHGAGTVAHGCTGKGNDQVRFEAGISALGPDLKCIAPVRDYAMTRDRAIAFCEEKNLPIATTRKSPYSIDQNVFGRAVETGFLEDIWNAPIEDIYEYTADPAVPREADEVVISFKEGVPVAVDGRPVTVLQAIQQLNERAGAQGVGRIDMVEDRLVGIKSREVYEAPGAIALITAHQELENVTVERELARYKRQVEQRWGEMVYDGLWFSPLKRALDGFINEANQHVTGDIRMTLHAGRAVVTGRKSEESLYDFNLATYDSGDTFDQSKAQGFIEIFGLSAKIAARRDLA

SEQ ID NO: 5389 - DNA, 1248 bp, Pichia pastoris
  CDS (1)..(1248)
atgtctaaaggaaaagtttgtttggcctactccggtggtttggatacctccatcatcctagcttggttgttggagcagggatacgaagtcgttgcctttttagccaacattggtcaagaggaagactttgaggctgctagagagaaagctctgaagatcggtgctaccaagtttatcgtcagtgacgttaggaaggaatttgttgaggaagttttgttcccagcagtccaagttaacgctatctacgagaacgtctacttactgggtacctctttggccagaccagtcattgccaaggcccaaatagaggttgctgaacaagaaggttgttttgctgttgcccacggttgtaccggaaagggtaacgatcaggttagatttgagctttccttttatgctctgaagcctgacgttgtctgtatcgccccatggagagacccagaattcttcgaaagattcgctggtagaaatgacttgctgaattacgctgctgagaaggatattccagttgctcagactaaagccaagccatggtctactgatgagaacatggctcacatctccttcgaggctggtattctagaagatccaaacactactcctccaaaggacatgtggaagctcactgttgacccagaagatgcaccagacaagccagagttctttgacgtccactttgagaagggtaagccagttaaattagttctcgagaacaaaactgaggtcaccgatccggttgagatctttttgactgctaacgccattgctagaagaaacggtgttggtagaattgacattgtcgagaacagattcatcggaatcaagtccagaggttgttatgaaactccaggtttgactctactgagaaccactcacatcgacttggaaggtcttaccgttgaccgtgaagttagatcgatcagagacacttttgttaccccaacctactctaagttgttatacaacgggttgtactttaccccagaaggtgagtacgtcagaactatgattcagccttctcaaaacaccgtcaacggtgttgttagagccaaggcctacaaaggtaatgtgtataacctaggaagatactctgaaaccgagaaattgtacgatgctaccgaatcttccatggatgagttgaccggattccaccctcaagaagctggaggatttatcacaacacaagccatcagaatcaagaagtacggagaaagtgtcagagagaagggaaagtttttgggactttaa

SEQ ID NO: 5390 - protein, 415 aa, Pichia pastoris
MSKGKVCLAYSGGLDTSIILAWLLEQGYEVVAFLANIGQEEDFEAAREKALKIGATKFIVSDVRKEFVEEVLFPAVQVNAIYENVYLLGTSLARPVIAKAQIEVAEQEGCFAVAHGCTGKGNDQVRFELSFYALKPDVVCIAPWRDPEFFERFAGRNDLLNYAAEKDIPVAQTKAKPWSTDENMAHISFEAGILEDPNTTPPKDMWKLTVDPEDAPDKPEFFDVHFEKGKPVKLVLENKTEVTDPVEIFLTANAIARRNGVGRIDIVENRFIGIKSRGCYETPGLTLLRTTHIDLEGLTVDREVRSIRDTFVTPTYSKLLYNGLYFTPEGEYVRTMIQPSQNTVNGVVRAKAYKGNVYNLGRYSETEKLYDATESSMDELTGFHPQEAGGFITTQAIRIKKYGESVREKGKFLGL

SEQ ID NO: 5391 - DNA, 1167 bp, uncultured archaeon GZfos9D1
  CDS (1)..(1167): transl_table=11
atgaaaaaagtagtgcttgcatattcgggtggactggacacctcagtctgcatcccgctgctcaaagagcattacggctatgacaacgtgattgccgtaaccgtggacgtagggcagcctgaggatgacataaaagaggctaaagaaagaggtgcgaagctgtgcgactcgtatagggaaatagatgcaaaagaggagtttgtgcgtgattatatctttccgttaataaaagcaaatggcaactacgagggatacgtgctcgggacggcgatagcgagaccgttgattgcgaagcacgtggtggaagttgcaagggaagagaacgcagatgcagtcgcacatggatgcacgggcaagggtaacgaccagctcaggtttgacgccgttttcagaacaactgaccttgacgtggtcgcaccgatgagggagctgagtttgacgagggcggaggagaggaaatatgcagcagagcacggcattttacttaaacccgagcaccggtggagtgtggatgaaaatatctggagcagaagtatagaaggagcggaattggaagacccctctttttccccgcctgaagagatatttcagtggactgtttcggcggataaagcgcctgaaaatgcagagacaataaaaattgactttgagaaaggtgttcctgtttcgttaaacgggacaaaaatggagggtgtttcgctactaaaaaagttgaacgaaacaggaggcaagcacggcgttggtagaacggacatgattgaggacagagttcttggctttaagtcgcgcgagaactacgagcatcccgcagctactataatattggtggcgcatcgtgacctcgaacagctcgtcctaacgagaaacgagctgaggtttaaggatttcgttgattccgcgtggagtgagttagtgtatcagggtctaatcatggacccgctttatgatagtcttaacgcctttatagataagacgcaggaacgcctgaacggctcggtatatgtgaaactggagaagggcattgcgcgagtggtgggaagagaatcaccaaacgcattgtattcagcaacggtttcgtttgacgttaagcaagagcaaaagggtgcggagggattttcgatgtatcatggttttcagtcgaggatggtcaaaaatgcttttcaataa

SEQ ID NO: 5392 - protein, 388 aa, uncultured archaeon GZfos9D1
MKKVVLAYSGGLDTSVCIPLLKEHYGYDNVIAVTVDVGQPEDDIKEAKERGAKLCDSYREIDAKEEFVRDYIFPLIKANGNYEGYVLGTAIARPLIAKHVVEVAREENADAVAHGCTGKGNDQLRFDAVFRTTDLDVVAPMRELSLTRAEERKYAAEHGILLKPEHRWSVDENIWSRSIEGAELEDPSFSPPEEIFQWTVSADKAPENAETIKIDFEKGVPVSLNGTKMEGVSLLKKLNETGGKHGVGRTDMIEDRVLGFKSRENYEHPAATIILVAHRDLEQLVLTRNELRFKDFVDSAWSELVYQGLIMDPLYDSLNAFIDKTQERLNGSVYVKLEKGIARVVGRESPNALYSATVSFDVKQEQKGAEGFSMYHGFQSRMVKNAFQ

SEQ ID NO: 5393 - DNA, 1167 bp, uncultured archaeon GZfos26F9
  CDS (1)..(1167): transl_table=11
atgaaaaaagtagtgcttgcatattccggcgggttggacacctcagtctgcatcccactgctcaaagagcattacgggtatgatgaagtgattgccgtaaccgtggacgtagggcagcctgaggatgacataaaagaggctaaagaaagaggtgcaaagctgtgcgactcgtatagggaaatagatgcaaaagaggagtttgtgcgtgattatatctttccgttgataaaagcgaacggcagctacgaaggatacgtgctcgggacggcgatagcgagaccgttgattgcgaagcacgtagtggaagttgcaagggaagagaaagcagatgcagtcgcacatggatgcacaggcaagggtaacgaccagctcaggtttgacgccgttttcagaaccactgaccttgacgtggtcgcaccgatgagggagctgagtttgacgagggtggaggagaggaaatatgctgcagagcacggcattttacttaaacccgagcaccggtggagtgtggatgaaaatatctggagcagaagcatagaaggagcagaattggaagaaccttctttcgtcccgcctgaagagatatttcagtggactgtttcggcggataaagcgcctgaagatgcagagacaataaaaattgaatttaaggaaggcgttcctgtttcgttaaacgggacaaaaatggatggtgtttcgctactaaaaaagttgaacggaacgggaggcaagcacggcgttggtagaacggacatgattgaggacagagttcttggctttaagtcgcgcgagaactacgagcatcccgcagctactataatattagtggcgcatcgtgacctcgaacagcttgtcttaacgcgaaacgagctgaggtttaaggatttcgttgattccgcgtggagtgagttagtgtatcagggtctaatcatggacccgctttatgatagtcttaatgcctttatagataagacgcaggaacgcctgaacggctcggtgtatgtgcgattggagaagggcgttgcgcgagtggtaggaagagaatcgccaaactcattgtattcagcaacggtttcgtttgatgtgaagcaagagcagaagggtgcggagggattctcgatgtatcatggatttcagtcgaggatggtcaaaaatgcttttcaataa

SEQ ID NO: 5394 - protein, 388 aa, uncultured archaeon GZfos26F9
MKKVVLAYSGGLDTSVCIPLLKEHYGYDEVIAVTVDVGQPEDDIKEAKERGAKLCDSYREIDAKEEFVRDYIFPLIKANGSYEGYVLGTAIARPLIAKHVVEVAREEKADAVAHGCTGKGNDQLRFDAVFRTTDLDVVAPMRELSLTRVEERKYAAEHGILLKPEHRWSVDENIWSRSIEGAELEEPSFVPPEEIFQWTVSADKAPEDAETIKIEFKEGVPVSLNGTKMDGVSLLKKLNGTGGKHGVGRTDMIEDRVLGFKSRENYEHPAATIILVAHRDLEQLVLTRNELRFKDFVDSAWSELVYQGLIMDPLYDSLNAFIDKTQERLNGSVYVRLEKGVARVVGRESPNSLYSATVSFDVKQEQKGAEGFSMYHGFQSRMVKNAFQ

SEQ ID NO: 5395 - DNA, 1167 bp, uncultured archaeon GZfos19A5
  CDS (1)..(1167): transl_table=11
atgaaaaaagtagtgcttgcatattcgggtggactggacacctcggtctgcatcccactgctcaaagagcattacgggtatgacgaagtgattgccgtaaccgtgaacgtagggcagcctgaggaggacataaaagaggctaaagaaagaggtgcgaagttgagcaactcgtatagggaaatagatgcaaaagatgagtttgtgcgtgattatatctttccgttaataaaagcgaatggcaactatgagggctacgtgctcgggacggcgattgcaagaccgctgattgcgaagcacgtggtggaagttgcaagggaagagaaagcagatgcagtcgcacatggctgcacgggcaagggtaacgaccagctcaggtttgacgccgttttcagaaccactgatcttgatgtggtcgcaccgatgagggagctgagtttgacgagggaggaggagaggaaatatgcagcagagcacggcattttacttaaacccgagcaccggtggagtgtggatgaaaatatctggagcagaagtatagaaggagcggaattggaacaaccttctttcgtcccgcctgaagagatatttacgtggactgtttcggcggataaagcgcctgaagatgcacagacaataaaaattgactttgagaaaggcgttcctgtttcgttaaacgggacaaaaatggatggtgtttcgctactaaaaaagttgaacgaaacaggaggcaagcacggcgttggtagaacggacatgatcgaggatagagttcttggctttaagtcgcgcgagaactacgagcatcccgcagctactataatattagaggcgcaccgtgacctcgaacagcttgtcttaacgcgaaacgagctgaggtttaaggatttcgttgattccgcgtggagtgagttagtgtatcagggtttagtcatggacccgctttatgatagtcttaacgcctttatagataagacgcaggaacgcctgaacggcacggtgtatgtgcgattggagaagggcattgcgcgagtggtagggagagaatcgccaaacgcattgtattcagcaacggtttcgtttgacgttaagcaagagcagaagggtgcggagggattttcgatgtatcatggatttcagtcgaggatggtcaaaaatgcttttcaataa

SEQ ID NO: 5396 - protein, 388 aa, uncultured archaeon GZfos19A5
MKKVVLAYSGGLDTSVCIPLLKEHYGYDEVIAVTVNVGQPEEDIKEAKERGAKLSNSYREIDAKDEFVRDYIFPLIKANGNYEGYVLGTAIARPLIAKHVVEVAREEKADAVAHGCTGKGNDQLRFDAVFRTTDLDVVAPMRELSLTREEERKYAAEHGILLKPEHRWSVDENIWSRSIEGAELEQPSFVPPEEIFTWTVSADKAPEDAQTIKIDFEKGVPVSLNGTKMDGVSLLKKLNETGGKHGVGRTDMIEDRVLGFKSRENYEHPAATIILEAHRDLEQLVLTRNELRFKDFVDSAWSELVYQGLVMDPLYDSLNAFIDKTQERLNGTVYVRLEKGIARVVGRESPNALYSATVSFDVKQEQKGAEGFSMYHGFQSRMVKNAFQ

SEQ ID NO: 5397 - DNA, 1212 bp, Rhizobium leguminosarum bv
  CDS (1)..(1212): transl_table=11
atgacgaagatagagaaaattgtgctttcttattcgggtgggctggatacctcgatcatcctcaaatggttgcaggaaacctacggatgcgaggtggtgacgttcaccgccgatctcggccagggcgaggagctcgagccggcgcgcgccaaggcggagatgtcaggggtcaaggacatccgtatcgtcgatctgcgcgaggagttcgtcagcgacttcgtctttccgatgctgcgggcgaacgcgctctatgaggggcagtacctgctgggcagttccatcgcacggccgctgattgccaagcatctggtcggcatagcccgggaggttggcgccgacgccgttgcccacggcgcgaccggcaagggcaatgatcagatccggttcgagctggccgtcaatgcgctcgacccgtcgattaaggtcattgctccctggcgccaatggaacatccgctcccgcttacagctttcggaatatgccgaaaagcatcggatcccggtgcccagcgacaagcgcggcgaggcgccgttctcgatcgatgccaacctgctgcacacctcgaccgaaggcaagagtctcgaaaatccggcggaggtcgcgcccgatcatgtctatcagcgcacggtcgatcccgtcgacgctcccgacacgcctgagatcatcaccgttggtttcgagaggggcgatccggtttcggtgaacggcaaggccatgacgccagccgcattgctgaccgagctcaatggactgggcggccggcacggcgtcgggcggctcgatctggttgaaaaccgcttcatcggcatgaagtcgaggggaatatacgaaacgccgggaggcacgatcctgctcgcggcccatcgcggcattgaatcgatcacgctcgaccgcgccgccgcccatctgaaggatgagatcatgccccgctacgccgagctgatctacaacggtttctggttcgctcccgagcgggaaatgctgcaagccctgatcgaccacagccaggctttcgtcagcggcgaagtgacgctcaggctctacaagggaagcgcctcggttatctcccgcgcctccccctgctccctctactccgccgacctcgtcaccttcgaagaaagcaccatcgccttcgatcatcacgacgcggaaggtttcatcaggctcaacggattgcggctcaggagctgggccgcccgcaacggcagatga

SEQ ID NO: 5398 - protein, 403 aa, Rhizobium leguminosarum bv
MTKIEKIVLSYSGGLDTSIILKWLQETYGCEVVTFTADLGQGEELEPARAKAEMSGVKDIRIVDLREEFVSDFVFPMLRANALYEGQYLLGSSIARPLIAKHLVGIAREVGADAVAHGATGKGNDQIRFELAVNALDPSIKVIAPWRQWNIRSRLQLSEYAEKHRIPVPSDKRGEAPFSIDANLLHTSTEGKSLENPAEVAPDHVYQRTVDPVDAPDTPEIITVGFERGDPVSVNGKAMTPAALLTELNGLGGRHGVGRLDLVENRFIGMKSRGIYETPGGTILLAAHRGIESITLDRAAAHLKDEIMPRYAELIYNGFWFAPEREMLQALIDHSQAFVSGEVTLRLYKGSASVISRASPCSLYSADLVTFEESTIAFDHHDAEGFIRLNGLRLRSWAARNGR

SEQ ID NO: 5399 - DNA, 1224 bp, Rhizobium leguminosarum bv
  CDS (1)..(1224): transl_table=11
atggcatcatacaaagacgtgaagaaagtcgttctcgcctattccggcggcctcgacacctcgatcatcctgaagtggctgcagacggagctcggcgccgaagtcgtcaccttcaccgccgatctcggccagggcgaagagctggagccggcgcgcaaaaaggccgagatgctcggcatcaaggagatctatatcgaggatgtgcgcgaggaattcgtgcgcgatttcgtcttcccgatgttccgcgccaatgccgtctacgagggcgtctacctgctcggcacctcgattgcccgtcctttgatttccaagcatctgatcgatatcgccaagaagaccggcgccgatgcgatcgcccatggcgcgaccggcaaggggaacgaccaggtccgtttcgaactgtccgcctatgccctgaaccccgacatcaagatcatcgcgccttggcgcgactgggcgttcaagagccgcaccgatctgctggcctttgccgaacagcatcagatccctgttgccaaggacaagatgggcgaggcgccgttctcggtcgacgccaaccttctgcattcctcgtccgaaggcaaggttctcgaggacccctcccaggaggcgcctgaatatgtgcatatgcgcaccatttcgcctgaagctgcacccgacaaggcaacgaccatcaaggtcggcttcgaaaagggtgatgcagtttcgatcaacggcgtgcgcatgagcccagcgacactcttggctgcgctcaacaattacggccgcgacaacggcatcggccgtctcgacctcgtcgagaaccgtttcgtcggcatgaagtcgcgcggcgtctacgagacaccaggcggcacgatcctgcttacggcgcaccgcgccatcgaatcgatcacgctcgaccgcggtgccgcccatctcaaggacgacatcatgccgcgttacgccgagctgatctattacggcttctggttctcgccggagcgcgagatgctgcaggcgctgatcgacaagagccaggagcatgtcgagggcgaagtgacgctgaagctctacaagggcaatgttatggtcatcggccgcgaaagcgacaagtcgctctattccgacaagctcgtcactttcgaggacgatcagggcgcctacgaccagaaggatgcggccggcttcatcaagctcaatgcgctgcgcctgcgcacgctcgccaagcgcaacctcgtgaaataa

SEQ ID NO: 5400 - protein, 407 aa, Rhizobium leguminosarum bv
MASYKDVKKVVLAYSGGLDTSIILKWLQTELGAEVVTFTADLGQGEELEPARKKAEMLGIKEIYIEDVREEFVRDFVFPMFRANAVYEGVYLLGTSIARPLISKHLIDIAKKTGADAIAHGATGKGNDQVRFELSAYALNPDIKIIAPWRDWAFKSRTDLLAFAEQHQIPVAKDKMGEAPFSVDANLLHSSSEGKVLEDPSQEAPEYVHMRTISPEAAPDKATTIKVGFEKGDAVSINGVRMSPATLLAALNNYGRDNGIGRLDLVENRFVGMKSRGVYETPGGTILLTAHRAIESITLDRGAAHLKDDIMPRYAELIYYGFWFSPEREMLQALIDKSQEHVEGEVTLKLYKGNVMVIGRESDKSLYSDKLVTFEDDQGAYDQKDAAGFIKLNALRLRTLAKRNLVK

SEQ ID NO: 5401 - DNA, 1218 bp, Acidobacteria bacterium
  CDS (1)..(1218): transl_table=11
atgcgtgaaaaaatcgttcttgcttattccggaggccttgatacctccatcatcattccttggctgaaggaaaactatagctgcgacgtcattgccatggttggtgacgtcggacagggcgacgacatcgatgccgtcgtagcgaaggctcataaaacgggcgcttccaaagtcatcgtaaaggacctccgcgaggagttcctcacccagtacgtctatcccgcgatctccaccggcgcggtctacgagcacaagtatctgctcggaacttcgctcgcacgtccgccgatcgcgaaggcgcaagtcgaagtcgcactcgccgaaggcgccactgcggtctcgcacggctgcactggcaagggcaacgaccaggtccgcttcgaacatgccttccaggcgctcgcgccggaactcaagatcatcgctccctggcgcgaatggacgctgaagtcccgcgaagattgtctcgactacgccgaagcccatggcatctccgttgcgcagagccgcgagaagatccactcccgcgatcgcaacttgctgcacgttagccacgagggcggggaactcgaagatcccaacaacgctccactcgataccacttggacgtggaccaagtccccgcaggaagcgcccgatcgcgtcgaagaagtcaccatcggattcgaaggcggcgtgccggtttccatcaacggcatgaagctcgaaccgctcgcgctcatcgagttgctcaatgaaattggcgcgcgcaacgccatcggccgcatcgatctcgtcgagaaccgcttcgtcggcatcaagtcgcgtggctgctatgagacccccggcggatctctgctgctcgccgcgcatcgcgaactcgaggccctctgtctcgatcgcgacaccctgcactacaagcaggaagtcgcgctcaagtgggcggaactcgtgtacttcggcctctggttcacgccgctgcgcgaatcgctcgacgctttcgtcgcgagcacgcagaagaacattgccggcgccgtgaagctcgccctctacaagggcaacatcgccgtagccgggcgcacctcgcccaaatcgctctatcgtcccgacatcgccagcttcaccatgggtgcgggctacgaccagaaggacgccgaaggcttcatccgcattctcggactgcccgcgcgttcgcgtgcgctcatcgagaacgccggcaaagaaaaggtgtcgaaatga

SEQ ID NO: 5402 - protein, 405 aa, Acidobacteria bacterium
MREKIVLAYSGGLDTSIIIPWLKENYSCDVIAMVGDVGQGDDIDAVVAKAHKTGASKVIVKDLREEFLTQYVYPAISTGAVYEHKYLLGTSLARPPIAKAQVEVALAEGATAVSHGCTGKGNDQVRFEHAFQALAPELKIIAPWREWTLKSREDCLDYAEAHGISVAQSREKIHSRDRNLLHVSHEGGELEDPNNAPLDTTWTWTKSPQEAPDRVEEVTIGFEGGVPVSINGMKLEPLALIELLNEIGARNAIGRIDLVENRFVGIKSRGCYETPGGSLLLAAHRELEALCLDRDTLHYKQEVALKWAELVYFGLWFTPLRESLDAFVASTQKNIAGAVKLALYKGNIAVAGRTSPKSLYRPDIASFTMGAGYDQKDAEGFIRILGLPARSRALIENAGKEKVSK

SEQ ID NO: 5403 - DNA, 1224 bp, Agrobacterium tumefaciens
  CDS (1)..(1224): transl_table=11
atggcactcccgaaagacgttaagaaagtcgttctcgcctattccggcggcctcgacacctcgatcatcctgaaatggcttcagacggaactcggcgccgaggtcgtgaccttcaccgccgatctcggccagggcgaagagcttgagccggcacgcaagaaggctgagatgctgggcatcaaggaaatctttgtcgaggacgttcgcgaagagttcgtgcgtgatttcgtgtttccgatgttccgcgccaatgccgtttatgaaggcgtctatctgctcggcacgtcgattgcccgtccgctgatttccaagcacctgatcgagatcgccaagaagaccggcgctgacgccatcgcccacggcgccaccggcaagggcaacgaccaggtccgcttcgagctttcggcctatgcgttgaaccctgacatcaagatcattgcgccctggcgcgactggacgttcaagagccgtaccgacctcctgaacttcgccgaacagcaccagatcccggtcgccaaggacaagaagggtgaagcgcctttctccgttgacgccaacctcttgcactcctcctccgagggcaaggtgctggaagacccggcggtggaagcacctgaatatgtgcatatgcgcaccatttccccggaagcggctcccgacaaggcgaccgtcatcaaggtcggtttccgcaagggcgatgcctgctccatcaacggtgttgaaatgtcgcccgcgacgcttcttgccacgctcaacaactacggtcgcgaaaacggcatcggccgcctcgatctggtcgagaaccgtttcgtcggcatgaagtcacgcggcgtttacgagacgcccggcggcacgatcctgctggcagcgcaccgcgccatcgaatccatcacactcgaccggggtgccgcgcatctcaaggacgatctgatgccgcgttacgctgagcttatctattacggcttctggttttcgccggagcgcgaaatgctgcaggccctgatcgacaagagccaggaacatgtcgaaggcgaagtgacgctgaagctctacaagggcaatgtcatggtaaccggccgcgagagcgagaagtcgctgtattccgacgcgctggtgaccttcgaggacgaccacggcgcttacgaccagaaggatgctgctggcttcatcaagctcaatgcgctgcgtcttcgcacgctcgccaagcgtaacctcaacaagtaa

SEQ ID NO: 5404 - protein, 407 aa, Agrobacterium tumefaciens
MALPKDVKKVVLAYSGGLDTSIILKWLQTELGAEVVTFTADLGQGEELEPARKKAEMLGIKEIFVEDVREEFVRDFVFPMFRANAVYEGVYLLGTSIARPLISKHLIEIAKKTGADAIAHGATGKGNDQVRFELSAYALNPDIKIIAPWRDWTFKSRTDLLNFAEQHQIPVAKDKKGEAPFSVDANLLHSSSEGKVLEDPAVEAPEYVHMRTISPEAAPDKATVIKVGFRKGDACSINGVEMSPATLLATLNNYGRENGIGRLDLVENRFVGMKSRGVYETPGGTILLAAHRAIESITLDRGAAHLKDDLMPRYAELIYYGFWFSPEREMLQALIDKSQEHVEGEVTLKLYKGNVMVTGRESEKSLYSDALVTFEDDHGAYDQKDAAGFIKLNALRLRTLAKRNLNK

SEQ ID NO: 5405 - DNA, 1209 bp, Alkalilimnicola ehrlichei
  CDS (1)..(1209): transl_table=11
atgagcgacgtcaagaaggtggtgctcgcctattccggcggtctcgacacctcggtcatcctgcaatggctgcgcgagacctacgactgcgaggtggtgaccttcaccgccgacctggggcagggcgaggagctggagccggcacgcaagaaggccgaggcctttggcatcaaagagatctacatcgacgatctgcgcgaggagttcgtccgcgatttcgtcttccccatgttccgggccaacgccatctacgagggtgagtacctgctcggcacctccatcgcccggccgctgatcgccaaacgccaggtggagatcgcccgcgagaccggcgccgacgccgtctcccacggggccaccggcaagggcaacgaccaggtgcgcttcgagctcggctactacggcctggagccgaacattaaggtgatcgccccctggcgcgaatgggatctcaactcccgcgagaagctgctggcctacgccgagaagcacggcatctccatcgagggcaagcagtccggcggctcgccctactccatggacgcgaacctgttgcacatctcctacgagggcggggtcctggaggacacttggaccgagtgcgaggaggccatgtggcgctggacgcgctcgcccgaggcggccccggacgaggcccaatatatcgacatcgagtttcagggcggcgacccggtgagtatcgacggcgagaagctcagccccgccgcgctgctgagccggctcaacgacctgggcgccatgcacggcgttggccggatcgatatcgtcgagaaccgctatgtgggcatgaagtcccgcggctgctacgaaaccccgggcggcaccatcctgctgcgcgcccaccgggccatcgagtccatcaccctggaccgcgagagcgcccacctgaaggacgaggtgatgcccaagtacgccgagttgatctacaacggctactggtggagcccggagcgcgaggccatgcaggcgttgatcgatgccacccagcgccgggtcaacggcgtggtgcggctgaagctctacaaggggaatgtcattgtggtgggacgcgattccgcgaacgattcgctgttcgaccagaccattgccaccttcgaggatgatcgcggcgcctacgatcagaaggacgccgagggctttatccgcctcaacgccctgcgcctgcgtatcgcccagcggcgcggctga

SEQ ID NO: 5406 - protein, 402 aa, Alkalilimnicola ehrlichei
MSDVKKVVLAYSGGLDTSVILQWLRETYDCEVVTFTADLGQGEELEPARKKAEAFGIKEIYIDDLREEFVRDFVFPMFRANAIYEGEYLLGTSIARPLIAKRQVEIARETGADAVSHGATGKGNDQVRFELGYYGLEPNIKVIAPWREWDLNSREKLLAYAEKHGISIEGKQSGGSPYSMDANLLHISYEGGVLEDTWTECEEAMWRWTRSPEAAPDEAQYIDIEFQGGDPVSIDGEKLSPAALLSRLNDLGAMHGVGRIDIVENRYVGMKSRGCYETPGGTILLRAHRAIESITLDRESAHLKDEVMPKYAELIYNGYWWSPEREAMQALIDATQRRVNGVVRLKLYKGNVIVVGRDSANDSLFDQTIATFEDDRGAYDQKDAEGFIRLNALRLRIAQRRG

SEQ ID NO: 5407 - DNA, 1203 bp, Anabaena sp
  CDS (1)..(1203): transl_table=11
atgggtcgcgccaaaaaggttgttctggcatattctggtggagtagatacctccgtttgcatcccctatctcaaacaagagtggggagtagaagaggtaattaccctagcagcagatttaggccagggagatgaattagaaccaatccgagaaaaagcactaaaatcaggtgcaagtgaatccctcgtagcggatgtcaaagaaagttttattaaagattatgcttttcccgcgatacaggccaacgccctctacgaaaatcgctatccgctaggaactgctttagcccgtccgttaattgctaagatattggtcgaagctgcggcaaaatacggtgctgatgcgatcgcacatggttgtacaggtaagggtaatgatcaggtgcgctttgatgtctcttgtactgcactcaatcctaatttgaagatcctcgccccggcgcgggaatggggaatgagcagagaagcaaccatcgcctatggtgaaaagtttggcatcccctcacccgtgaaaaagtcttcgccttacagcattgataaaaatttacttggtcgtagtattgaagctggtgcgttggaagatcccaaatttgagccaccagaagaaatctatgaaatgacaaaggcgatcgccgacacccccaatgagccagaatacattgaaataggttttactcaaggtctgccaactacactcaacggtatacctaaagaccctgtagcactcattcaagaactcaatcaggtggtaggaagtcacggtgtcggacgcatcgacatgattgaaaaccgattagtgggaatcaaatcacgagagatttacgaatctccggcaatgttggtgctaattccagcccacagagacctagaaagcctgacattaaccgccgatgttagccactacaaacgaggtattgaagagacctacagccaaatagtttacaacggtctgtggtacagccccctgaaagccgccttagatgcctttattcaaaagacccaagaacgggtgtcaggaactgtcagagtgaaactattcaaaggtaacgccaccatagtcggacgctggagcgatagttcactctacacccccgatttagcaacctacggcgctgaagaccaatttgaccacaaagccgccgaaggcttcatttacgtttggggattaccaactcgtatctgggcgcagcaggatagaggttaa

SEQ ID NO: 5408 - protein, 400 aa, Anabaena sp
MGRAKKVVLAYSGGVDTSVCIPYLKQEWGVEEVITLAADLGQGDELEPIREKALKSGASESLVADVKESFIKDYAFPAIQANALYENRYPLGTALARPLIAKILVEAAAKYGADAIAHGCTGKGNDQVRFDVSCTALNPNLKILAPAREWGMSREATIAYGEKFGIPSPVKKSSPYSIDKNLLGRSIEAGALEDPKFEPPEEIYEMTKAIADTPNEPEYIEIGFTQGLPTTLNGIPKDPVALIQELNQVVGSHGVGRIDMIENRLVGIKSREIYESPAMLVLIPAHRDLESLTLTADVSHYKRGIEETYSQIVYNGLWYSPLKAALDAFIQKTQERVSGTVRVKLFKGNATIVGRWSDSSLYTPDLATYGAEDQFDHKAAEGFIYVWGLPTRIWAQQDRG

SEQ ID NO: 5409 - DNA, 1203 bp, Anabaena variabilis
  CDS (1)..(1203): transl_table=11
atgggtcgcgccaaaaaggttgttctggcatattctggtggagtagatacctccgtttgcattccctacctaaaacaagagtggggagtagaagaggtaattaccctagcagcagatttaggccagggagatgaattagaaccaatccgagaaaaagcactaaaatcgggtgcaagtgaatccctcgtagcggatgtcaaagaaagttttattaaagattatgcttttcccgcgatacaggccaacgccctctatgaaaatcgctatccgctaggaactgccttagcccgtccgttgattgcgaagatattggtcgaagcagcagaaaaatacggtgctgatgcgatcgcacatggttgtacaggtaaaggtaatgatcaggtgcggtttgatgtctcttgtactgctctcaatcctaaattgaagatcctcgcccccgcacgggaatggggtatgagtcgggaagcaaccatcgcctacggtgaaaagtttggcattccctcacctgtgaaaaagtcttcaccttacagcattgataagaatttacttggtcgcagtattgaagctggtgcgctggaagatcccaaatttgagccaccagaagaaatttatgagatgacaaaggcgatcgccgacaccccaaatgagccagaatacattgaaataggatttactcaaggtcttcccacgactatcaacggtacacccaaagaccctgtagcgctcatccaagaactaaatcaactagttggtagtcacggtgtcggacgcatcgatatgattgaaaaccgattagtgggaatcaaatcacgagagatttacgaatctccggcaatgttggtgctaattcaagcccacagagacctagaaagcctgacattaaccgccgatgttagccactacaaacgaggtattgaagagacctacagccaaatagtttacaacggcttgtggtacagtcccctgaaagccgctttagatgcctttattcaaaagactcaagaacgggtatcaggaattgtcagagtgaaactattcaaaggtaacgccaccatagtcggacgctggagcgatagttcactctacacccccgacttagcaacttacggcgctgaagaccaatttgaccacaaagccgccgaaggcttcatttacgtttggggattaccaactcgtatctgggcgcagcaggatagaggttaa

SEQ ID NO: 5410 - protein, 400 aa, Anabaena variabilis
MGRAKKVVLAYSGGVDTSVCIPYLKQEWGVEEVITLAADLGQGDELEPIREKALKSGASESLVADVKESFIKDYAFPAIQANALYENRYPLGTALARPLIAKILVEAAEKYGADAIAHGCTGKGNDQVRFDVSCTALNPKLKILAPAREWGMSREATIAYGEKFGIPSPVKKSSPYSIDKNLLGRSIEAGALEDPKFEPPEEIYEMTKAIADTPNEPEYIEIGFTQGLPTTINGTPKDPVALIQELNQLVGSHGVGRIDMIENRLVGIKSREIYESPAMLVLIQAHRDLESLTLTADVSHYKRGIEETYSQIVYNGLWYSPLKAALDAFIQKTQERVSGIVRVKLFKGNATIVGRWSDSSLYTPDLATYGAEDQFDHKAAEGFIYVWGLPTRIWAQQDRG

SEQ ID NO: 5411 - DNA, 1206 bp, Aquifex aeolicus
  CDS (1)..(1206): transl_table=11
atgaagaaaaagagggtaattctcgcatactcgggcggactcgacacatccataatagtgagatggctcacggaaaaagggtacgaggtaataacatacaccgcggacgtgggacagggagaagaactctctgaaattcccgaaaaggcaaggagagcgggagcgattgaagccatagtagaggatttaaaagaaacctttgcggaaaattactgccttccaactttgagggcattagccctttacgaagggaagtaccccctcaccgcagccctctcaagacctctcatagcagagaggctcgtttactatgccgaaaagttcaacgcggactacgtagcacacggctcaactgggaagggaaacgatcaggtgaggtttgaactctcagtctgggccctaaaccccgatatagaggttctcgctcccgtgagagaatgggagttcaaatcaagggaagaacaagttgagtacgctcagaggttcaacatccccgttaaagctacgaaagaaaagccatactccatagacaggaacctctggggcgtttccatagagtgcggacccttagaagacccgtggcaagaaccaccgcaagacgcttaccagatcacccaatcccctgaagaggctccggatgaaccagaatacgttaccgtgggttttgaaaaaggaaaacccgtttacctgaacggtgagcgctacgaagagcagtggaaattgatagccaacctaaatgaaatagcgggaagacacggtgtgggaaggatagacatggttgaaaacagactcgtagggataaagagcagggagatatacgaagctcccggagccatggttctctacgaagcatacagggatttactctctttagttcttgacaggtttaccttccactacttcctcacccatattccccacgagtacgcaaagctcgtttacgaaggtctctggttcacccccttgagggaagcgcttgacgcctttacgaataaaatcgccgagttcgcaacgggagaagtaagattaaaactctacaaaggaagtgtaagcgttgttgggagacgttcacccaactccctttacgttgaagagctcgcaacttactcggaaaaggaccaatttgaccaaatagcaggtaagcacttcacaaaggtatggggacttccactgaaggttctgggaagggtgagaaaaggtaaatag

SEQ ID NO: 5412 - protein, 401 aa, Aquifex aeolicus
MKKKRVILAYSGGLDTSIIVRWLTEKGYEVITYTADVGQGEELSEIPEKARRAGAIEAIVEDLKETFAENYCLPTLRALALYEGKYPLTAALSRPLIAERLVYYAEKFNADYVAHGSTGKGNDQVRFELSVWALNPDIEVLAPVREWEFKSREEQVEYAQRFNIPVKATKEKPYSIDRNLWGVSIECGPLEDPWQEPPQDAYQITQSPEEAPDEPEYVTVGFEKGKPVYLNGERYEEQWKLIANLNEIAGRHGVGRIDMVENRLVGIKSREIYEAPGAMVLYEAYRDLLSLVLDRFTFHYFLTHIPHEYAKLVYEGLWFTPLREALDAFTNKIAEFATGEVRLKLYKGSVSVVGRRSPNSLYVEELATYSEKDQFDQIAGKHFTKVWGLPLKVLGRVRKGK

SEQ ID NO: 5413 - DNA, 1173 bp, Archaeoglobus fulgidus
  CDS (1)..(1173): transl_table=11
atgaaggttgtgctgtcatattccggtgggcttgatacgacggtctgcatccctctgcttaaagagaagtacggttttgatgaggttatcacggtcaccgttgacatagggcagcctgaagcggatataaagcaggcagaggagaggggaaagaagtatgcggacaagcactacacaatcgatgcgaaaaaggagtttgttgattccctcttcatgctgatcaaggctaacggcaattacgaaggttacgttttgggaacggctttggctaggccgctgatagccgaaaaggttgttgaagtcgccaagaaggagggggctgaggcggttgctcatggatgcacggggaagggaaacgaccagctcagattcgagaacattttcaggcagcacggatttaaggtcatcgcccccgtgagagagctgaacctcacgagagagtgggaaatcgaatacgcgaggcagcacggcattgaggtgcccgcaacaaaggagaagccgtacagcatcgacgagaatctctggagcaggagcgttgagggagggaagctggaagatccatccttcgagccgcctgaggacatctacgagtggacagcgagcccggaaaaggctccagacaagccagagatcgtaaagatagatttcgagaagggagttcctgtagcgctgaacgatgagagaatgggcggatttgagctgataaaagcccttaacgagattggcggaaagcacggagtgggaagaacggacatgattgaggacagggttctcggactgaaggcgagggagaactacgagcatcctgcagccacaatccttataacagcccacagggaccttgaaaacctcgtcctcagcagaagggagctgaagttcaagaagttcgttgaggaggagtgggcggagcttgtttactatggcctggtcaacgacccgcttttcgacgctctgaacgccttcatagacaagacacaggagagggtgacggggtgggttaaagttaagctttacaagggctccgcagttgttgtggccagaaactcaccctacgccctttactcggaagagctcgtctccttcgacacggagtccattgaccagcgccttgctgagggatttgcggcattccacggtctgcagggcaggctgttcaggaggctgtttcaataa

SEQ ID NO: 5414 - protein, 390 aa, Archaeoglobus fulgidus
MKVVLSYSGGLDTTVCIPLLKEKYGFDEVITVTVDIGQPEADIKQAEERGKKYADKHYTIDAKKEFVDSLFMLIKANGNYEGYVLGTALARPLIAEKVVEVAKKEGAEAVAHGCTGKGNDQLRFENIFRQHGFKVIAPVRELNLTREWEIEYARQHGIEVPATKEKPYSIDENLWSRSVEGGKLEDPSFEPPEDIYEWTASPEKAPDKPEIVKIDFEKGVPVALNDERMGGFELIKALNEIGGKHGVGRTDMIEDRVLGLKARENYEHPAATILITAHRDLENLVLSRRELKFKKFVEEEWAELVYYGLVNDPLFDALNAFIDKTQERVTGWVKVKLYKGSAVVVARNSPYALYSEELVSFDTESIDQRLAEGFAAFHGLQGRLFRRLFQ

SEQ ID NO: 5415 - DNA, 1230 bp, Azoarcus sp
  CDS (1)..(1230): transl_table=11
atgagcgacgtcaagaaagcggtgcttgcctattcgggcgggctggatacctcggtcatcctgaagtggctgcaggatacctatcagtgcgaagtggtgacgttcacggccgacctcggccagggcgaagagctcgagcccgcgcgccagaaagcgctgaagttcggcatcaagcccgacaacatcttcatcgacgacctgcgcgaagagttcgtgcgcgacttcgtcttcccgatgttccgctgcaacacggtttatgagggcgaatacctgctcggcacgtcgatcgcccgtccgctgatcgccaagcgccagatcgagatcgcgcgcgcgaccggcgctgacgcggtgtcgcacggcgcaaccggcaagggcaacgaccaggtccgcttcgaactcggctattacgcgctgatgccgggcgtgaaagtcatcgcgccgtggcgcgaatgggaccttttgtcgcgcgagaagctgctcgcgtacgccgagaagcacggcatcccgatcgagatgaagcacaagcagggcggctcgccgtattcgatggacgcgaacctgctgcacatctcgttcgaaggccgccacctcgagaacccggctgcggaagccgaggagtcgatgtggcgctggaccgtgtcaccggaagcggcgcccgacgcggccgagtacctcgacctcgaattcgagcgcggcgacctcgtcgcgatcaacggcacgcgcatgaaggcgcacgagctgctcgcgaagctcaacgagctcggcggcaagcatggcatcggccgcctcgacctcgtcgaaaaccgctatgtcggcatgaagagccgcggctgctacgaaaccccgggcggcacgatcctgctgcgtgcccaccgcgcgatcgaatccgtgacgctcgaccgcgaagtcgcgcacctcaaggacgacctgatgccgcgctacgccagcctgatctacaacggctactggtggagcccggagcgtcgcgcgctgcaggcgctgatcgacaacacgcaggaatcggtcaacggttgggtgcgcgtcaagctctacaagggcaacgtcatcgtcaccggccgcgactcgaagaccgattcgctgttcgacccgacgatcgcgacgttcgaggacgaccagggcgcctacaaccagaaggacgcgcacggcttcatccgcctcaacgcgctgcgcatgcgcatcgcggcgaacgcgcagacgaagcgcggctaa

SEQ ID NO: 5416 - protein, 409 aa, Azoarcus sp
MSDVKKAVLAYSGGLDTSVILKWLQDTYQCEVVTFTADLGQGEELEPARQKALKFGIKPDNIFIDDLREEFVRDFVFPMFRCNTVYEGEYLLGTSIARPLIAKRQIEIARATGADAVSHGATGKGNDQVRFELGYYALMPGVKVIAPWREWDLLSREKLLAYAEKHGIPIEMKHKQGGSPYSMDANLLHISFEGRHLENPAAEAEESMWRWTVSPEAAPDAAEYLDLEFERGDLVAINGTRMKAHELLAKLNELGGKHGIGRLDLVENRYVGMKSRGCYETPGGTILLRAHRAIESVTLDREVAHLKDDLMPRYASLIYNGYWWSPERRALQALIDNTQESVNGWVRVKLYKGNVIVTGRDSKTDSLFDPTIATFEDDQGAYNQKDAHGFIRLNALRMRIAANAQTKRG

SEQ ID NO: 5417 - DNA, 1206 bp, Bacillus anthracis
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcattaaatccttacttagaagtaattgcacctgtacgtgaatggaaatggtcacgtgaagaagaaattgcctatgcaaaagaaaataatgtaccgattccaattaatttagatagcccgttttcaatcgatcaaaatttatggggacgcagcaatgaatgcggcattttagaagatccatgggcagcgccgccagaagatgcatatgagatgacattggcattagaagacacaccgaataaaccagaatttgtagaaattggctttgaagcaggcgtaccgactactttaaatggcactgcatatccactttcagaacttattaaaacgttaaatgcacttgctggaaaacatggcgttggacgtatcgatcacgtagaaaatcgtcttgttggtattaaatcacgtgaagtatacgaatgcccagcagcaatgacattaattacggcgcataaagaacttgaagatttaacacttgtaaaagaagtagcacattttaaaccgatgattgagcaaaaaataacagagcttatttataacggtttatggttctcgcctttaaaacaagcgcttcatgctttcttacaagaaacgcaaaagaatgtaacaggcacggtgcgtgtgaaattatttaaaggtcatgcaattgtagaagggcgtaaatctgagtactctttatacgatgaaaaattagcaacgtatactgctcaggatgaatttaatcatgatgcagcagttggattcatttcattattcggtttaccgacgaaagtatatagccaagtgaatcaaaagaaggtggaagcgtga

SEQ ID NO: 5418 - protein, 401 aa, Bacillus anthracis
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGTVRVKLFKGHAIVEGRKSEYSLYDEKLATYTAQDEFNHDAAVGFISLFGLPTKVYSQVNQKKVEA

SEQ ID NO: 5419 - DNA, 1206 bp, Bacillus cereus
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaatgaatatgcattgatggcgatgcaagcgcacacgttatacgaagggaaataccctctcgtttcggcgctatcacgcccacttatcgcgaagaaattagtggaaattgcagaacaagaaggtgcgactgcagtggcacacggatgtacagggaaagggaatgatcaagttcgttttgaagtttctattcaagcgttaaatccttacttagaagtgattgcgcctgtacgtgaatggaaatggtcacgtgaagaagaaattgcatatgcaaaagaaaacgatgtaccaattccgattaatttagatagcccgttttcaatcgatcaaaatttatggggacgtagcaatgaatgtggcattttagaagatccatgggcagcgccgccagaagatgcatatgagatgacattagcattagaagatacaccgaataaaccagagtttgtagaaatcggctttgaagcaggcgtaccgacgactttaaatggtactgcctatccactttcagaacttattaaaacgttaaatgcacttgctggaaagcatggcgttggacgtatcgatcacgtagaaaatcgccttgttggtattaaatcgcgtgaagtatacgaatgcccagcagcgatgacattaattacggcgcacaaggaactggaagatttaacactcgtaaaagaagtagcgcattttaaaccgatgattgagcagaaaataacagaacttatttataacggtttatggttctcgcctttaaaacaagcgctgaatgctttcttacaagaaacgcaaaagaatgtaacaggcatggtgcgtgtgaaattatttaaaggccatgcgattgtagaaggacgtaaatctgagtactctttatacgatgaaaaattagcaacgtatactgctcaggatgaatttaatcatgatgcagcagttggattcatttcattattcggtttaccgacgaaagtatacagccaagtgaatcaaaagaaggtggaagcgtga

SEQ ID NO: 5420 - protein, 401 aa, Bacillus cereus
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENDVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALNAFLQETQKNVTGMVRVKLFKGHAIVEGRKSEYSLYDEKLATYTAQDEFNHDAAVGFISLFGLPTKVYSQVNQKKVEA

SEQ ID NO: 5421 - DNA, 1206 bp, Bacillus cereus
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacattatacgaagggaaataccctcttgtctctgcattatctcgtccgcttattgcgaagaaattagtagaaatcgcagaacaagaaggcgcaactgcagttgcacacggatgtacagggaaaggaaatgatcaagttcgttttgaagtttctattcaagcattaaatccttacttagaagtgattgcacctgtacgtgaatggaagtggtcacgtgaagaagaaattgcctatgcaaaagaaaacgatgtaccaattccgattaatttagatagcccgttttcaatcgatcaaaacttatggggacgcagcaacgaatgtggaattttagaagatccatgggcagcgccgccagaagatgcatatgagatgacattggcattagaagatacaccgaataaaccagagtttgtagaaatcggatttgaagcaggcgtaccgactactttaaatggcactgcatattcacttgcagaattaattaaaacgttaaatgcgcttgctggaaaacacggcgttggacgtattgatcacgtagaaaatcgtcttgtcggtattaaatctcgtgaagtatacgaatgcccagcagcaatgacgttaatcactgcgcataaagagttggaagatttaacacacgtaaaagaagtagcacattttaaaccagtgattgaacagaaaataacagaacttatttataatggtttatggttctcgcctttaaaacaagcgcttcatgcatttttacaagaaacgcaaaagaatgtaacaggtacagtgcgtgtgaaattatttaaaggtcatgcgattgtagaaggacgtaaatctgaatactctttatacgatgaaaaattagcaacatatactgctcaagatgaatttaatcatgatgcagcagttggattcatttcattattcggtttaccgacgaaagtatacagccaagtgaatcaaaagaaggtggaagcgtga

SEQ ID NO: 5422 - protein, 401 aa, Bacillus cereus
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENDVPIPINLDSPFSIDQNLWGRSNECGILEDPWAAPPEDAYEMTLALEDTPNKPEFVEIGFEAGVPTTLNGTAYSLAELIKTLNALAGKHGVGRIDHVENRLVGIKSREVYECPAAMTLITAHKELEDLTHVKEVAHFKPVIEQKITELIYNGLWFSPLKQALHAFLQETQKNVTGTVRVKLFKGHAIVEGRKSEYSLYDEKLATYTAQDEFNHDAAVGFISLFGLPTKVYSQVNQKKVEA

SEQ ID NO: 5423 - DNA, 1206 bp, Bacillus cereus
  CDS (1)..(1206): transl_table=11
atggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcgttaaatccttacttagaagtaattgcacctgtacgtgaatggaaatggtcacgtgaagaagaaattgcctatgcaaaagaaaacaatgtaccgattccaattaatttagatagcccgttttcaatcgatcaaaatttatggggacgcagcaatgaatgtggcattttagaagatccatgggcagcgccgccagaagatgcatatgagatgactttggcattagaagatacaccgaataaacctgagtttgtagaaatcggttttgaagcaggcgtaccgactactttaaatggtactgcctatccactttcagaacttattaaaacgttaaatgcacttgctggaaaacatggcgttggacgtatcgatcacgtcgaaaatcgtctggttggtattaaatcgcgtgaagtatacgaatgcccagcagcaatgacattaattacggcgcataaggaactggaagatttaacactcgtaaaagaagtagcgcattttaaaccgatgattgagcaaaaaataacagaacttatttataacggtttatggttctcacctttaaaacaagcgcttaacgctttcttacaagaaacgcaaaagaatgtaacaggtacagtgcgtgtgaaattatttaaaggccatgcgattgtagaaggacgtaaatctgagtactctttatacgatgaaaaactagcaacatatactgcccaggacgagtttaatcatgatgcagcagttggattcatttcattattcggtttaccgacgaaagtatacagccaagtgaaccaaaagaaggtggaagcgtga

SEQ ID NO: 5424 - protein, 401 aa, Bacillus cereus
MEKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALNAFLQETQKNVTGTVRVKLFKGHAIVEGRKSEYSLYDEKLATYTAQDEFNHDAAVGFISLFGLPTKVYSQVNQKKVEA

SEQ ID NO: 5425 - DNA, 1230 bp, Bacillus halodurans
  CDS (1)..(1230): transl_table=11
atgagcaaaaagaaagttgtcttagcgtattctgggggattagatacatctgtagccattaagtggcttagcgataaaggatatgatgtcattgccgttggccttgatgtcggtgaaggaaaggatcttgaatttgtaaaggaaaaagcattgaaagtaggcgcgatcgaatcgtatacaattgatgcgaaaaaagaatttgcggaagaatttgttttgccggcattgcaagcacatgcgttgtatgaacaaaaatacccgcttgtttccgccctatctcgtccattgatttcgaaaaagcttgtagaaatcgcggaacaaacaggcgcacaggcagtagcccacggttgtaccggaaaaggaaacgatcaagtgcgctttgaggtatcgatccaagcattaaatccaaacttagaagttttagcccctgtacgtgagtgggcatggtctcgtgatgaagagattgagtacgctaagaaaaacaacattccaattccgattgatttagataatccgtactctgtcgatcaaaacctatggggacgtagcaacgagtgcggaattttagaagatccgtgggcaacacctccagaaggtgcttatgagttaacagtcgcaatcgaggatgctcccgatcaaccagaaattgtggaaattggatttgaaaaaggaatccctgttacgttgaacgggaaaagctatccagtccatgaattgatcctagagttgaatcaaatcgcaggtaagcatggagttggacgaattgatcacgtagaaaatcgcttggtcggtattaagtctcgtgaagtgtacgaatgtcctggagcgatgacactcattaaagctcataaagagttggaggatttaacgttaacaaaagaagtggcccattttaaaccagttgtagagaaaaaaatagcagagctcatttatgaaggtctttggttctcaccacttcaacccgctttgtctgccttcttaaaggaaactcaatccacagtgactggggttgtacgggtaaaactgtttaaagggcacgccattgtagaaggacgtaaatcagagtattccctttataatgaaaagctagccacttacacaccagatgacgaatttgatcataatgcagcggtaggcttcatctccttatggggactaccaacgaaagtgtatagtatggtgaacaaggaaatgaaggaaaagcaagagaagaaggaggttacatcgtga

SEQ ID NO: 5426 - protein, 409 aa, Bacillus halodurans
MSKKKVVLAYSGGLDTSVAIKWLSDKGYDVIAVGLDVGEGKDLEFVKEKALKVGAIESYTIDAKKEFAEEFVLPALQAHALYEQKYPLVSALSRPLISKKLVEIAEQTGAQAVAHGCTGKGNDQVRFEVSIQALNPNLEVLAPVREWAWSRDEEIEYAKKNNIPIPIDLDNPYSVDQNLWGRSNECGILEDPWATPPEGAYELTVAIEDAPDQPEIVEIGFEKGIPVTLNGKSYPVHELILELNQIAGKHGVGRIDHVENRLVGIKSREVYECPGAMTLIKAHKELEDLTLTKEVAHFKPVVEKKIAELIYEGLWFSPLQPALSAFLKETQSTVTGVVRVKLFKGHAIVEGRKSEYSLYNEKLATYTPDDEFDHNAAVGFISLWGLPTKVYSMVNKEMKEKQEKKEVTS

SEQ ID NO: 5427 - DNA, 1206 bp, Bacillus thuringiensis subsp
  CDS (1)..(1206): transl_table=11
atggataagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgatgttcaagaagaatttgcaaacgaatatgcattgatggcgatgcaagcacacacgttatacgaagggaaatatcctctcgtttcggcgttatctcgtccacttatcgcaaagaaattagtagaaattgcagaacaagaaggagcgactgcagttgcacacggatgtacagggaaagggaatgatcaagttcgttttgaagtttctattcaagcattaaatccttacttagaagtaattgcacctgtacgtgaatggaaatggtcacgtgaagaagaaattgcctatgcaaaagaaaataatgtaccgattccaattaatttagatagcccgttttcaatcgatcaaaatttatggggacgcagcaatgaatgtggcattttagaagatccatgggcagcgccgccagaagatgcatatgagatgacattggcattagaagacacaccgaataaaccagaatttgtagaaattggctttgaagcaggcgtaccgactactttaaatggcactgcatatccactttcagaacttattaaaacgttaaatgcacttgcaggaaaacatggcgttggacgtatcgatcacgtagaaaatcgtcttgttggtattaaatcacgtgaagtatacgaatgcccagcagcaatgacattaattacggcgcataaagaacttgaagatttaacacttgtaaaagaagtagcacactttaaaccgatgattgagcaaaaaataacagagcttatttataacggtttatggttctcgcctttaaaacaagcgcttcatgctttcttacaagaaacgcaaaagaatgtaacaggcatggtgcgtgtgaaattatttaaaggtcatgcaattgtagaagggcgtaaatctgagtactctttatacgatgaaaaattagcaacatatactgctcaggatgaatttaatcatgatgcagcagttgggttcatttcattattcggtttaccgacgaaagtatacagccaagtgaatcaaaagaaggtggaagcgtga

SEQ ID NO: 5428 - protein, 401 aa, Bacillus thuringiensis subsp
MDKKKVVLAYSGGLDTSVAIKWLQEKNYDIIALCLDLGEGKDLAFVKEKALSVGAIKSYMIDVQEEFANEYALMAMQAHTLYEGKYPLVSALSRPLIAKKLVEIAEQEGATAVAHGCTGKGNDQVRFEVSIQALNPYLEVIAPVREWKWSREEEIAYAKENNVPIPINLDSPFSIDQNLWGRSNECGILEDPWAAPPEDAYEMTLALEDTPNKPEFVEIGFEAGVPTTLNGTAYPLSELIKTLNALAGKHGVGRIDHVENRLVGIKSREVYECPAAMTLITAHKELEDLTLVKEVAHFKPMIEQKITELIYNGLWFSPLKQALHAFLQETQKNVTGMVRVKLFKGHAIVEGRKSEYSLYDEKLATYTAQDEFNHDAAVGFISLFGLPTKVYSQVNQKKVEA

SEQ ID NO: 5429 - DNA, 1212 bp, Bacillus licheniformis
  CDS (1)..(1212): transl_table=11
atgacgcaaaagaaaaaagtggtattagcatattcaggaggacttgatacttctgtcgcgataaagtggcttcaggaacagggatatgatgtagtggcctgctgccttgacgtcggagagggaaaggatctcgcctttgttcagcaaaaagcgcttcaagtcggagcctctaattcttatgttatcgatgcaaaagaagaatttgcgaaagagtttgcgctgaccgccctccaggcccacacgctttatgaaggaaagtatccgctcgtatcagccctgtccagaccgctgatcgccaaaaagctcgtcgaagtggctgagaaagaaaacgcgcaagccgtggctcacggctgcacaggcaaagggaatgaccaagtgcgcttcgaggtgtcgattaaatcgctcaatccggatttggaggtgctggcacctgtgcgcgaatggaaatggtctcgcgacgaagagatcgcgtatgcagaaaagcatggcattccaattccgatcaatcttgacagcccgtattcaatcgaccagaacctgtggggcagaagcaatgaatgcggagtcctggaagatccttgggccgcgcctcctgaaggagcgtatgatttgacgaagcctcttgaaaaaacaccggatactcctgatgtgatcgaaatcgcttttgaagaaggcgttcccgtatccattgacgggactcactacccgctgtcagacttgattttaaagctgaatgaactggcgggcgcacatggagtggggcgcatcgaccatgttgaaaaccgccttgtcggcatcaaatcgcgcgaagtttacgaatgcccgggcgcgatgactttgattaaggcgcacaaggagcttgaagatttgacattggtaaaagaagtggcgcatttcaaacctataatcgaacaaaaaatggctgaagtgatctataacggcctctggttttctccgcttaaagacgcgctttccggtttcctgaaagaaacgcagaagcatgtcacgggcgtcgtccgcgtcaagctgtttaaaggccatgcgatcgttgaagggcgtaagtccgaatactccctgtatgatgaaaagcttgcgacgtatacaaaagacgatgcattcgatcatcacgctgcagtcggctttatcgagctgtggggactgccgacgaaagtaaacagcatcgtccaaaaaaaggagcagattaaagcatga

SEQ ID NO: 5430 - protein, 403 aa, Bacillus licheniformis
MTQKKKVVLAYSGGLDTSVAIKWLQEQGYDVVACCLDVGEGKDLAFVQQKALQVGASNSYVIDAKEEFAKEFALTALQAHTLYEGKYPLVSALSRPLIAKKLVEVAEKENAQAVAHGCTGKGNDQVRFEVSIKSLNPDLEVLAPVREWKWSRDEEIAYAEKHGIPIPINLDSPYSIDQNLWGRSNECGVLEDPWAAPPEGAYDLTKPLEKTPDTPDVIEIAFEEGVPVSIDGTHYPLSDLILKLNELAGAHGVGRIDHVENRLVGIKSREVYECPGAMTLIKAHKELEDLTLVKEVAHFKPIIEQKMAEVIYNGLWFSPLKDALSGFLKETQKHVTGVVRVKLFKGHAIVEGRKSEYSLYDEKLATYTKDDAFDHHAAVGFIELWGLPTKVNSIVQKKEQIKA

SEQ ID NO: 5431 - DNA, 1212 bp, Bacillus clausii
  CDS (1)..(1212): transl_table=11
atggcgaaagaaaaagtagttttagcttactctgggggattggatacgtctgttgccgttaaatggctaactgacaaagggtatgacgttatagctgtcggcctcgatgttggcgaaggaaaagatttggagtttgtaaaacaaaaagcccttcaagttggggccattcaatcttatacaattgacgcaaaaaaagagtatgctgaatcatttgtcttgcctgcgttgcaagcacatgccctttatgagcaaaagtatcctcttgtttcggcgttatcacgcccgctcatttccaaaaagctcgtagagattgccgaacagacgggagcaacagcagtagcccatggctgcacaggaaaaggcaacgatcaagtgcgctttgaagtttccattcaagcgttaaatccgaacttaaaagtattagcacctgtaagggaatgggcatggtcacgtgatgaagaaatcgagtatgcaaaagcgcacaatatcccgattccgattgatcttgacaacccatattcggttgaccagaacttgtggggacgtagcaatgagtgtggcgttcttgaagatccttgggcgactccgccagaaggagcctatgcgctgacagcgccgcttgagaaaacgcctgatacaccagacattattgaactgtcttttgaaaaaggggtgcccgttgcgattaacggagaggcataccctcttgatcagctgattttgacgttaaatgagatcgctggcaaacatggcgtaggccggattgaccatgttgagaaccgcctagttggcatcaaatctcgtgaagtttatgaatgcccaggagcgatgacgctaatcaaagctcacaaagagttggaagatttgacgctaccgaaagaattggcccactttaaaccggttatcgaaaagaaactgactgaactcatttatgaagggctttggttttcaagcttgcaaccagcacttcttgctttcttaaaagaatctcaaacgcatgtaactggtgttgtccgtgtcaaactttttaaaggccatgcgatcatcgaagggcgcaaatctgcttactctttgtacaatgaaaaactagccacgtacacgccagatgatgaatttgaccattcagctgcagttgggtttatttccctatggggcttgcctacaaaagtacacagcatggtgacaaaggagaaaaaggaggtcacgctgtga

SEQ ID NO: 5432 - protein, 403 aa, Bacillus clausii
MAKEKVVLAYSGGLDTSVAVKWLTDKGYDVIAVGLDVGEGKDLEFVKQKALQVGAIQSYTIDAKKEYAESFVLPALQAHALYEQKYPLVSALSRPLISKKLVEIAEQTGATAVAHGCTGKGNDQVRFEVSIQALNPNLKVLAPVREWAWSRDEEIEYAKAHNIPIPIDLDNPYSVDQNLWGRSNECGVLEDPWATPPEGAYALTAPLEKTPDTPDIIELSFEKGVPVAINGEAYPLDQLILTLNEIAGKHGVGRIDHVENRLVGIKSREVYECPGAMTLIKAHKELEDLTLPKELAHFKPVIEKKLTELIYEGLWFSSLQPALLAFLKESQTHVTGVVRVKLFKGHAIIEGRKSAYSLYNEKLATYTPDDEFDHSAAVGFISLWGLPTKVHSMVTKEKKEVTL

SEQ ID NO: 5433 - DNA, 1212 bp, Bacillus subtilis
  CDS (1)..(1212): transl_table=11
atgtcagaacagaaaaaagtcgtattagcatactcaggaggtcttgatacttccgtcgcaataaaatggcttcaggagcaaggatataatgtaatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatctctttgcaggcccacacaatgtatgaaggaaaatacccgcttgtttcggcattatctcgaccgctgatcgcgaaaaaactggttgaaattgcggaaaaagaagatgcacaggcgattgcccacggatgcacagggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgaccaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagaaatcatttacaacggcttatggttctcaccgttaaaagacgcgctgcacgctttcttaaaagaaacgcaaaagcatgtcacaggcattgtccgcgtgaagctgtttaaaggccatgcaattgtagaaggacgtaaatcggaatactctctatatgatgaaaaacttgcaacatatacaaaagacgatgcatttgatcaccatgcagcaatcggatttatcgagctttggggacttccgacaaaagtgaacagcatcgtgaaaaagaaggagcagattaaagcatga

SEQ ID NO: 5434 - protein, 403 aa, Bacillus subtilis
MSEQKKVVLAYSGGLDTSVAIKWLQEQGYNVIACCLDVGEGKDLAFVQQKALEVGATNSYVIDAKEEFAQDYALISLQAHTMYEGKYPLVSALSRPLIAKKLVEIAEKEDAQAIAHGCTGKGNDQVRFEVSIKSLNPDLEVIAPVREWQWSREEEIEYAASRGIPIPINLDSPYSIDQNLWGRANECGILEDPWAAPPEGAYDLTAPLEKTPDTPEVIEIAFEQGVPVSIDGVSYSLSELILKLNEMAGAHGVGRIDHVENRLVGIKSREVYECPGAMTLIKAHKELEDLTLVKEVAHFKPIIEQKMSEIIYNGLWFSPLKDALHAFLKETQKHVTGIVRVKLFKGHAIVEGRKSEYSLYDEKLATYTKDDAFDHHAAIGFIELWGLPTKVNSIVKKKEQIKA

SEQ ID NO: 5435 - DNA, 1239 bp, Bifidobacterium longum
  CDS (1)..(1239): transl_table=11
atggcagataacaagcgcattgttctggcctactccggcggtcttgacacatccgtcgccatctcgtacctgaaggagcgcaccggcaaggacgtcgtggccgtgtccctcgacgtcggccagggcggcgaaagccttgagaccatcaagcagcgcgccctcgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagttgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggtgccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcccgcgacgtcaagttcggcaacggcatcgaggtcccgaagaacaccgtcgagtaa

SEQ ID NO: 5436 - protein, 412 aa, Bifidobacterium longum
MADNKRIVLAYSGGLDTSVAISYLKERTGKDVVAVSLDVGQGGESLETIKQRALACGAVESYVVDARDEFANEYCMKALKANAMYEGVYPLVSAISRPLISKHLVRAAHQFGADTISHGCTGKGNDQVRFEVSIASIDPTLKAISPIRDLSLTRDVEIAFAKEHKLPITQTEKSPYSIDQNVWGRAIETGFLEDPWNGPTKDCYSYTDDPAFPPVEDEVVIEFKEGVPVKIDGRDVTPLQAIEEMNRRAGAQGVGRIDLIEDRLVGIKSRELYEAPGAVALITAHQELENCCLEREQHRIKRDIDKRWGELVYDAQWFSPATQSLNAFIEDTQKYVSGEIRMVLHGGRAVVTGRRSDSSLYDYKLATYDSGDTFDQKSSNGFIDIYGLPSRVAAARDVKFGNGIEVPKNTVE

SEQ ID NO: 5437 - DNA, 1338 bp, Bordetella bronchiseptica
  CDS (1)..(1338): transl_table=11
atgactactattctcccgaaccttcctaccggccagaaggtcggcatcgccttttccggcggcctcgataccagcgccgcgctgctgtggatgcgccagaaaggcgccgtgccctacgcgtacaccgccaacctgggccagcccgacgagccggactacgatgaaatcccccgccgcgccatgcaatacggcgccgaagccgcccgcctggtcgactgtcgcgcgcaactggtcgccgaagggatcgccgcgctgcaggccggcgccttccatatctcgaccgccggcctgacctacttcaacaccacgcctatcgggcgcgccgtcaccggcaccatgctggtggccgccatgaaggaagacggcgtcaacatctggggcgacggcagcacgttcaagggcaacgacatcgagcgcttctaccgctacggcctgctgaccaacccggacctgaagatctacaagccctggctggaccagaccttcatcgacgagctgggcggccgcgcggaaatgtccgagtacatgcgccaggccggtttcgactacaagatgtcggccgagaaagcctactcgaccgactccaacatgctcggcgccacccacgaggccaaggacctggagctcctgaactccggcatccgtatcgtgcagcccatcatgggcgtggccttctggcaggacagcgtgcagatcaaggccgaggaagtgacggtgcgcttcgaggaaggccagccggtcgccctcaacggcgtcgagtacgccgacccggtcgaactgctgctggaagccaaccgcatcggcggccgccacggcctgggcatgagcgaccagatcgagaaccgcatcatcgaagccaagagccgcggcatctacgaagccccgggcctggcgctgctgttcatcgcctacgagcgcctggtcaccggcatccataacgaagacaccatcgagcagtaccgcgagaacggccgcaagctgggccgcctgctgtaccagggccgctggttcgacccgcaggccatcatgctgcgcgaaaccgcacagcgctgggtcgcgcgcgccatcaccggcgaagtcacgctcgaactgcgccgcggcaacgactactcgctgctgaacaccgaatcggccaacctgacgtacgcgcccgagcggctgtccatggagaaggtggaaaacgcccccttcacgccggccgaccgcatcggccagctcaccatgcgcaacctcgacatcgtcgatacccgcgaaaagctgttcacctacgtcaagaccggcttgctggccccgtcggccggctcggcgctgccgcagatcaaggacggcaagaaatag

SEQ ID NO: 5438 - protein, 445 aa, Bordetella bronchiseptica
MTTILPNLPTGQKVGIAFSGGLDTSAALLWMRQKGAVPYAYTANLGQPDEPDYDEIPRRAMQYGAEAARLVDCRAQLVAEGIAALQAGAFHISTAGLTYFNTTPIGRAVTGTMLVAAMKEDGVNIWGDGSTFKGNDIERFYRYGLLTNPDLKIYKPWLDQTFIDELGGRAEMSEYMRQAGFDYKMSAEKAYSTDSNMLGATHEAKDLELLNSGIRIVQPIMGVAFWQDSVQIKAEEVTVRFEEGQPVALNGVEYADPVELLLEANRIGGRHGLGMSDQIENRIIEAKSRGIYEAPGLALLFIAYERLVTGIHNEDTIEQYRENGRKLGRLLYQGRWFDPQAIMLRETAQRWVARAITGEVTLELRRGNDYSLLNTESANLTYAPERLSMEKVENAPFTPADRIGQLTMRNLDIVDTREKLFTYVKTGLLAPSAGSALPQIKDGKK

SEQ ID NO: 5439 - DNA, 1338 bp, Bordetella pertussis
  CDS (1)..(1338): transl_table=11
atgactactattctcccgaaccttcctaccggccagaaggtcggcatcgccttttccggcggcctcgataccagcgccgcgctgctgtggatgcgccagaaaggcgccgtgccctacgcgtacaccgccaacctgggccagcccgacgagccggactacgatgaaatcccccgccgcgccatgcaatacggcgccgaagccgcccgcctggtcgactgtcgcgcgcaactggtcgccgaagggatcgccgcgctgcaagccggcgccttccatatctcgaccgccggcctgacctacttcaacaccacgcctatcgggcgcgccgtcaccggcaccatgctggtggccgccatgaaggaagacggcgtcaacatctggggcgacggcagcacgttcaagggcaacgacatcgagcgcttctaccgctacggcctgctgaccaacccggacctgaagatctacaagccctggctggaccagaccttcatcgacgagctgggcggccgcgcggaaatgtccgagtacatgcgccaggccggtttcgactacaagatgtcggccgagaaagcctactcgaccgactccaacatgctcggcgccacccacgaggccaaggacctggagctcctgagcgccggcatccgtatcgtgcagcccatcatgggcgtggccttctggcaggacagcgtgcagatcaaggccgaggaagtgacggtgcgcttcgaggaaggccagccggtcgccctcaacggcgtcgagtacgccgacccggtcgaactgctgctggaagccaaccgcatcggcggccgccacggcctgggcatgagcgaccagatcgagaaccgcatcatcgaagccaagagccgcggcatctacgaagccccgggcctggcgctgctgttcatcgcctacgagcgcctggtcaccggcatccataacgaagacaccatcgagcagtaccgcgagaacggccgcaagctgggccgtctgctgtaccagggccgctggttcgacccgcaggccatcatgctgcgcgaaaccgcacagcgctgggtcgcgcgcgccatcaccggcgaagtcacgctcgaactgcgccgcggcaacgactactcgctgctgaacaccgaatcggccaacctgacgtacgcgcccgagcggctgtccatggagaaggtggaaaacgcccccttcacgccggccgaccgcatcggccagctcaccatgcgcaacctcgacatcgtcgatacccgcgaaaagctgttcacctacgtcaagaccggcttgctggccccgtcggccggctcggcgctgccgcagatcaaggacggcaagaaatag

SEQ ID NO: 5440 - protein, 445 aa, Bordetella pertussis
MTTILPNLPTGQKVGIAFSGGLDTSAALLWMRQKGAVPYAYTANLGQPDEPDYDEIPRRAMQYGAEAARLVDCRAQLVAEGIAALQAGAFHISTAGLTYFNTTPIGRAVTGTMLVAAMKEDGVNIWGDGSTFKGNDIERFYRYGLLTNPDLKIYKPWLDQTFIDELGGRAEMSEYMRQAGFDYKMSAEKAYSTDSNMLGATHEAKDLELLSAGIRIVQPIMGVAFWQDSVQIKAEEVTVRFEEGQPVALNGVEYADPVELLLEANRIGGRHGLGMSDQIENRIIEAKSRGIYEAPGLALLFIAYERLVTGIHNEDTIEQYRENGRKLGRLLYQGRWFDPQAIMLRETAQRWVARAITGEVTLELRRGNDYSLLNTESANLTYAPERLSMEKVENAPFTPADRIGQLTMRNLDIVDTREKLFTYVKTGLLAPSAGSALPQIKDGKK

SEQ ID NO: 5441 - DNA, 1338 bp, Bradyrhizobium japonicum
  CDS (1)..(1338): transl_table=11
atgaccacgatcctgaaaagcctgcccaagggcgagaaagtcggcatcgcgttttcgggcggcctcgacaccagcgcggcgctgctctggatgaagcagaagggcgcgcgctgctacgcctataccgccaatctcggccagcccgatgaagccgactacaacgagatcccgcgcaaggcgcaggaattcggtgccgagaaggccgtgctggtcgattgccgcacgcagctcgtccacgaaggcatcgccgcgatccagtccggcgccttccacatctcgaccggcggcatcacctatttcaacaccacgccgctcggccgtgccgtcaccggcacgatgctggtcgcggcgatgaaggaggacggcgtcaacatctggggcgacggctcgaccttcaagggcaacgacatcgagcgcttctatcgctacggcctgctcaccaatccgagcctgcgcatctacaagccctggctcgaccagcagttcatcgacgaactcggcggccgcgccgagatgtcggcgttcatgaccgcccagggcttcgcctacaagatgagcgccgagaaggcgtactcgaccgacagcaacctgctcggcgccacgcatgaagccaaggatctcgagagcctcgacagcggcatcaagatcgtcaacccgatcatgggcgtgccgttctggcgcgaggactgcaacgtcaaggccgagaaggtcgtcgtgcgtttcgaagaaggccagcccaccgcgctgaacggccagaccttcaccgatcccgtcgcgctgttcctcgaagccaatgcgatcggcggccgccacggcctcggcatgagcgaccagatcgagaaccgcatcatcgaggccaagagccgcggcatctatgaggcgcccggcatggcgctgttgcacatcgcctatgagcgcctcgtcaccggcatccacaacgaggacaccatcgagcagtaccgcatcagcggcatgcgtctcggccgcctgctctatcagggccgctggttcgattcgcaggccctgatgctgcgcgagaccgcgcagcgctgggtcgcgcgcgccgtcaccggcgaggtgacgctcgagctgcgccgcggcaacgattattcgatcctaaacaccgagagccccaacctcacctatgcgccggagcggctcagcatggagaaggtcgaggatgccgccttcacgccggccgaccgcatcggccagctcaccatgcgcaacctcgacatcgccgacacgcgcaccaagctgaagctctatacggacaccggcctgctttcaggcagcgaaggctcgcagatcttccggctggagaacgacaagggctga

SEQ ID NO: 5442 - protein, 445 aa, Bradyrhizobium japonicum
MTTILKSLPKGEKVGIAFSGGLDTSAALLWMKQKGARCYAYTANLGQPDEADYNEIPRKAQEFGAEKAVLVDCRTQLVHEGIAAIQSGAFHISTGGITYFNTTPLGRAVTGTMLVAAMKEDGVNIWGDGSTFKGNDIERFYRYGLLTNPSLRIYKPWLDQQFIDELGGRAEMSAFMTAQGFAYKMSAEKAYSTDSNLLGATHEAKDLESLDSGIKIVNPIMGVPFWREDCNVKAEKVVVRFEEGQPTALNGQTFTDPVALFLEANAIGGRHGLGMSDQIENRIIEAKSRGIYEAPGMALLHIAYERLVTGIHNEDTIEQYRISGMRLGRLLYQGRWFDSQALMLRETAQRWVARAVTGEVTLELRRGNDYSILNTESPNLTYAPERLSMEKVEDAAFTPADRIGQLTMRNLDIADTRTKLKLYTDTGLLSGSEGSQIFRLENDKG

SEQ ID NO: 5443 - DNA, 1221 bp, Brucella suis
  CDS (1)..(1221): transl_table=11
atgagcaagtggaaagacgttaagaaagtcgttctcgcctattcgggcggcctcgacacctcgatcatcctgaagtggcttcagacggaactgggcgcggaagtcgtgacctttaccgctgatctcggccagggcgaggaacttgaaccggcccgcaagaaagcggaaatgctgggcatcaaggaaatcttcattgaggacgtgcgcgaagaattcgtgcgcgatttcgtcttcccgatgttccgcgccaatgccgtctatgaaggcgtctatctgctcggcacatcgattgcccgcccactgatctccaagcatctgatcgacatcgccaaaaaaaccggcgccgacgccatcgcccatggcgcgaccggcaagggcaacgaccaggttcgcttcgagctttcggcctatgcgctgaacccggacatcaagatcatcgctccatggcgcgactggtcgttcaagagccgcacgcagcttctcgaatttgccgaacagcaccagattccggttgccaaggacaaaaagggcgaagcaccgttctccgtcgatgccaacctgctgcactcctcgtcggagggcaaggttctggaagacccatcgcaggaagcgccggaatatgtgcatatgcgcactatttcgccggaaaccgcgcccgacaaggcaacgatcatcaagatcggctttgaaaagggcgatgccgtttcaatcaatggcgagcgcctgtcgccagcgacccttcttgccaagctcaacgactatggccgcgacaatggcattggccgtctcgacctcgtggaaaaccgcttcgtcggcatgaagtcgcgcggcgtctacgaaacgccgggcggtacgatcctgcttgcagcgcaccgcgccattgaatcgatcacgctcgaccgtggtgcggcgcacctgaaagacgagctgatgccgcgctatgcggaactgatctattatggcttctggttctcgccggaacgcgaaatgctgcaagcggccatcgatcacagccagcaccatgtcgaaggcgaagtcacgctcaagctctacaagggcaatgtgatggtgatcggtcgcgaatcggccaagtcgctctattccgacaagctcgtgacctttgaagacgatcagggcgcctacgaccagaaggatgcggcaggcttcatcaagctcaatgcgctgcgtctgcgcacactggctgcacgcgaccgcaaataa

SEQ ID NO: 5444 - protein, 406 aa, Brucella suis
MSKWKDVKKVVLAYSGGLDTSIILKWLQTELGAEVVTFTADLGQGEELEPARKKAEMLGIKEIFIEDVREEFVRDFVFPMFRANAVYEGVYLLGTSIARPLISKHLIDIAKKTGADAIAHGATGKGNDQVRFELSAYALNPDIKIIAPWRDWSFKSRTQLLEFAEQHQIPVAKDKKGEAPFSVDANLLHSSSEGKVLEDPSQEAPEYVHMRTISPETAPDKATIIKIGFEKGDAVSINGERLSPATLLAKLNDYGRDNGIGRLDLVENRFVGMKSRGVYETPGGTILLAAHRAIESITLDRGAAHLKDELMPRYAELIYYGFWFSPEREMLQAAIDHSQHHVEGEVTLKLYKGNVMVIGRESAKSLYSDKLVTFEDDQGAYDQKDAAGFIKLNALRLRTLAARDRK

SEQ ID NO: 5445 - DNA, 1212 bp, Buchnera aphidicola subsp
  CDS (1)..(1212): transl_table=11
atgataagaaaaaaaaataataaagttgttttagcttattctggcggtttagatacttctgcaattattccatggcttaaagaaaattataattttgaagttgttgcttttgtagcagacataggacaatcaaaaaaagatttaaatggaattgaaaaaaaatctttagaatctggcgcatctagttgtcatgtttttgatttaaaagaagaatttatagaaaattatgtctatcctgtactaaaaactggagctttatatgaaggcagttatttgttaggaacagcaatggccagacctattattgcaaagaaacaagtagaactcgcattgaatattggagcaaattcactatgtcatggtgctactgggaaaggaaatgaccaagtacgttttgaaatggcttatgccgctttagctccgaatttaaatgtaattgcaccgtggcgggaatggaatcttaattcacgagaatcattattaaaatatttagataaaaaaaacatctctacaacagcaacattagaaaaaatatatagtaaagatgaaaattcctggcatatttcaactgaaggaggtttgctagaaaatccttggaatcaatctaatgaagattgttggagctggacggttaatcctgaggatgctccagaaaaaccggaatatgtttcattgcaattaaaagaaggctgcgtagtatccgttaacaatcaaaaattaaatccgttaaaatgtgtagaagaattaaatagtttaggtgctaaacatggaattggtagaattgatattattgaaaatagattaattggaatgaaatctaggggatgttatgaaacacctggaggtactattattatgacagctataaaagccatcgaacagttagttttagatcgtgaaagttttcgatggagggaaaaaataggtttagaaatgtcatctattgtttatgacggacgttggttttctccaatacgtaaatctttacaagccgctgctgattcattgtctttggaaataactggagaagtaatattaaaattatataaaggctctgtcacagctgttcagaaaaaatctcctaattccttatattctgaagaatatgccacttttggtgaggataaagtgtataagcaatctgatgcagatggttttattcgtcttttttctctttcttcaaagatacgagcacaaaatatgttgaagtag

SEQ ID NO: 5446 - protein, 403 aa, Buchnera aphidicola subsp
MIRKKNNKVVLAYSGGLDTSAIIPWLKENYNFEVVAFVADIGQSKKDLNGIEKKSLESGASSCHVFDLKEEFIENYVYPVLKTGALYEGSYLLGTAMARPIIAKKQVELALNIGANSLCHGATGKGNDQVRFEMAYAALAPNLNVIAPWREWNLNSRESLLKYLDKKNISTTATLEKIYSKDENSWHISTEGGLLENPWNQSNEDCWSWTVNPEDAPEKPEYVSLQLKEGCVVSVNNQKLNPLKCVEELNSLGAKHGIGRIDIIENRLIGMKSRGCYETPGGTIIMTAIKAIEQLVLDRESFRWREKIGLEMSSIVYDGRWFSPIRKSLQAAADSLSLEITGEVILKLYKGSVTAVQKKSPNSLYSEEYATFGEDKVYKQSDADGFIRLFSLSSKIRAQNMLK

SEQ ID NO: 5447 - DNA, 1206 bp, Buchnera aphidicola subsp
  CDS (1)..(1206): transl_table=11
atgaataattttaaaaaagtggtgttagcatattctggtggtttagatacttcagccatcatcccttggttgaaagaaaattatcatgttgatgttgtggcttttgtagctgatataggtcaatcaaaaaaagatttaaatggtattgaaaaaaaagcactgcaatctggtgcaattgattgccgtgtttttgatttaaaagaggaatttataaaagattacgtatatccagttttaaaaacaggttctttatatgaaggaaattatttattaggtacagcaatagctagacctattattgctaaaaaacaagtagaattcgcttcgagtattggagcaaaatttttatgtcatggcgctactgggaagggtaatgatcaagttcgttttgagatagcttatgcagcattagctccttatatgaaagtgattgctccatggcgcgaatggaatcttaattcaagagaatcactgttagaatatttgcgtgaaaaaaatattccaacatcagcgactttagagaaaatttacagcagagatgagaattctttgcatatttctacagaaggaggtttacttgaagatctttggaataaaccgaatgcagattgttggaattggacagtagaactagaagatgctccagaacaaccagaatatatttctttaattgtaaaaaatggatctgttgtatctgttaataatgagtttttaactcctttaaaatgtatagaaaaattaaacaaaattggttctaaacacgctataggaagaattgacattgttgaaaatagactcgttggaattaaatctagaggttgctatgaaactccgggtggtactattatgcacatagcactcagagcaattgagcaattagtatttgatcgagaaagttttaaatggcgagaaaaaattggtttagaaatgtcgtctgtagtttacgatggacgttggtttactcctattcgtaaatctttacaagcttctgcagattctttatcttctgaagttaatggcgaagttgtattaaaattgtataaaggcagtgtaattcctgtacaaaaaaaatcttcgaattctttatattctaaagaatatgcaacttttggtgaagatgaagtttataagcattctgatgctgaaggttttattcgtcttttttctctttcttctagaatacgagctcaaaacaagttaaaataa

SEQ ID NO: 5448 - protein, 401 aa, Buchnera aphidicola subsp
MNNFKKVVLAYSGGLDTSAIIPWLKENYHVDVVAFVADIGQSKKDLNGIEKKALQSGAIDCRVFDLKEEFIKDYVYPVLKTGSLYEGNYLLGTAIARPIIAKKQVEFASSIGAKFLCHGATGKGNDQVRFEIAYAALAPYMKVIAPWREWNLNSRESLLEYLREKNIPTSATLEKIYSRDENSLHISTEGGLLEDLWNKPNADCWNWTVELEDAPEQPEYISLIVKNGSVVSVNNEFLTPLKCIEKLNKIGSKHAIGRIDIVENRLVGIKSRGCYETPGGTIMHIALRAIEQLVFDRESFKWREKIGLEMSSVVYDGRWFTPIRKSLQASADSLSSEVNGEVVLKLYKGSVIPVQKKSSNSLYSKEYATFGEDEVYKHSDAEGFIRLFSLSSRIRAQNKLK

SEQ ID NO: 5449 - DNA, 1230 bp, Buchnera aphidicola subsp
  CDS (1)..(1230): transl_table=11
atgcgaaataaaaacatcaaaaaagttgtactagcttattccggtggattagatacatcagctattattccttggataaaagaaaattactcttcagaagtaatagcgtttgtagcaaatgtaggacaaaatcaagcggatttaaaagacattgaatacaaagctctaaaatctggagcatctcaatgtattattaaagatttaagagaagagtttatacgagattatgtatatcctgttttaaaatctggagcattgtatgaggaaaattatttattaggtactgctttagctcgtcctattattgctaaatcacaagtagatctagctctaaaattaaaagctgatggtgtttgtcatggcgctactggaaaaggtaatgatcaagttcgatttgaaactgcatatgtaggattagctccagaattaaaaattattgcaccatggcgagaatggagttttaaatctcgaggagaattattatcttatctaaaagaaaaaaatgttaaaactactgcttctattgaaaaaatttatagcaaagatgaaaatgcttggcatgtttctactgaaggaggtgttttagaagatttatggaataaaccgaatcaggattgttggacttggactaatgatccaaaagatgctcctaatgttccagaaataatttctattaagataaaaaacggtagcgttattgctgttaataatgaatttttgagtccgtttaagtgtttagaaaaattaaatttagttggaattaaacacggtataggacgtattgatgttgttgaaaatcgtttagtaggtatgaagtcgcgagcgtgttatgaaactccaggtggaactattttagtaaatgcgttacgttcacttgaacagttagtattagatagagatagttataaatggaggcaacaaatagctttagaaatgtcttatgttatttataatggaaattggtttagtccttttcggaaatcattgcaagctgcggctacagagttagcgactgaaatagatggagaagttattttagaattatataaaggtacagtaacagctattaggaagttttctcctaattctttatattctaaggaatttgcaacatttgatcaagacgaggtatatcgtcaatctgatgctgatggatttattaagttatattctttgccttcgaagataagagctataaataagtgtatgaataaggcgttaatgaagtag

SEQ ID NO: 5450 - protein, 409 aa, Buchnera aphidicola subsp
MRNKNIKKVVLAYSGGLDTSAIIPWIKENYSSEVIAFVANVGQNQADLKDIEYKALKSGASQCIIKDLREEFIRDYVYPVLKSGALYEENYLLGTALARPIIAKSQVDLALKLKADGVCHGATGKGNDQVRFETAYVGLAPELKIIAPWREWSFKSRGELLSYLKEKNVKTTASIEKIYSKDENAWHVSTEGGVLEDLWNKPNQDCWTWTNDPKDAPNVPEIISIKIKNGSVIAVNNEFLSPFKCLEKLNLVGIKHGIGRIDVVENRLVGMKSRACYETPGGTILVNALRSLEQLVLDRDSYKWRQQIALEMSYVIYNGNWFSPFRKSLQAAATELATEIDGEVILELYKGTVTAIRKFSPNSLYSKEFATFDQDEVYRQSDADGFIKLYSLPSKIRAINKCMNKALMK

SEQ ID NO: 5451 - DNA, 1338 bp, Burkholderia cepacia
  CDS (1)..(1338): transl_table=11
atgagcacgattctcgaaagcctcccgaccggccagaaggtcggtatcgccttctccggcggcctggacaccagcgccgcgctgcactggatgaaactgaagggcgccgtcccgtacgcgtacacggcaaacctcggccagcccgacgaagacgattacgatgcgatcccgaaacgtgcgctcgaatacggtgcggccggtgcccgcctgatcgactgccgcgcgcaactcgtcgccgaaggcatcgccgcgctgcaaagcggcgcgttccacatcacgaccgccggcgtcacgtacttcaacacgacgccgatcggccgcgccgtgacgggcacgatgctcgtcgccgcgatgaaggaagacggcgtgaacatctggggcgacggcagcacgtacaagggcaacgacatcgagcgcttctaccgctacggtctgctcgtgaacccggatctgaagatctacaagccgtggctcgaccagacgttcatcgacgaactcggcggccgcgcggaaatgtccgaattcatgcgtcagtcgggcttcgcgtacaagatgtcggccgagaaggcgtattcgaccgactcgaacctgctcggcgcgacgcacgaggcgaaggatctggaaagcctcgaaagcgggatcaagatcgtgaacccgatcatgggcgtcgcgttctggcgcgacgacgtgaagatcgccgccgaagaagtgacggtgcgcttcgaagccggccagccggtcgcgctgaacggcgtcgagttcaaggatcaggtcgagttgctgctcgaggcgaaccgcatcggcggccgtcacggcctcgggatgagcgaccagatcgagaaccgcatcatcgaggcgaagagccgcggcatctatgaagcgccggggctcgcgctgctgtatatcgcttacgagcgtctcgtgacgggcatccacaacgaagacacgatcgagcagtaccgcgagaacggtcgccgtctcggtcgcctgctgtatcagggccgctggttcgacccgcaggcgatcatgctgcgcgaaacggcccagcgctgggtcgcgcgcgcgatcaccggcgaagtgaagatcgagctgcgccgcggcaacgactattcgattctcagcacgaagtcgccgaacctcacgtatcagccggagcgtctgtcgatggagaaggtcgcgtcgacgttctcgccgcgcgaccggatcggtcagctgacgatgcgcaatctcgacatcaccgatacgcgcgacaagctgcgcgtgtacacgcaggtcgggctgctgacgccgggtgaagcgtcggcgctgccgcaaatcaagggcgatagcggggagtaa

SEQ ID NO: 5452 - protein, 445 aa, Burkholderia cepacia
MSTILESLPTGQKVGIAFSGGLDTSAALHWMKLKGAVPYAYTANLGQPDEDDYDAIPKRALEYGAAGARLIDCRAQLVAEGIAALQSGAFHITTAGVTYFNTTPIGRAVTGTMLVAAMKEDGVNIWGDGSTYKGNDIERFYRYGLLVNPDLKIYKPWLDQTFIDELGGRAEMSEFMRQSGFAYKMSAEKAYSTDSNLLGATHEAKDLESLESGIKIVNPIMGVAFWRDDVKIAAEEVTVRFEAGQPVALNGVEFKDQVELLLEANRIGGRHGLGMSDQIENRIIEAKSRGIYEAPGLALLYIAYERLVTGIHNEDTIEQYRENGRRLGRLLYQGRWFDPQAIMLRETAQRWVARAITGEVKIELRRGNDYSILSTKSPNLTYQPERLSMEKVASTFSPRDRIGQLTMRNLDITDTRDKLRVYTQVGLLTPGEASALPQIKGDSGE

SEQ ID NO: 5453 - DNA, 1215 bp, Burkholderia pseudomallei
  CDS (1)..(1215): transl_table=11
atgaaacccaaacacattctcctcgcttattccggcggcctcgacacgtccaccgcgctgcacttcctgaagcggcatttcgattgccgcgtcaccgcctattgcgcgaacctcgggcagaaggaggattgggagcggatgaaacgccgcgcggcgatcgccggcgcggacgagctggtcatcgaggatctgcgcgagacgttcatcggcgatttcgtgtttcccgcactgaaggcgaacgcgtcgtacgagcgggactatctgctcggcacgccgctcgcccgcccggcgatcgtcaaggggctcatcgagtacgcgcgcaagcacgacgtcgattgcctgtcgcacggctgcacgcagaagggcaacgatcaggtgcgcttcgagatggccgcgaagatcctcgcgcccgatctgccgacggtcgcgccgtggcgcatctggtcgctgcagtcgcgcgaggatctgttcgcgtattgtcagcagcacggcattccggtcgaaagccgtccggacaatctgttgagccacgacgagaatctcgtgcacatcacgacggagggcgactatctggagagcgtcgcgaacgcgttcgactggcgcgacgcgaactggatcacgccgcccacgcaagcgccggatgcgatcgagacgatcacgctcgggttccgccggggcgtgcccgtcagcgtcgacggcgcggcgctcgggccggtcgagctggtcgagcggctcaacgaagcgggcgcccgcaacggcgtcggcttccaggacatcatcgagaaccgcatcaacggcctgaaggtgcgcggcgtgttcgagaaccccgcgctgacgatcctgcacgccgcgcatcgcaagctcgagaagatcacgctcggccgcgacgtcgagcgcctgcgcaacctcgtgtcggacgactacggcgacatcgtctaccgcggcctgtggttcagcgacgagcggctctgcctgcaggcgctcatcgacgaatcgcagaagtacgtgagcggcgacgtgaaggttcagctctacaagggttcgtgcacgccgtgcgccgtcgaatcggagcagtcgctttattcgcgcgagctcgtgacgctgcacgcgggccgcgcgatcagcggcgaggacgcgacgggtttcctgaacacgctcggcctgcgtatcggcatcgaagccgcgcgcgccggcaacacgggagccggcgcatga

SEQ ID NO: 5454 - protein, 404 aa, Burkholderia pseudomallei
MKPKHILLAYSGGLDTSTALHFLKRHFDCRVTAYCANLGQKEDWERMKRRAAIAGADELVIEDLRETFIGDFVFPALKANASYERDYLLGTPLARPAIVKGLIEYARKHDVDCLSHGCTQKGNDQVRFEMAAKILAPDLPTVAPWRIWSLQSREDLFAYCQQHGIPVESRPDNLLSHDENLVHITTEGDYLESVANAFDWRDANWITPPTQAPDAIETITLGFRRGVPVSVDGAALGPVELVERLNEAGARNGVGFQDIIENRINGLKVRGVFENPALTILHAAHRKLEKITLGRDVERLRNLVSDDYGDIVYRGLWFSDERLCLQALIDESQKYVSGDVKVQLYKGSCTPCAVESEQSLYSRELVTLHAGRAISGEDATGFLNTLGLRIGIEAARAGNTGAGA

SEQ ID NO: 5455 - DNA, 1227 bp, Burkholderia xenovorans
  CDS (1)..(1227): transl_table=11
atgagcgatatcaagaaagtcgtgctcgcctattcgggcggcctcgacacctccgtcatcctgaagtggttgcaggacaattacgacgccgaagtcgtcacgttcacggccgacatcggccagggcgaagagctggaaccggcgcgcaagaaagccctgcaactcggcatcaagccggaaaacatctttatcgaagacctgcgcgaagaattcgtgcgtgacttcgtgttcccgatgttccgcgccaacacgatctatgaaggcgagtacctgctgggcacctcgatcgcgcgtccgctgatcgccaagcgtcagatcgaaatcgcgcgcgccaccggcgcacaagcggtgtcgcacggcgcaaccggcaagggcaacgaccaggttcgcttcgaactcggttactacgcgctggaaccgggcatcaaggtgatcgcgccgtggcgcgaatgggacctgctgtcgcgcgaaaagctgctcgcgtatgccgaaaaggccggcattccaattgaaatgaagcacaagcaaggcggcgcgccgtattcgatggacgcgaacctgctgcacatttcgttcgaaggccgtcacctggaagatccgaaagcggaagcggaagccgacatgtggcgttggaccgtctcgccggaagaagcgccggaccaggctgaatacctcgacatcgagtacgagcacggcgatccggttgcaatcaacggcaagcgtctgtcgcctgcggaaatgctcaccgaactgaaccgtctgggcggcaagcacggcatcggccgtctcgacctggtggaaaaccgttatgtcggcatgaagtcgcgcggctgctacgaaacgccgggcggcacgatcatgctgaaggcgcaccgcggcatcgagtcgatcacgctcgaccgtgaagtggctcacctgaaagacgatctgatgccccgctacgccgcattgatttataacggctactggtggagcccggagcgccgcgcgcttcaggtgctgatcgaccatacgcaagagaaggtcaacggctgggtgcgtgtgaagctgtacaagggcagcgtgtcggttgtcgcgcgcgattcgaaggaaacgctgttcgacaagaccatcgcaacgttcgacgacgacggcggcgcctacaaccaggccgacgccggcggcttcatcaagctgaacgcactgcgtatgcggattgcggaaaacgcgcgtcgtcagcgtggctga

SEQ ID NO: 5456 - protein, 408 aa, Burkholderia xenovorans
MSDIKKVVLAYSGGLDTSVILKWLQDNYDAEVVTFTADIGQGEELEPARKKALQLGIKPENIFIEDLREEFVRDFVFPMFRANTIYEGEYLLGTSIARPLIAKRQIEIARATGAQAVSHGATGKGNDQVRFELGYYALEPGIKVIAPWREWDLLSREKLLAYAEKAGIPIEMKHKQGGAPYSMDANLLHISFEGRHLEDPKAEAEADMWRWTVSPEEAPDQAEYLDIEYEHGDPVAINGKRLSPAEMLTELNRLGGKHGIGRLDLVENRYVGMKSRGCYETPGGTIMLKAHRGIESITLDREVAHLKDDLMPRYAALIYNGYWWSPERRALQVLIDHTQEKVNGWVRVKLYKGSVSVVARDSKETLFDKTIATFDDDGGAYNQADAGGFIKLNALRMRIAENARRQRG

SEQ ID NO: 5457 - DNA, 1221 bp, Campylobacter jejuni
  CDS (1)..(1221): transl_table=11
atgaaaaatgaagtaaaaaaagtagttttagcgtattctggagggcttgatacgagcattattttaaaatggcttcaagatgagtataattgtgaagttgtaacttttacagcagatattggtcaaggcgaagaactcgaacctgcgagaaaaaaagccctttctttaggcataaaagaagaaaatattttcattaaagatttaagagatgaatttgttaaagattatgtatttcctatgtttagagccaatgcaatttatgaaggagagtatcttttaggaacaagtatagcaagaccactcatagcaaaaactcaagcacaaattgccctgcaaacaggtgctgatgcggtaagtcatggcgccacaggcaaaggaaatgatcaagtgcgttttgaacttggttatcttgcttttagtcccgatttaaaaatcatcgctccatggcgtgagtgggatttaaacagtcgtgaaaaactccttgcttatgcgcaaaaacatggcattgatatttctaagaaaaaaggaaaatccccttattctatggacgcaaatttacttcatatttcttacgaaggacttgttttagaagatcctgcacacgcacctgaagaagatatgtggagatggagtaaaagcccaaaagacgctccaaatgaaagtgaaattatagaacttgatttccaaaaaggagatttagtagcgataaatggagaaaaactaagtcctgcaggacttttaaccaaacttaacgaactaggctgcaaacacggtataggacgccttgatatagtagaaaatcgctatgtaggcatgaaaagccgtggttgttacgaaactccaggcggtactatacttttaaaagcacatagagcgcttgaaagcatcacgcttgatagagaagcagcacacttaaaagatgaactcatgccaaaatacgcgagtttaatttataatggctattggttctcgcctgaaagaatgatgcttcaagccttaatcgatgagtctcaaattcacgccaatggcagagtaaagctcgagctttataaaggcaatgtgatggttataggacgcgaaagtgcgaacgatagcttgtttaacgcagcttattgtacttttgaagaagatgaagtgtataatcaaaaagacgcagcaggctttatcaagcttaatgctttgcgttttatcatcgcaggaaaaaatggaagaaaattttaa

SEQ ID NO: 5458 - protein, 406 aa, Campylobacter jejuni
MKNEVKKVVLAYSGGLDTSIILKWLQDEYNCEVVTFTADIGQGEELEPARKKALSLGIKEENIFIKDLRDEFVKDYVFPMFRANAIYEGEYLLGTSIARPLIAKTQAQIALQTGADAVSHGATGKGNDQVRFELGYLAFSPDLKIIAPWREWDLNSREKLLAYAQKHGIDISKKKGKSPYSMDANLLHISYEGLVLEDPAHAPEEDMWRWSKSPKDAPNESEIIELDFQKGDLVAINGEKLSPAGLLTKLNELGCKHGIGRLDIVENRYVGMKSRGCYETPGGTILLKAHRALESITLDREAAHLKDELMPKYASLIYNGYWFSPERMMLQALIDESQIHANGRVKLELYKGNVMVIGRESANDSLFNAAYCTFEEDEVYNQKDAAGFIKLNALRFIIAGKNGRKF

SEQ ID NO: 5459 - DNA, 1221 bp, Campylobacter jejuni
  CDS (1)..(1221): transl_table=11
atgaaaaatgaagtaaaaaaagtagttttagcgtattctggggggcttgatacgagcattattttaaaatggcttcaagatgagtataattgtgaagttgtaacttttacagcagatattggtcaaggtgaagaactcgaacctgcaagaaaaaaagccctttctttaggcataaaagaagaaaatattttcattaaagatttaagagatgaatttgttaaagattatgtatttcctatgtttagagccaatgcgatttatgaaggagaatatcttttaggaacaagtatagcaagaccacttatagcaaaaactcaagcacaaatcgccctgcaaacaggtgctgatgcagtaagtcatggtgccacaggtaaaggaaatgatcaagtgcgttttgaacttggttatcttgcttttaatcccgatttaaaaatcatcgctccatggcgtgagtgggatttaaacagtcgtgaaaaactccttgcttatgcacaaaaacacggtattgatatttctaagaaaaaaggaaaatctccttattctatggacgcaaatttacttcatatttcttacgaaggacttgtcttagaagatcctgcacacgcacctgaagaagatatgtggagatggagtaaaagcccaaaagatgctccaaatgaaagtgaaattatagaacttgatttccaaaaaggagatttagtagcgataaatggagaaaaactaagtcctgcaggacttttaaccaaacttaacgaactaggctgcaaacacggtataggacgccttgatatagtagaaaatcgctatgtaggtatgaaaagccgtggttgttacgaaacaccaggtggtaccatacttttaaaagcacacagagcgcttgaaagcatcacgcttgatagagaagcagcacacttaaaagatgaactcatgccaaaatacgcgagtttaatttataatggctattggttctcgcctgaaagaatgatgcttcaagccttaatcgatgagtctcaaattcacgccaatggcagagtaaaactcgagctttataaaggcaatgtgatagttataggacgcgaaagttcgaacgatagcttgtttaacgcagcttattgtacttttgaagaagatgaagtgtataatcaaaaagacgcagcaggctttatcaagcttaatgctttgcgttttatcatcgcaggaaaaaatggaagaaaattttaa

SEQ ID NO: 5460 - protein, 406 aa, Campylobacter jejuni
MKNEVKKVVLAYSGGLDTSIILKWLQDEYNCEVVTFTADIGQGEELEPARKKALSLGIKEENIFIKDLRDEFVKDYVFPMFRANAIYEGEYLLGTSIARPLIAKTQAQIALQTGADAVSHGATGKGNDQVRFELGYLAFNPDLKIIAPWREWDLNSREKLLAYAQKHGIDISKKKGKSPYSMDANLLHISYEGLVLEDPAHAPEEDMWRWSKSPKDAPNESEIIELDFQKGDLVAINGEKLSPAGLLTKLNELGCKHGIGRLDIVENRYVGMKSRGCYETPGGTILLKAHRALESITLDREAAHLKDELMPKYASLIYNGYWFSPERMMLQALIDESQIHANGRVKLELYKGNVIVIGRESSNDSLFNAAYCTFEEDEVYNQKDAAGFIKLNALRFIIAGKNGRKF

SEQ ID NO: 5461 - DNA, 1206 bp, Carboxydothermus hydrogenoformans
  CDS (1)..(1206): transl_table=11
atggcggaaaaagtagttttggcttattccggtggcctggatacctcgattatcattccctggcttaaagaaaattacggttacgaagtcattgccatggtggccgatgtgggccagggggaagaattagagcctttaagggaaaaggcgattaaaagcggcgctgccaaaatatatattgaagatgttaaggaagagtttgtccgggattttgtttttcccatgctgaaagcaggagcggtgtacgaaaataaataccttctgggaacttcggtagcccgtccgcttattgctaaaaagttggtggagatagcggaaaaggaaggggcggtggcggtagctcacggggcaaccggtaagggtaacgaccaggtacgttttgaacttaccgttaaagcgttaaatccggatttaaaaatcatcgctccctggcgggaatgggagataaaatcccgggaagatgccattgattatgccgaaaagagagggattccggtaccggttaccaagaagcagccttacagcatggatagaaacctctggcatctttcccacgaagggggtattttagaagacccggccgttgaaccgccggaagatgtgctcctacttaccaaccctccggaaaaagcaccggaccagccggagtatgtagaaatagagtttgttaaaggagaaccggtagcggtaaacggggaaaaactttcgccggtggaattaatttttaagcttaatgagcttggcggaaagcacggaattggtattgccgacatggtggaaaaccgtttggtgggtatgaaatcccggggagtatacgaaactcccggagggaccattttaacctttgctcaccgggagttagagagcttaactttagaccggcagaccatgcactttaaacagatggtagccttaaagtatgccgaacttatttacgatggcttatggtttacgcctctaagggaagctctggaagcttttgtggacaaaacccaggaaacggttacaggaaaagtcagagttaagctttacaaaggaaatatttacccggccggtataacttctccttactccctttatgttaaagatttagctacctttggtgaagataacctctataaccagaaggatgccgaaggatttattaatttatttggtcttccacttaaagtaagggctatgacccagaaaccataccagaagtag

SEQ ID NO: 5462 - protein, 401 aa, Carboxydothermus hydrogenoformans
MAEKVVLAYSGGLDTSIIIPWLKENYGYEVIAMVADVGQGEELEPLREKAIKSGAAKIYIEDVKEEFVRDFVFPMLKAGAVYENKYLLGTSVARPLIAKKLVEIAEKEGAVAVAHGATGKGNDQVRFELTVKALNPDLKIIAPWREWEIKSREDAIDYAEKRGIPVPVTKKQPYSMDRNLWHLSHEGGILEDPAVEPPEDVLLLTNPPEKAPDQPEYVEIEFVKGEPVAVNGEKLSPVELIFKLNELGGKHGIGIADMVENRLVGMKSRGVYETPGGTILTFAHRELESLTLDRQTMHFKQMVALKYAELIYDGLWFTPLREALEAFVDKTQETVTGKVRVKLYKGNIYPAGITSPYSLYVKDLATFGEDNLYNQKDAEGFINLFGLPLKVRAMTQKPYQK

SEQ ID NO: 5463 - DNA, 1227 bp, Caulobacter crescentus
  CDS (1)..(1227): transl_table=11
atggccgacaagtccgtgaagaaggtcgtgctcgcctattcgggcggtctcgacacctcgatcatcctcaagtggctgcagaccgaatacggcgctgaggtcatcaccttcacggccgacctcggccaaggcgaagagatcgagccggcccgcgccaaggccctggccgccggcgtcaagcccgagaacatcttcatcgaggacgtccgcgaagagttcgtgcgcgactacgtcttcccgatgttccgcgccaacacggtctatgagggccagtacctcctgggcacatcgatcgcccgtccgctgatcgccaagaagcagatcgagatcgcccgcaagatgggcgcagacgccgtcagccacggcgcgaccggcaagggcaacgaccaggtccgcttcgagctcggctattatggcctcgagcccgacatcaccgtgatcgccccctggcgcgagtgggacttcaagtcccgcgaggccctgctggacttcgccgagaagcaccagatccagatcaccaaggacaaacgcggcgaagcgccgttcagcgtcgacgccaacctgctgcactcctcgtccgagggtaaggtcctggaggacccggcggtcgaggctcccgagttcgtccacatgcgcaccattgcgccggaagacgcgccggacgcgccgaccatcatcaccatcgacttcgaaaagggtgacccggtcgccatcgacggcgtggcgatgagcccggccaccctgctgaccaagctgaacgaactgggccgcgacaacggcgtcggccgtctggacctcgtggaaaaccgcttcgtcggcatgaagtcgcgcggcgtctacgagacccccggcggcaccatcctgctggccgcccaccgcggcatcgagagcatcacgctggaccggggcgccatgcacctgaaggacgagctgatgccgaagtatgcttcgctcgtctataacggcttctggttctcgcccgagcgcgagatgctgcaggccgctatcgactacagccaggacaaggtcaccggccgcgtccgcgtgaagctgtacaagggcaatgtcacggtcatcggccgcgagagcccctactcgctgtatgaccaggacttggtgaccttcgaagaaggcaaggtcgcctacgaccaccgcgacgccggcggcttcatcaagctcaacgccctgcgcctgcgggtcctggccaagcgcgacaagcgcggctag

SEQ ID NO: 5464 - protein, 408 aa, Caulobacter crescentus
MADKSVKKVVLAYSGGLDTSIILKWLQTEYGAEVITFTADLGQGEEIEPARAKALAAGVKPENIFIEDVREEFVRDYVFPMFRANTVYEGQYLLGTSIARPLIAKKQIEIARKMGADAVSHGATGKGNDQVRFELGYYGLEPDITVIAPWREWDFKSREALLDFAEKHQIQITKDKRGEAPFSVDANLLHSSSEGKVLEDPAVEAPEFVHMRTIAPEDAPDAPTIITIDFEKGDPVAIDGVAMSPATLLTKLNELGRDNGVGRLDLVENRFVGMKSRGVYETPGGTILLAAHRGIESITLDRGAMHLKDELMPKYASLVYNGFWFSPEREMLQAAIDYSQDKVTGRVRVKLYKGNVTVIGRESPYSLYDQDLVTFEEGKVAYDHRDAGGFIKLNALRLRVLAKRDKRG

SEQ ID NO: 5465 - DNA, 1206 bp, Chlorobium tepidum
  CDS (1)..(1206): transl_table=11
atgagcaaggaaaaaattgcggtcgcctactccggcggccttgacacgtcagtcatgatcaaatggctgaaggacaagtatgaaggggcggaaatcgttgccgtcacgggcaacctcggccagaagatggaggtcgacaacctcgaacagaaagccatagccaccggcgcaaagtcgttccacttcgtcgatctgcgcaaaaccttcgtcgaagagtacatctggaaagcactaaaagctggcgcgttgtacgaggatgtgtacccactggccactgcgctcggacgcccgctgctcgccaaggcgctcgtcgatgtggcgctcgccgaagggtgcaccatgctcacccacggctgcaccggtaagggcaacgaccaggtgcgcttcgaggtcgccttcgccgcgctcgccccgcatatgaaggtggtcgccccgctgcgcgagtgggagttcacctcacgcgagcaggagatcgcctacgcgatggagcacaacatcccggtttcggcgaccaagaaaaatccctactcgatcgacgagaacatctggggcatcagcatcgagtgcggcgtgctcgaagatccgatggtcgctcccccggctgacgcctaccagatcactacggctcccgaacttgcacccgacgagccgaccgttgtcgatatcgagtttgcccagggggtgcccgtggcgctcgacggccagcagatggagggtctcgacctcatcgtcagactcaacgaactcggcgcgatgaacggcgtcggcaggctcgacatgatcgagaaccgtgtcgtcggcatcaagtctcgcgaaatctacgaagccccggcagccaccatcctgcacttcgcccaccgcgagctcgaacgcctcacgctcgaaaagtcggtcttccagtacaagcgcaatatcggccaggactacgccaacctcatctacaacggcacctggttctcgccaatgcgcaaagcgctcgacgcctttgtggacgagacgcagaagccggtcaccggcatggtcagaatcaagctctacaaaggctcgatgaccctgctcggccgcacctcgcccaactcgctctacaacgaagcgctggccacctataccgaagccgataccttcgaccacaaatctgccgaaggtttcatcaaaatctacggattgggcctgaagactttccacgaggtaaacaagagcgagtga

SEQ ID NO: 5466 - protein, 401 aa, Chlorobium tepidum
MSKEKIAVAYSGGLDTSVMIKWLKDKYEGAEIVAVTGNLGQKMEVDNLEQKAIATGAKSFHFVDLRKTFVEEYIWKALKAGALYEDVYPLATALGRPLLAKALVDVALAEGCTMLTHGCTGKGNDQVRFEVAFAALAPHMKVVAPLREWEFTSREQEIAYAMEHNIPVSATKKNPYSIDENIWGISIECGVLEDPMVAPPADAYQITTAPELAPDEPTVVDIEFAQGVPVALDGQQMEGLDLIVRLNELGAMNGVGRLDMIENRVVGIKSREIYEAPAATILHFAHRELERLTLEKSVFQYKRNIGQDYANLIYNGTWFSPMRKALDAFVDETQKPVTGMVRIKLYKGSMTLLGRTSPNSLYNEALATYTEADTFDHKSAEGFIKIYGLGLKTFHEVNKSE

SEQ ID NO: 5467 - DNA, 1227 bp, Chromobacterium violaceum
  CDS (1)..(1227): transl_table=11
atgtctgacatcaagaaagtggttttggcgtattccggcggtctggatacctcggtgatcctgaagtggctgcaagacgagtatcaatgcgaagtggtgaccttcaccgccgacatcggccagggcgaggaagtggagccggcgcggcagaaagcggtttcgctgggcatcaagccggaaaacatcttcatcgaggacctgcgcgaggagttcgtccgcgatttcgtctacccgatgttccgcgccaacactatttacgaaggcgaatacctgctgggcacctcgatcgcccggccgctgatcgccaagcgtcagatcgagatcgccaaccaggttggcgccgacgcggtatcgcacggcgccaccggcaagggcaacgaccaggtgcgcttcgagctcggttattacgcgctgaagccggatgtgaaagtgatcgcgccgtggcgcgagtgggacctgctgtcgcgcgagaagctgctggcctacgccgaaacccacggcatcgacatcagcaagaagaagaacggcggcagtccgtactcgatggacgccaatctgctgcacatttcctacgaaggcacggtgctggaagatccggcccaggagccggaagaggatatgtggctgtggagcgtgagtccggagaacgcgccggaccaggccgagtacgtggagctggaataccgcaagggcgacatcgtcgccgtcaacggccaagcgctgagcccggccggcgtgctgaccgagctgaaccgcctgggcaacaagcacggcatcggccgcttggacatcgtcgagaaccgctacgtgggcatgaagtcgcgcggctgctatgaaaccccgggcggcaccatcatgctgaaggcgcaccgcgcgatcgagtccatcacgctggaccgcgaagtggcccacctgaaggacgagctgatgccgaaatacgcgcagctgatctacaccggttactggtggagcccggagcgcgcgatgctgcagcagatgatagacgcgtcgcaggccacggtgaacggctgggtgcggctgaagctgtacaagggcaatgtgatcgtcgtcggccgcgaatccaagaccgattcgctgttcgacccgaccatcgccaccttcgacgaggacggcggcgcctacaaccatgccgacgcggccggcttcatccgcctgaacgcgctgcggatgcgcatcgctgccaatgcgcggaacaagcgcggctga

SEQ ID NO: 5468 - protein, 408 aa, Chromobacterium violaceum
MSDIKKVVLAYSGGLDTSVILKWLQDEYQCEVVTFTADIGQGEEVEPARQKAVSLGIKPENIFIEDLREEFVRDFVYPMFRANTIYEGEYLLGTSIARPLIAKRQIEIANQVGADAVSHGATGKGNDQVRFELGYYALKPDVKVIAPWREWDLLSREKLLAYAETHGIDISKKKNGGSPYSMDANLLHISYEGTVLEDPAQEPEEDMWLWSVSPENAPDQAEYVELEYRKGDIVAVNGQALSPAGVLTELNRLGNKHGIGRLDIVENRYVGMKSRGCYETPGGTIMLKAHRAIESITLDREVAHLKDELMPKYAQLIYTGYWWSPERAMLQQMIDASQATVNGWVRLKLYKGNVIVVGRESKTDSLFDPTIATFDEDGGAYNHADAAGFIRLNALRMRIAANARNKRG

SEQ ID NO: 5469 - DNA, 1203 bp, Clostridium acetobutylicum
  CDS (1)..(1203): transl_table=11
atgaaagagaaagttgtgttagcttattcaggtggacttgatacgtctgtaacaattccatggcttaaagataattatgatgttgaggtaatagctgtatgtgttaacgtaggacaagaagatgatatggataaagttaaagaaaaagctgtaaatagtggagcggctaaaatatatgttgaagatgttaaagaggaatttgtgactgagtatttatacaatgccataaagtggaatgccacttatgaaggaaaatatcttttgggaacttcctttgctagacctttaattgcaaagaagctagttgaagttgcacataaagaaggagctaaatatatatgtcatggctgtacaggaaaaggaaacgatcaagtgcgttttgaaacggctattgcagcaatggatccctacattaagataattgctccatggagactttggaatatagattcacgagaagcagaaatagattatgcattatcaaaaggagtagaggttccagtaacaaaggagaagatttattccgaggactggaatttatggcatataagtcacgaaggtggggatttggaagatcctaaaaatgagcataaggaagaaatgtataaatgtgttactccacctgaagaagcaaaggatgaaccagcatatataagcatatattttgaaaagggtgtaccatgtaaaataaatggagaagagctagagcctgttaagcttattgaaaaggtaaataaagtggcaggagaaaatggtataggagttgtagatcttgttgagaacagacttgttggaatgaagtccagaggagtatatgagacgccagggggaactcttctttatgaagcacatgctcaacttgagagactaactgtagataaggatgcatatcactataagcaagtacttgcgcttaagtattcagagcttgtatatgatggtttatggtttacgacaacaagagaggcgcttgatgcatttgttgatacagttgaagaaaatgtgacaggtacagtaaagcttaaattatataagggaaatatgaaagtctctagtgttgagtctgaaaatgcattgtatgatgagggaatatcatcttttggggcaagtgatttatatgatcacaaagatgcgcaaggatttataaatttattcagccttccaagcaaaataaaagctatgaagaagttggagaagaaataa

SEQ ID NO: 5470 - protein, 400 aa, Clostridium acetobutylicum
MKEKVVLAYSGGLDTSVTIPWLKDNYDVEVIAVCVNVGQEDDMDKVKEKAVNSGAAKIYVEDVKEEFVTEYLYNAIKWNATYEGKYLLGTSFARPLIAKKLVEVAHKEGAKYICHGCTGKGNDQVRFETAIAAMDPYIKIIAPWRLWNIDSREAEIDYALSKGVEVPVTKEKIYSEDWNLWHISHEGGDLEDPKNEHKEEMYKCVTPPEEAKDEPAYISIYFEKGVPCKINGEELEPVKLIEKVNKVAGENGIGVVDLVENRLVGMKSRGVYETPGGTLLYEAHAQLERLTVDKDAYHYKQVLALKYSELVYDGLWFTTTREALDAFVDTVEENVTGTVKLKLYKGNMKVSSVESENALYDEGISSFGASDLYDHKDAQGFINLFSLPSKIKAMKKLEKK

SEQ ID NO: 5471 - DNA, 1200 bp, Clostridium difficile
  CDS (1)..(1200): transl_table=11
atgaaggaaaaagtagtattagcatattcaggaggacttgacacatcaatcataataccttggttaaaggaaaattatgaagatatagatgttatagctgtttgtggaaatgtaggtcaggaagataaaatggaagatgtatatgaaaaagctttacaaagtggagcatcaaaggcatatgtggatgatataagtgaagaatttgtaactgaaactatatttaaagccgtaaaagcagaggctaaatatgaaggaaaatacttattaggaacttctttagcaagacctataatagctaaaaaattagttgaagttgctcataaagaaggtgcaaaatatatatgccatggatgtacaggaaaaggtaatgaccaagttagatttgaagctacaattgcagctcttgacccaactataaaagttattgcaccttggagaatttgggatataaaatcaagagaagatgctatagactatgctgaaaaacataatataaaggtaacagcaactaaagctaaaatatattcagtagatgctaacctttggcatgtttcaacagaaggtggagatatagagcacctagaaaatgaacataaaaaagatgtttataaacaatgtgtagacccagaagatgcatgtgatgtagctgaatatgtagaagtttactttgaaaaaggtgtacctaaaaaggtaaatggcgaagaattatctccagttgcactgattcataagttaaatgagttgggttgtaaacatggaattggtgttatagatatagttgagaatagacttgttggtatgaaatcaagaggtatatatgagactccaggaggaacaatcctttatgaagcacataatattttagaaagtgctactttagacaaagatacattacatttcaaacaaatggtatcttataaatacggagaacttatttacaatggactatggtattgtaaattaagagaatctatagatgcatttatggaacaaactcaagataatgttacaggaacagtaaaagttaaactttacaaaggaaatataaaacctgctggaatatttactgaaaatgctctttatgatgaaggaatatcttcttttggaaatagtgaactttatgaccacaaagatgcagaaggatttattaatttattcactttaccattaaaaatcagagctatgaaagctggaaaataa

SEQ ID NO: 5472 - protein, 399 aa, Clostridium difficile
MKEKVVLAYSGGLDTSIIIPWLKENYEDIDVIAVCGNVGQEDKMEDVYEKALQSGASKAYVDDISEEFVTETIFKAVKAEAKYEGKYLLGTSLARPIIAKKLVEVAHKEGAKYICHGCTGKGNDQVRFEATIAALDPTIKVIAPWRIWDIKSREDAIDYAEKHNIKVTATKAKIYSVDANLWHVSTEGGDIEHLENEHKKDVYKQCVDPEDACDVAEYVEVYFEKGVPKKVNGEELSPVALIHKLNELGCKHGIGVIDIVENRLVGMKSRGIYETPGGTILYEAHNILESATLDKDTLHFKQMVSYKYGELIYNGLWYCKLRESIDAFMEQTQDNVTGTVKVKLYKGNIKPAGIFTENALYDEGISSFGNSELYDHKDAEGFINLFTLPLKIRAMKAGK

SEQ ID NO: 5473 - DNA, 1212 bp, Clostridium perfringens
  CDS (1)..(1212): transl_table=11
atgaaaaaatttaataaagtaattttagcctattcaggaggattagatacttcaataataatcccttggttaaaagaaaattatggatgtgaagttattgcagtggtaggaaatgttggacaatctgatgaattagttggattaaaagaaaaagctataaaaactggggcgtctaaaatatatattgaggatctaactaaagaatttgtagaagattacatctttcctaccatacaagctggggcaaaatatgaaggaaagtatctactaggcacttcttttgctagacctataatagcaaaaagattagtagaaattgcaaaacttgaaggtgcagatgctatttgtcatggatgtactggaaaaggaaatgaccaagttcgttttgaattagcaattaaaacttttaatccagaaatgcaaattattgctccatggagaacttgggaaattaaatctagagaagaagaaatacaatatgctatagacaatgaagttcctataaatattacttatgaaacaaattatagtaaagataaaaatctatggcatttaagccatgaaggtttagatttagagtttcctgaaaatgaacctaaatatgataaaattctcgaactatgtaataccttagaaaaggctcctaatgaagctgaatatattactttaggttttgaaaaaggaattgcaacctcattaaatggtgaaaaactagatggagtcactcttttacaggaacttaataaaattggtggaaaacatggtattggagttatagatatggttgaaaatagattagttggtatgaaatcaagaggagtatatgaaactcctggaggatctattttatataaagctcataaagatttagaagaattatgtttagataaggaaacctcccattataaagaaatagtttccttaaaattcgctgatttagtttataatggtcaatggtttaccccattgagagaagccttatctgcctttatatcaaaaactcaagaaactgtaactggcgaaataaaattaaaattatataaaggaaacataataaatgctggaatgacatcaccatattctttatacagcgaagaatacgctacttttggtgaagatggaatatatgatcaaaaggacgctgaaggctttattaatctttttagcttaccatctatcgtacaagctaaaatggcccaaaagttaaattaa

SEQ ID NO: 5474 - protein, 403 aa, Clostridium perfringens
MKKFNKVILAYSGGLDTSIIIPWLKENYGCEVIAVVGNVGQSDELVGLKEKAIKTGASKIYIEDLTKEFVEDYIFPTIQAGAKYEGKYLLGTSFARPIIAKRLVEIAKLEGADAICHGCTGKGNDQVRFELAIKTFNPEMQIIAPWRTWEIKSREEEIQYAIDNEVPINITYETNYSKDKNLWHLSHEGLDLEFPENEPKYDKILELCNTLEKAPNEAEYITLGFEKGIATSLNGEKLDGVTLLQELNKIGGKHGIGVIDMVENRLVGMKSRGVYETPGGSILYKAHKDLEELCLDKETSHYKEIVSLKFADLVYNGQWFTPLREALSAFISKTQETVTGEIKLKLYKGNIINAGMTSPYSLYSEEYATFGEDGIYDQKDAEGFINLFSLPSIVQAKMAQKLN

SEQ ID NO: 5475 - DNA, 1218 bp, Clostridium perfringens
  CDS (1)..(1218): transl_table=11
atgtatatgaaaaaatttaataaagtaattttagcctattcaggaggattagatacttcaataataatcccttggttaaaagaaaattatggatgtgaagttattgcagtggtaggaaatgttggacaatctgatgaattagttggattaaaagaaaaagctataaaaactggggcgtctaaaatatatattgaggatctaactaaagaatttgtagaagattacatctttcctaccatacaagctggggcaaaatatgaaggaaagtatctactaggcacttcttttgctagacctataatagcaaaaagattagtagaaattgcaaaacttgaaggtgcagatgctatttgtcatggatgtactggaaaaggaaatgaccaagttcgttttgaattagcaattaaaacttttaatccagaaatgcaaattattgctccatggagaacttgggaaattaaatctagagaagaagaaatacaatatgctatagacaatgaagttcctataaatattacttatgaaacaaattatagtaaagataaaaatctatggcatttaagccatgaaggtttagatttagagtttcctgaaaatgaacctaaatatgataaaattcttgaattatgtaataccttagaaaaggctcctaatgaagctgaatatattactttaggttttgaaaaaggaattgcaacctcattaaatggtgaaaaactagatggagtcactcttttacaagaacttaataaaattggtggaaaacatggtattggagttatagatatggttgaaaatagattggttggtatgaaatcaagaggagtatatgaaactccaggaggatctattttatataaagctcataaagatttagaagaattatgtttagataaggaaacttcccattataaagaaatagtttccttaaaattcgctgatttagtttataatggtcaatggtttaccccattgagagaagccttatctgcctttatatcaaaaactcaagaaactgtaactggcgaaataaaattaaaactatataaaggaaatataataaatgctggaatgacatctccatattctttatacagcgaagaatatgctacctttggtgaagatggaatatataatcaaaaggacgctgaaggctttattaatctttttagcttaccatctatagtacaagctaaaatggctcaaaagttaaattaa

SEQ ID NO: 5476 - protein, 405 aa, Clostridium perfringens
MYMKKFNKVILAYSGGLDTSIIIPWLKENYGCEVIAVVGNVGQSDELVGLKEKAIKTGASKIYIEDLTKEFVEDYIFPTIQAGAKYEGKYLLGTSFARPIIAKRLVEIAKLEGADAICHGCTGKGNDQVRFELAIKTFNPEMQIIAPWRTWEIKSREEEIQYAIDNEVPINITYETNYSKDKNLWHLSHEGLDLEFPENEPKYDKILELCNTLEKAPNEAEYITLGFEKGIATSLNGEKLDGVTLLQELNKIGGKHGIGVIDMVENRLVGMKSRGVYETPGGSILYKAHKDLEELCLDKETSHYKEIVSLKFADLVYNGQWFTPLREALSAFISKTQETVTGEIKLKLYKGNIINAGMTSPYSLYSEEYATFGEDGIYNQKDAEGFINLFSLPSIVQAKMAQKLN

SEQ ID NO: 5477 - DNA, 1197 bp, Clostridium tetani
  CDS (1)..(1197): transl_table=11
atgacaaaggaaaaagtagtattagcatattcagggggcttagacacttctataatcataccttggttaaaagagaattatgatttagatgttattgcagtatgtatagatgtaggacaagatgatgatatggaagaagttaagaaaaaagccattaaaactggggcagttaaggtttatgtagaggatgcaaaggaagaattcgtaaaggattatgtttttaaagctttaaaggcaaatgctctttatgaagaaaagtatatgttggggacatctcttgcaagaccgttaatggctaaaaaacttgtggaaattgctcataaagaaggagcaaaatatatatgtcatggatgtacaggtaagggaaatgatcaggtaagatttgaagttggaatagcatcttttgatccaagtatcaaaataatagcaccttggagaatttgggatataaaatctagagaagatgctatagattatgcgaaggaaaaaggcgttgaagtacctgtaactaaaaagaaaatatactcagtagataaaaatatattgcatacaagtcatgaaggtggagaattagaagatcctaaaaatgcacataataaagaaatgtatagtatggttacaccaccagaaaaagctaaagatgagcctacttatgtggacatatattttaataagggtgtacctgaaaaaattaatggaaaagaaatatctcctgttgaacttttaaatactttaaataaaattggtggagaaaatggagtaggtgtagtagatatagtagaaaatagattggttggtatgaaatcaagaggagtttatgaaacaccggggggaactattctatatgaagctcataaagatttagagagccttactttagacaaattaactctccattgtaagcaagaattagctcaaaaatatggtgaaatagcttatgatggtttatggtttactactttaagagaatcattagatgcctttgtggatgtaacacaagaaaatgtaacaggaacagttaagttaaaactatacaaagggaatataatgaatgctggaatagatactaaaaacgctctttatgatgaaggaatatcttcctttggagcaagtgaattatatagtcataaagatgcagaaggatttattaaattattttcccttcctagtaaaataaaagctttaaagaataaataa

SEQ ID NO: 5478 - protein, 398 aa, Clostridium tetani
MTKEKVVLAYSGGLDTSIIIPWLKENYDLDVIAVCIDVGQDDDMEEVKKKAIKTGAVKVYVEDAKEEFVKDYVFKALKANALYEEKYMLGTSLARPLMAKKLVEIAHKEGAKYICHGCTGKGNDQVRFEVGIASFDPSIKIIAPWRIWDIKSREDAIDYAKEKGVEVPVTKKKIYSVDKNILHTSHEGGELEDPKNAHNKEMYSMVTPPEKAKDEPTYVDIYFNKGVPEKINGKEISPVELLNTLNKIGGENGVGVVDIVENRLVGMKSRGVYETPGGTILYEAHKDLESLTLDKLTLHCKQELAQKYGEIAYDGLWFTTLRESLDAFVDVTQENVTGTVKLKLYKGNIMNAGIDTKNALYDEGISSFGASELYSHKDAEGFIKLFSLPSKIKALKNK

SEQ ID NO: 5479 - DNA, 1257 bp, Colwellia psychrerythraea
  CDS (1)..(1257): transl_table=11
atggctttagcaaagaaaacaattaaaaaagtagtactggcatattcaggtggattagatacttcagctatcattccatggttaaaagaaaattacgacggttgtgaagttatcgcgttttgtgctgatgtaggccaaggtgatgaagaacttgaaggcgttaaagaaaaagccatagcatcaggtgcatcagaatgttatgtagttgatcttaaagaagaatatgtaaaagaatatatctacccaattctgaaaacaggttcagtgtatgaaggtcaatatttgttaggtacgtcaatggcacgtcctatcattgctaaagcacacatagaagttgcgcttaaagttggcgctgatgcagtgtgtcatggctgtaccggtaagggtaacgaccaagtacgttttgaatcttgttttgccgctttagcgccagagcttactgttattgcaccatggcgtgaatgggacatggtttctcgtgaagacttacttgattatttagcagaacgtaatattccttgtgctgcttcattaactaaaatctatagtcgtgatgcaaacgcttggcatatctctcatgaaggtggtgagttagaagacccatggtgtgagccatcaaaagaagtatggaccatgacggttgatccaatggatgcgccagatgtgccggaaaaagtacaattaagctttaaagaaggtgaattggttggtattgatggtaaagatttttctcaacatggcgctggtgcctatgaagccttaatgtaccttaacgagaaaggttcagcacacggtgtcggcagaattgatatcgtagaaaatcgtttagtcggtatgaaatctcgtggttgttatgaaacaccaggtggtactattttaatggccgcttacaaaggcttagaaacgcttattctagacaaagaatcacttaaataccgtgaatctgtaggacttgaattctctcatgttatctatgacggacgttggtttacaccacttgctaaagcacagctagcctctgctgcatcgtttgctgaaaagctaacaggtgatgttgttgttaaattatacaaaggtatggcgcaagtgattcaacgtcgctctccaaatagtttgtattctgaagcgtttgctacttttggcgctgatgatgtttacgaccaaaaacatgccgaaggttttattcgtttatttagtctatcaagcaggattaccgcgctttctcaaaaagactctttaaaagataaggcagaataa

SEQ ID NO: 5480 - protein, 418 aa, Colwellia psychrerythraea
MALAKKTIKKVVLAYSGGLDTSAIIPWLKENYDGCEVIAFCADVGQGDEELEGVKEKAIASGASECYVVDLKEEYVKEYIYPILKTGSVYEGQYLLGTSMARPIIAKAHIEVALKVGADAVCHGCTGKGNDQVRFESCFAALAPELTVIAPWREWDMVSREDLLDYLAERNIPCAASLTKIYSRDANAWHISHEGGELEDPWCEPSKEVWTMTVDPMDAPDVPEKVQLSFKEGELVGIDGKDFSQHGAGAYEALMYLNEKGSAHGVGRIDIVENRLVGMKSRGCYETPGGTILMAAYKGLETLILDKESLKYRESVGLEFSHVIYDGRWFTPLAKAQLASAASFAEKLTGDVVVKLYKGMAQVIQRRSPNSLYSEAFATFGADDVYDQKHAEGFIRLFSLSSRITALSQKDSLKDKAE

SEQ ID NO: 5481 - DNA, 1200 bp, Corynebacterium diphtheriae
  CDS (1)..(1200): transl_table=11
atgaccaatcgtgtcgtcctcgcctattcaggtggactcgatacctccgttgcaattccatacctggctaagatgactggtggcgaagttgtcgcagtttctttggatcttggccaaggcggagaggacatggagtccgttcgtcagcgtgcacttgattgtggtgcggttgaatctattgtcattgacgctaaagatgagtttgccaatgattactgcctgccgactatcaaagcaaacggcatgtacatgaagcagtaccctttggtttctgcaatctctcgtccactcatcgtgaagcacttggtagaagccgctaaaaaacatggtggtacccatgtttcccatggttgtactggtaaaggaaacgatcaggttcgatttgaggtaggtttccgcaaccttgctccagaactgcagatcattgccccagcccgtgattacgcatggactcgcgataaggcgattgcttttgctgaagagattaatctacctatcgagcaatccaagaagtcgccattctccatcgatcaaaatgtttggggacgtgccgtagagaccggtttcctcgaggatctctggaacccgccgacaaaagatctatactcctacactgaagatccagctctcggaaatgctcctgatgagatcatcattagcttcaaagctggtgttccggtagcaatcgatggacgtccagtcaccgtacttgaagcaattgaagaaatgaaccgtcgtgcaggtgcacaaggcattggccgtctggacatggtggaagatcgtctcgttggtattaaatctcgcgaggtctacgaagctccaggcgcaattgcactgattacagcacaccaagctatggaagatgtgaccattgagcgtgagcttgcacgttacaagcgcggaatcgacgctcgttggtctgaagaggtgtacgacggattgtggtacgcgccactcaagcgttctttggatgcgttcattgaaaatactcaagagcacgtaacaggtgacattcgcatggtcatgcatgctggtaagtgcaccgtaaacggacgtcgttctgagcattcgctttacgacttcgacttggctacttatgacaccggtgataccttcgaccagaccttggctaagggctttgtggaacttcacggtttgtcatccaagatctcgaacaagcgtgaccgtgaggcacaatag

SEQ ID NO: 5482 - protein, 399 aa, Corynebacterium diphtheriae
MTNRVVLAYSGGLDTSVAIPYLAKMTGGEVVAVSLDLGQGGEDMESVRQRALDCGAVESIVIDAKDEFANDYCLPTIKANGMYMKQYPLVSAISRPLIVKHLVEAAKKHGGTHVSHGCTGKGNDQVRFEVGFRNLAPELQIIAPARDYAWTRDKAIAFAEEINLPIEQSKKSPFSIDQNVWGRAVETGFLEDLWNPPTKDLYSYTEDPALGNAPDEIIISFKAGVPVAIDGRPVTVLEAIEEMNRRAGAQGIGRLDMVEDRLVGIKSREVYEAPGAIALITAHQAMEDVTIERELARYKRGIDARWSEEVYDGLWYAPLKRSLDAFIENTQEHVTGDIRMVMHAGKCTVNGRRSEHSLYDFDLATYDTGDTFDQTLAKGFVELHGLSSKISNKRDREAQ

SEQ ID NO: 5483 - DNA, 1206 bp, Corynebacterium efficiens
  CDS (1)..(1206): transl_table=11
atgaccaatcgtgtcgtactcgcgtactccggtggcctggacacctctgtcgccatcccgtacctgtccaagatgaccggcggcgaggtcgtcgccgtctccctcgacctcggtcagggcggcgaggacatggagtccgtccgccagcgtgcgctcgactgcggtgcggtcgaatccatcgtcatcgacgccaaggatgagttcgccgaggagtactgcctgcccaccatcaaggccaacggcatgtacatgaagcagtacccgctggtgtccgcgatctcccgtccgctgatcgtcaagcacctggtgcaggccgccaaggagcacggtggcacccacgtctcccacggctgcaccggcaagggcaatgaccaggtccgcttcgaggtcggtttcatggacctcgaccccagcctggagatcatcgccccggcacgtgactacgcatggacccgcgacaaggccatcgagttcgccgaggagaacaacgttccgatcgagcagtccgcagcctccccgttctccatcgaccagaacgtctggggccgtgccatcgaaaccggtttcctcgaggacctgtggaacccgccgaccaaggacctctacgcctacaccgaggatcccgccctgggcaacgcccccgatgaggtcatcatcaccttcaagtccggcaagcctgtcgccatcgacggccgtccggtcaccatgctcgaggccatcgaggagctcaaccgccgtggtggtgcacagggtgtcggtcgtctcgacatggtcgaggaccgcctcgtgggcatcaagtcccgcgagatctacgaggcaccgggtgccatcatcctcatcaccgcccacgaggccatggaggacgtcaccatcgagcgtgagctggcccgctacaagcgcggtatcgacgcccgctggtccgaggaggtctacgacggtctctggttcggcccgctgaagcgctccctggatgccttcatcgagtccacccaggagcacgtcaccggtgatatccgcctggtgctgcacgccggcaaggtcaccgtcaacggccgtcgttccggttcctccctctacgacttcaacctggccacctacgacaccggcgacaccttcgaccagaccgcagccaagggcttcgtccagctgcacggcctgtcctccaagatcgccaataagcgcgaccgcgaggccggcgagaactag

SEQ ID NO: 5484 - protein, 401 aa, Corynebacterium efficiens
MTNRVVLAYSGGLDTSVAIPYLSKMTGGEVVAVSLDLGQGGEDMESVRQRALDCGAVESIVIDAKDEFAEEYCLPTIKANGMYMKQYPLVSAISRPLIVKHLVQAAKEHGGTHVSHGCTGKGNDQVRFEVGFMDLDPSLEIIAPARDYAWTRDKAIEFAEENNVPIEQSAASPFSIDQNVWGRAIETGFLEDLWNPPTKDLYAYTEDPALGNAPDEVIITFKSGKPVAIDGRPVTMLEAIEELNRRGGAQGVGRLDMVEDRLVGIKSREIYEAPGAIILITAHEAMEDVTIERELARYKRGIDARWSEEVYDGLWFGPLKRSLDAFIESTQEHVTGDIRLVLHAGKVTVNGRRSGSSLYDFNLATYDTGDTFDQTAAKGFVQLHGLSSKIANKRDREAGEN

SEQ ID NO: 5485 - DNA, 1407 bp, Dechloromonas aromatica
  CDS (1)..(1407): transl_table=11
atgagcgatatcaagaaggttgtgctggcctattcgggcggtctggatacttcggtcatcctcaagtggctgcaggatgtttacaagtgtgaagtcgttaccttcacggccgacctcggtcagggtgaggaactggagccggcgcgtgccaaggcactgaaggccggcatcaagccgaagaacatttatatcgacgacgtgcgcgaggagttcgtccgcgacttcgtcttcccgatgttccgtgccaacaccgtctatgaaggcgaatacctgctcggtacctccatcgcccgtccgctgattgccaagcgtctgatcgagatcgtcaatgaaaccggtgccgatgccatctgtcatggcgcaaccggcaaagggaacgatcaggtccgtttcgaactcggtgcctatgcgctgaagccgggcatcaaggtcattgccccgtggcgcgagtgggacctgatgtcccgtgaaaaattgatggcctatgccgagaagcatggcatcgagattgacatgaagcacaagaagggcggctccccgtactcgatggatgccaacctgctgcacatctcctatgaaggtcgccatctggaagacccggcggccgaggctgaagagtcgatgtggcggtggactgtgtcgccggaaaaggcaccgaacaaggccgagtacctcgatctggaatttgccaagggtgatgtcgtcgcggtcaatggcaagaagctgaaggctcatgaagtgctggccctgctcaacgagttgggtggcaagcacggcatcggccgtctcgatctggttgagaaccgctatgtcggcatgaagtcacgtggctgttacgaaaccccgggcggcaccattctgctgcgcgcccaccgcgccatcgagtcggtgacccttgaccgcgaagttgcccacctcaaggatgacctgatgccgcgctacgccagcctggtgtacaacggctactggtggagcccggagcgtaaggcgctgcaggtgctgatcgatcacacgcaacagacggtcaacggcgttgttcgcctgaagctgtacaagggcaacgtcatcgtcgtcggtcgcgattcgaagacggattcgctgttcgactcgaccattgccacttttgaggatgacgccggtgcttacgaccagcgcgatgcaggcggctttatcaagctgaatgcgctgcgtttacgtattgcggccaatctggctggccgcaaggctggcaagccggttgcgaagaaggctgctgccaagcctgtcaccaaagctgtccccaaggcggttgccaagccggtgacgaaggctgtagcaaaggccgctgaaaaaccggttgccgccaaagctaccgccaagcctgtcaaggctccggtcaagaagccaatcgccaaaaagaagggctaa

SEQ ID NO: 5486 - protein, 468 aa, Dechloromonas aromatica
MSDIKKVVLAYSGGLDTSVILKWLQDVYKCEVVTFTADLGQGEELEPARAKALKAGIKPKNIYIDDVREEFVRDFVFPMFRANTVYEGEYLLGTSIARPLIAKRLIEIVNETGADAICHGATGKGNDQVRFELGAYALKPGIKVIAPWREWDLMSREKLMAYAEKHGIEIDMKHKKGGSPYSMDANLLHISYEGRHLEDPAAEAEESMWRWTVSPEKAPNKAEYLDLEFAKGDVVAVNGKKLKAHEVLALLNELGGKHGIGRLDLVENRYVGMKSRGCYETPGGTILLRAHRAIESVTLDREVAHLKDDLMPRYASLVYNGYWWSPERKALQVLIDHTQQTVNGVVRLKLYKGNVIVVGRDSKTDSLFDSTIATFEDDAGAYDQRDAGGFIKLNALRLRIAANLAGRKAGKPVAKKAAAKPVTKAVPKAVAKPVTKAVAKAAEKPVAAKATAKPVKAPVKKPIAKKKG

SEQ ID NO: 5487 - DNA, 1221 bp, Dehalococcoides ethenogenes
  CDS (1)..(1221): transl_table=11
atgtctgaaaaagttgtactggcatattccggcgggctggatacatcggccgccgtcaaatggcttcaggaaaaatacggcatggacgttattgccgttaccatagacgtgggtaatgagaaagactttaccctgataaaagaaaaagccctgaaggtaggggctaaaaaggcctacgtacgggatgtacgcaaggaatttgccgaggattatatctggaaggctatcaaggccaattccatgtacgagggtgtctatccgctggctaccgcccttgcccgccccctgattgccaaggttatggtagacatagccatggaagaaggggctaccgccattgcccacggctgcaccggcaaaggcaatgaccaggtacgttttgacgtgggcataaacacccttgccccccatttgaagattattgctcccgcccgccagtggggcatgacccgtgagcaaactatggaatacgcccagaaatggggcattcccgtacctatttcagtcaaaaaccctttctccatagatgaaaatctgtgggggcggagtatagagtgcggtctgctggaagacccctggaacgagcctattcccgaagtatttgcctggacccgcccggtggaagcaaccccggacgcacctgagtacctggaagtagagtttgaacagggcgtgccggtagctgtaaacggggaaaaactgtctcctttagcccttatacagaaagtgcatgatattgccggactgcatggggtaggccgtattgaccacgtggaaaaccgtctggtaggcattaaatcccgcgagatttatgaagccccggcggcggtggtgctgattgccgcccaccaggctctggaagccatgaccctttccaagagccagttacgctttaagcagatggtggaagccacctattcggatattatttataacgggctgtggttctctgccctgcggcaggatttggacgcttttatagaatccagccagcgctttgtcagcggcacagtccgcttaaagctttccaagggcagcttccgggtagtgggacgcaaatccccctattccctgtaccacaagggtatggccacctatgataagggagaccagtttgacccgtcttcggcagtgggtttcataaccctgtggggacttcaggccaaactgcaggcccagctccagcctattctggaagaagaaaaggggaataaatcctag

SEQ ID NO: 5488 - protein, 406 aa, Dehalococcoides ethenogenes
MSEKVVLAYSGGLDTSAAVKWLQEKYGMDVIAVTIDVGNEKDFTLIKEKALKVGAKKAYVRDVRKEFAEDYIWKAIKANSMYEGVYPLATALARPLIAKVMVDIAMEEGATAIAHGCTGKGNDQVRFDVGINTLAPHLKIIAPARQWGMTREQTMEYAQKWGIPVPISVKNPFSIDENLWGRSIECGLLEDPWNEPIPEVFAWTRPVEATPDAPEYLEVEFEQGVPVAVNGEKLSPLALIQKVHDIAGLHGVGRIDHVENRLVGIKSREIYEAPAAVVLIAAHQALEAMTLSKSQLRFKQMVEATYSDIIYNGLWFSALRQDLDAFIESSQRFVSGTVRLKLSKGSFRVVGRKSPYSLYHKGMATYDKGDQFDPSSAVGFITLWGLQAKLQAQLQPILEEEKGNKS

SEQ ID NO: 5489 - DNA, 1221 bp, Dehalococcoides sp
  CDS (1)..(1221): transl_table=11
atgtctgaaaaagttgtgctggcatactccggcgggttagatacctcagccgccgtcaaatggcttcaggaaaaatacggcatggacgtgattgccgttactatagacgtgggtaatgaaaaagattttaccctgataaaggaaaaagccctgaaggtaggcgctaaaaaagcctatgtacgggatgtgcgcaaggaatttgccgaggattatatctggaaagctatcaaagccaattccatgtacgaaggcgtctatccgctggcaaccgcccttgcccgcccccttattgccaaggttatggtagatatagcccttgaggaaggggctaccgccattgcccacggttgtaccggcaaaggcaatgaccaggtacgctttgacgtgggtataaatacccttgccccccatttaaaaattattgctccggcccgccagtggggcatgacccgcgagcagaccatggaatacgcccagaaatggggcattcccgtacctatttcggttaaaaaccccttctctatagatgaaaacctgtggggacggagtatagagtgcggtctgctggaagacccttggaacgagcctattcccgaggtatttgcctggacccgaccggtggaagaaaccccggatgagcccgaatatttggaagtagagtttgaacagggtgtgcctgtggctgtaaacggagaaaaactgtctcctctggcgctaatccagaaggtgcatgatattgccagtttgcacggggtaggccgtattgaccacgtggaaaaccgtctggtaggcataaaatcccgcgagatttacgaagccccggccgcggttgtccttattgccgcccatcaggctttggaggccatgaccctttccaagagccaattacgctttaagcagatggtggaagctacctattcggatattatttataacggtctgtggttctctgccctgcggcaggatctggacgcttttatagactccagccagcgttttgtcagcggcacagtccgcctgaaactctccaagggaagtttccgggtagtgggacgcaaatccccatattccctgtaccacaagggtatggccacttacgataagggcgaccagtttgacccgtcttcggcagtgggttttataaccctgtgggggcttcaagccaaactgcaagcccagcttcaacctattttggaagaagaaaaggggaataaatcctaa

SEQ ID NO: 5490 - protein, 406 aa, Dehalococcoides sp
MSEKVVLAYSGGLDTSAAVKWLQEKYGMDVIAVTIDVGNEKDFTLIKEKALKVGAKKAYVRDVRKEFAEDYIWKAIKANSMYEGVYPLATALARPLIAKVMVDIALEEGATAIAHGCTGKGNDQVRFDVGINTLAPHLKIIAPARQWGMTREQTMEYAQKWGIPVPISVKNPFSIDENLWGRSIECGLLEDPWNEPIPEVFAWTRPVEETPDEPEYLEVEFEQGVPVAVNGEKLSPLALIQKVHDIASLHGVGRIDHVENRLVGIKSREIYEAPAAVVLIAAHQALEAMTLSKSQLRFKQMVEATYSDIIYNGLWFSALRQDLDAFIDSSQRFVSGTVRLKLSKGSFRVVGRKSPYSLYHKGMATYDKGDQFDPSSAVGFITLWGLQAKLQAQLQPILEEEKGNKS

SEQ ID NO: 5491 - DNA, 1209 bp, Deinococcus radiodurans
  CDS (1)..(1209): transl_table=11
atgagcaaggaaaaaatcgtactcgcgtacagcggcggcttagacacctccatcatcctcaagtggctccagaccgagcgcaactacgacgtggtgtgcttcaccgccgacctcgggcagggcgacgaggtggaagaagcccgtgtcaaggcgttgaacaccggcgcggtggcggcctacgcccttgacctgcgcgaagaattcgtgcgcgactacgtgtttccgatgatgcgctcctcggcgctgtacgagggctactacctgctcggcacgtccatcgcccggcccctgattgccaagaagatggtcgagattgccgagaaggagggcgcggtcgccatttcgcacggcgcgaccggcaagggcaacgatcaggtgcgcttcgagatgagcgcctacgccctcaagcccgacatcgtgaccgtggccccctggcgtgactgggactttcagggccgcgccgacctcgaagcctttgcccgcgagcacggcattccggtgcccaccaccaagaaagacccctggagcatggacgccaacatgctgcacatctcctatgagggcggcccgctcgaagacccctggactgagccgcccacccacatgttcaagctgacggtgaaccccgaggacgcgccgagcgaggccgaatacgtcgaaatcgagtacgtgaacggcgacccggtgagcatcaacggtgaacagctctcgcccgccgcgctgctgacgaaggcgaacgaaatcgccgggcgtcacggcgtgggccgcatcgacctcgtggagaaccgcttcgtgggcatgaagtcgcgcggcgtgtacgaaacgcccggcggcacgctgctgtaccacgcccgccgcgccgtggaaagcctgaccctcgaccgcgaagtgctgcatcagcgcgacgccctggggccgaagtacgccgaactggtctataacggcttctggttcgcccccgagcgcgaagccttgcaggtctactttgaccatgtggccaaaagcgtgacgggcaccgctcgcctgaagttgtacaagggcaactgcatcgtggcaggccgcaaggccgagcgcagcctctacgacaaggacctcgtgagcttcgaggcgggcggtgactacaaccagcacgacgccggagccttcatcaagctcaactcgctgcggatgcgggtgcaaaagcgcgtggaggataaagggaagaagtaa

SEQ ID NO: 5492 - protein, 402 aa, Deinococcus radiodurans
MSKEKIVLAYSGGLDTSIILKWLQTERNYDVVCFTADLGQGDEVEEARVKALNTGAVAAYALDLREEFVRDYVFPMMRSSALYEGYYLLGTSIARPLIAKKMVEIAEKEGAVAISHGATGKGNDQVRFEMSAYALKPDIVTVAPWRDWDFQGRADLEAFAREHGIPVPTTKKDPWSMDANMLHISYEGGPLEDPWTEPPTHMFKLTVNPEDAPSEAEYVEIEYVNGDPVSINGEQLSPAALLTKANEIAGRHGVGRIDLVENRFVGMKSRGVYETPGGTLLYHARRAVESLTLDREVLHQRDALGPKYAELVYNGFWFAPEREALQVYFDHVAKSVTGTARLKLYKGNCIVAGRKAERSLYDKDLVSFEAGGDYNQHDAGAFIKLNSLRMRVQKRVEDKGKK

SEQ ID NO: 5493 - DNA, 1203 bp, Desulfovibrio desulfuricans
  CDS (1)..(1203): transl_table=11
atgggtaaagaaatcaaaaaggtagtgcttgcctattccggcgggctggatacgtcggtcatcctgaagtggattgccaagacatatgattgcgaagtggtgacgctgactgccgatctggggcaggaggaagatctggacggcgtggatgaaaaagcgctgcgcacaggggccaccagagcctatgtggaagacctgcgcgaagagttcgcccgcgatttcatttttcccatgatgcgtgcctgcgccatttacgaaggccgctatctgctgggcacttccatcgcccgtccgctcattacccgccgtctggtggaaatagcccacgcggaaggagcacaggcagtggcccacggtgctaccggcaaaggcaacgatcaggtgcggttcgagctggcttccgccgcacttgacccgtcgctcaaggtcattgctccgtggcgcgaatgggatttccgctcccgtaccgacctgctcaactttgctgcagaaaatgatattcccgttatttctgccggtaaccgcaaactgtacagtatggacagaaacatgctgcactgcagctttgaaggcggcgaactggaagacccgtggaacgagccgggaccgggcagttatatcatggcagtaccggtagagcaggctcctgacgagccggaatacatcaccatcgattttgaaaaaggcaacgccgtggcaatcaacggtcaggccatgtcgcctgccgccatcatcaaaacgctgaacacacttggcggcaagcacggtgtaggacgtctggacatggtggaaaaccgttttgtgggcatgaagtcgcgcggtgtgtatgaaacccccggcggcaccgtgctgcatgcggcacaccgcgacctcgaaggcatatgccttgaccgtgaagccctgcatctgcgcgacagcctgataccccgctacgccgcggccgtgtacaacggtttctggtactcgccggagcgcgaagccctgcaggctctggtagacaagacacaggaaaacgtgaccggaacagtgcgcgtgaagctgtataaaggcaatgtcgtgcccgtgggccgcaagtcgccgtattcactgtaccgtatggatcttgcgacctttgaggaagatgaagtttacaatcaggcagacgccgccggctttatccgcctgaacagtctgcgcattcagggttacggcaggagaagctga

SEQ ID NO: 5494 - protein, 400 aa, Desulfovibrio desulfuricans
MGKEIKKVVLAYSGGLDTSVILKWIAKTYDCEVVTLTADLGQEEDLDGVDEKALRTGATRAYVEDLREEFARDFIFPMMRACAIYEGRYLLGTSIARPLITRRLVEIAHAEGAQAVAHGATGKGNDQVRFELASAALDPSLKVIAPWREWDFRSRTDLLNFAAENDIPVISAGNRKLYSMDRNMLHCSFEGGELEDPWNEPGPGSYIMAVPVEQAPDEPEYITIDFEKGNAVAINGQAMSPAAIIKTLNTLGGKHGVGRLDMVENRFVGMKSRGVYETPGGTVLHAAHRDLEGICLDREALHLRDSLIPRYAAAVYNGFWYSPEREALQALVDKTQENVTGTVRVKLYKGNVVPVGRKSPYSLYRMDLATFEEDEVYNQADAAGFIRLNSLRIQGYGRRS

SEQ ID NO: 5495 - DNA, 1230 bp, Desulfitobacterium hafniense
  CDS (1)..(1230): transl_table=11
atgttaagaaaggaagttatccctatgaaaaaggtagtgcttgcgtattccggaggattagatacctcgatcatcatcccttggctgaaagagaattatggctatgaagtcattgctatggccgctgacctgggacaaggagaagagctggagcctctccacgaaaaagcgattaagagcggagccagtaaattatatatcgaagatctgcaagaagaattcgttactgatttcatctaccccaccctaaaagccggagctgtctatgaaggcaaatatcttttgggaacctcctttgcccgtcccctgattgcccaacgtttagtagagattgcggcaaaagagggagctgtggccattgctcacggtgccacgggaaaaggaaacgaccaggttcgctttgagctggctgtcaaagccttaaatcctgatctggagatcatagctccttggcggatttgggatatcaagtcccgggaagatgctattgactatgctgttgagaggggaattcctgtccctgtaacgaaagatcgcccttacagtatggaccgcaatgtctggcatctcagccatgaaggaggcgatttagaagatccttggaatgagcccaaaaaggatctctatctccttggggtttcaccggaagatgctcccgacgaagccgagtacctggaactggattttgaacaaggtattcctgtttctttaaacggagaaaagttaggtcctgttcagcttttggagaccctcaatgaggttggcggcaaacacggcattggcattgtggacatggtggaaaaccgcttagtaggaatgaaatcccggggggtttatgagactcccggtggtaccattctctatacagctcatcaagccctggaacatttgaccttggatcgtttgacccttcattataaggagcaaatcgccctgaaatacgctgaattggtttacgacggcgtttggcattctcctttgcgggaagccctggatgccttcgtggatgttacccagaaaaatgtcaccggaacggtacgcctgaagctttataaaggcaattgcagcttagccggtgtgaaatccccctactccctctatagtgaagaatttgctaccttcggacgggatggggtctataaccaaaaggatgctgaaggtttcatcaatctcttcggtcttcctcttaaagtaagagcgttaatggaaaagaaatcagggttgagataa

SEQ ID NO: 5496 - protein, 409 aa, Desulfitobacterium hafniense
MLRKEVIPMKKVVLAYSGGLDTSIIIPWLKENYGYEVIAMAADLGQGEELEPLHEKAIKSGASKLYIEDLQEEFVTDFIYPTLKAGAVYEGKYLLGTSFARPLIAQRLVEIAAKEGAVAIAHGATGKGNDQVRFELAVKALNPDLEIIAPWRIWDIKSREDAIDYAVERGIPVPVTKDRPYSMDRNVWHLSHEGGDLEDPWNEPKKDLYLLGVSPEDAPDEAEYLELDFEQGIPVSLNGEKLGPVQLLETLNEVGGKHGIGIVDMVENRLVGMKSRGVYETPGGTILYTAHQALEHLTLDRLTLHYKEQIALKYAELVYDGVWHSPLREALDAFVDVTQKNVTGTVRLKLYKGNCSLAGVKSPYSLYSEEFATFGRDGVYNQKDAEGFINLFGLPLKVRALMEKKSGLR

SEQ ID NO: 5497 - DNA, 1197 bp, Desulfotalea psychrophila
  CDS (1)..(1197): transl_table=11
atgagcgttgataaaattgtactcgcctattcaggcggtttagatacatctgttattttaaagtggttggccaatgagtatgaatgtcctgttgttgcctattctgctaatattggccagatagaggattgggatgcagttaaggaaaagggtatggccaccggtgccgataaggtaatcgtttccgacctgcagaaggaatttgttgaagattatatcttccccgcctttcgtgcatctgcaatttacgagggcacctatcttcttggtacctctcttgcccgtccacttatctctaaagagcaggtacgtattgcccatgcagagggtgccaacgccgtaagtcatggcgccaccggtaagggtaacgatcaggttcgttttgagctcggttatatcggtcttgatcctagtctgcagatcattgctccatggcgtacctgggatctcaactcccgtaccagacttgaagagtatgctaagcagcataatattcctgtgccaaccaccaagaaaaacccctatagctccgatgagaacctgcttcacatcagctttgagggcggcatccttgagagcccatggaatgagcctgatccggatatgttcaaactcaccgtctctcctgagatggccccggacaagcctacctatctggaaatcacctttcaaaacggtgatcctatagcccttgatggcgttgccatggaaccacttgagcttttcagagcgcttaataaggttgccggtgaaaatgctgttggtcgtcttgatcttgtcgagaaccgtttcgttggtatgaagagtcgtggtgtctatgagactcctggtggaaccctgctctatcatgctcaccgtgatcttgagaccatctgtctcgatcgtgaggtgatgaagattcgtgactctttggtgcctcgttatgctgagcttatctacaatggtttctggttctcacctgagcgcgagcttctccagatgaccatggatactgcccagaagaccgtaagcggtgtggtacgtatgaagctttataagggcaactgtttttctgttggccgtaagtctgatcagagtctttacaaagaagattttgccacctttgaagcagatgatgtatatgaccagggcgatgccaccggttttatccgtctcaatggccttcgtttgaagatcaacgcactgcagggcaagtaa

SEQ ID NO: 5498 - protein, 398 aa, Desulfotalea psychrophila
MSVDKIVLAYSGGLDTSVILKWLANEYECPVVAYSANIGQIEDWDAVKEKGMATGADKVIVSDLQKEFVEDYIFPAFRASAIYEGTYLLGTSLARPLISKEQVRIAHAEGANAVSHGATGKGNDQVRFELGYIGLDPSLQIIAPWRTWDLNSRTRLEEYAKQHNIPVPTTKKNPYSSDENLLHISFEGGILESPWNEPDPDMFKLTVSPEMAPDKPTYLEITFQNGDPIALDGVAMEPLELFRALNKVAGENAVGRLDLVENRFVGMKSRGVYETPGGTLLYHAHRDLETICLDREVMKIRDSLVPRYAELIYNGFWFSPERELLQMTMDTAQKTVSGVVRMKLYKGNCFSVGRKSDQSLYKEDFATFEADDVYDQGDATGFIRLNGLRLKINALQGK

SEQ ID NO: 5499 - DNA, 1191 bp, Desulfovibrio vulgaris
  CDS (1)..(1191): transl_table=11
atgtccggtatcaagaaggtcgttctcgcctactctggcggtctcgatacgtccgtcatcctgaagtggctcgccgtcacctataactgcgaagtggtgaccctcaccgccgacctcggtcaggaagaggacctcgacggcgtggacgacaaggccatgcgcacgggagcctcccgcgcctacgtcgaagacctgcaggaagagttcgcccgcgacttcatcttccccatgatgcgcgccggggcggtctatgaaggccgctacctgctgggcacctccatcgcgcgcccgctcatcgccaagcgccttgtcgagatcgctcgcgccgaaggcgcgcaggccgtggcccacggcgccaccggcaagggcaacgaccaggtgcgcttcgaactggcagtgaacgccctcgcacccgacctgcgcgtcatcgcgccgtggcgagaatgggacctgcgctcgcgcacgcagctcaacgccttcgccgaagagcacggcatccccatctccagttcggccaagcagtacagcatggaccgcaacatgctccactgcagcttcgagggcggcgaacttgaagacccgtggaacgaacccggccccaacagctacgtcatggccgttcccatggaacaggcccccgacgaggccgagtacatcagcatcgacttcgaacacggcaaccccgtggccgtgaacggcgaacgcctctcgcccgccgcgctggtcaagaagctcaacagcatcggcggacgtcacggcatcggccgtctcgacatggtcgagaaccgcttcgtgggcatcaagtcgcgcggcgtgtacgagacccccggcggtacgctcatccacatcgcccaccgagacctcgaaggcatctgcatcgaccgcgagaccatgcacctgcgcgacgccatgctgccccgctacgccgcagccatctacaacggcttctggttcgcccccgaacgcgaggccatgcaggcgatgatcgacgtctcgcagcagcgcgtcaccggcaccgtgcgcctgaagctgtacaagggcaatgcgtggcccgtgggtcgccagtcgcccaacaccctctactgccacgacctcgccaccttcgaagactgcgccacctacgaccacaaggacgcggcaggcttcatcaaactgcagggtctgcgcatccgcggttacaagaagggatag

SEQ ID NO: 5500 - protein, 396 aa, Desulfovibrio vulgaris
MSGIKKVVLAYSGGLDTSVILKWLAVTYNCEVVTLTADLGQEEDLDGVDDKAMRTGASRAYVEDLQEEFARDFIFPMMRAGAVYEGRYLLGTSIARPLIAKRLVEIARAEGAQAVAHGATGKGNDQVRFELAVNALAPDLRVIAPWREWDLRSRTQLNAFAEEHGIPISSSAKQYSMDRNMLHCSFEGGELEDPWNEPGPNSYVMAVPMEQAPDEAEYISIDFEHGNPVAVNGERLSPAALVKKLNSIGGRHGIGRLDMVENRFVGIKSRGVYETPGGTLIHIAHRDLEGICIDRETMHLRDAMLPRYAAAIYNGFWFAPEREAMQAMIDVSQQRVTGTVRLKLYKGNAWPVGRQSPNTLYCHDLATFEDCATYDHKDAAGFIKLQGLRIRGYKKG

SEQ ID NO: 5501 - DNA, 1344 bp, Escherichia coli O157
  CDS (1)..(1344): transl_table=11
atgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctataaaggaaacgatatcgaacgtttctatcgttatggtctgctgaccaatgctgaactgcagatttacaaaccgtggcttgatactgactttattgatgaactgggcggtcgtcatgaaatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgagcaaggtcatccggtggcgttgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggccgtcagttgggccgtctgctgtaccaggggcgttggtttgattcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtatcggtcaactgaccatgcgcaacctggatatcaccgatacccgcgagaaacttttcggttatgccaaaactggcctgctttcctcctctgccgcttcaggcgtgccgcagatggagaatctggaaaacaaaggccagtaa

SEQ ID NO: 5502 - protein, 447 aa, Escherichia coli O157
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSAASGVPQMENLENKGQ

SEQ ID NO: 5503 - DNA, 1344 bp, Escherichia coli O6
  CDS (1)..(1344): transl_table=11
atgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggtggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcaaaaagccgcggcatttatgaagcccctgggatggcactgctgcacattgcgtatgaacgtttgttgaccggtattcacaacgaagacaccattgagcagtatcacgcgcatggtcgtcagttgggccgtctgctgtaccagggacgttggtttgattcccaggcgctgatgctgcgtgactctctgcaacgctgggttgccagccagatcactggtgaagttactctggagctgcgccgcgggaacgattattcaatcctgaataccgtctcagagaacctgacctacaaaccagagcgtctgacgatggaaaaaggcgactcggtgttctcgccagatgatcgtatcggtcaactgaccatgcgtaacctggatatcaccgatacccgcgagaaacttttcggttatgccaaaactggcctgctctcctcctctgccgcttcaggggtgccgcaggtggagaatctggaaaataaaggccagtaa

SEQ ID NO: 5504 - protein, 447 aa, Escherichia coli O6
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSAASGVPQVENLENKGQ

SEQ ID NO: 5505 - DNA, 1182 bp, Ehrlichia canis
  CDS (1)..(1182): transl_table=11
atgaaaaaaatagtattagcttactcaggagggttagatacctcagtaatattaaaatggcttcaagaaaactacaattgcgaagtagtagtatttactgcagatttaggccaagatgatgatatgtcagtcattagacaaaaggcaactgcattaaacgtgaaagaaattttcatagaagatttaaaagaagaattcgtaaaagattttgtcttccctatgttcagagcaaatacagtatatgaaggatactacttgcttggaacatccatagcaagaccattaatagctaaacgacaaattgaaatagcaaaacttacaggggcagatacagtagcacacggagcaactggaaaaggaaatgatcaaatcagatttgagtttggatactattgttgtaacccaaatataaaagtaatagcaccttggcgtcagtggaaattaacttcaagaaatagtttaatagaatatgcaaaaaaacatggcattaatgtacctttagataaatctagtgagccaccatattccatagatgcaaatttattacatacttcatatgaaggaaaatctttagaagatccatatgttgaacctgattacacaatactttcaaaatcagtaactccagaattggctagcgataccccagaatacatagaaatttcctttgaaaaaggtgatccatgtgcaataaacaatataccactttcacctgcaaatctattaaagcaactgaatacaataggcggcaagcatggcataggtatcatcgatatagtagagaatagatatgtaggtataaaatcacgaggaatatatgaaactccaggaggcacaatacttttacatgcacatcgtgctatagaaagtataacattagatagagaagcagcacacctcaaagacgagataatgccaaaatatgctaaattaatatacaatggttactggtggaccactgaaaggaaaatgttacaagcactaattgacaggtcacaagagaaagtgaacggggttgtacgtttaaaattatataaaggatctgttatagttgtaggaagaaaatctgaaaatagtttatattcacataatcttgcaagttttgacttgtcagaagattataatcatacagatgcagaagggttcattaagataaattctttaaggctaaggaattgctaa

SEQ ID NO: 5506 - protein, 393 aa, Ehrlichia canis
MKKIVLAYSGGLDTSVILKWLQENYNCEVVVFTADLGQDDDMSVIRQKATALNVKEIFIEDLKEEFVKDFVFPMFRANTVYEGYYLLGTSIARPLIAKRQIEIAKLTGADTVAHGATGKGNDQIRFEFGYYCCNPNIKVIAPWRQWKLTSRNSLIEYAKKHGINVPLDKSSEPPYSIDANLLHTSYEGKSLEDPYVEPDYTILSKSVTPELASDTPEYIEISFEKGDPCAINNIPLSPANLLKQLNTIGGKHGIGIIDIVENRYVGIKSRGIYETPGGTILLHAHRAIESITLDREAAHLKDEIMPKYAKLIYNGYWWTTERKMLQALIDRSQEKVNGVVRLKLYKGSVIVVGRKSENSLYSHNLASFDLSEDYNHTDAEGFIKINSLRLRNC

SEQ ID NO: 5507 - DNA, 1182 bp, Ehrlichia chaffeensis
  CDS (1)..(1182): transl_table=11
atgaaaaaaatagtattagcttattcagggggattagatacctcagttatattaaaatggctccaagaaaattataattgtgaagtagtagtatttactgcagatttaggtcaaaatgatgatatgtctgcaataagacaaaaggcagctgcatcaaatgtaaaagaaatttttatagaagacttaaaagaagaatttgtaaaagatttcgtattccccatgtttagagcaaatactgtatatgaaggatattacttattgggaacatctatagcaaggccattaatagctaaacgacaaattgaaatagctcaccttacaggagcagatgctgtagcacatggagcaactggaaaaggaaatgaccagattagatttgaatttggatattattcatgcgatccaaatataaaggtaatagcaccttggcgtcagtgggaattgacttcaagaaatagtttaatagaatatgcaaaaaagcatggtattgatgttcctttagataaagcaagtgaaccaccatattctatagatgcaaacctattacatacctcatacgaaggcaaatctttagaagatccatatattgaacctgattatacaatgctctccaaatcagtaattccagaattagctagtgatactccagaatatatagaaatttcctttaaaaacggagatccacatgcaataaataatgtacccctttcacctgcaaatctattacaacaattgaatataataggtggtagacatggtataggaattattgacatagtagaaaatcgctatataggcataaaatcaagaggagtatacgaaactcctggaggaacaattcttttacacgcacaccgtgctatagaaagtataactttagacagagaagcagcacaccttaaggatgaaataatgccaagatatgctaaactaatatataatggatattggtggactactgaaagaaagatgttacaagcacttattgataaatcacaagacaaagtaaatggagtagtacgcttaaaattatacaaaggatctgttatggttgtaggacgaacatcagaaaatagcttatattcacataacctagcaagctttgactcatcaggaaattataatcatacagacgcagaaggatttattaaaataaattctctaagattaagaaatagctaa

SEQ ID NO: 5508 - protein, 393 aa, Ehrlichia chaffeensis
MKKIVLAYSGGLDTSVILKWLQENYNCEVVVFTADLGQNDDMSAIRQKAAASNVKEIFIEDLKEEFVKDFVFPMFRANTVYEGYYLLGTSIARPLIAKRQIEIAHLTGADAVAHGATGKGNDQIRFEFGYYSCDPNIKVIAPWRQWELTSRNSLIEYAKKHGIDVPLDKASEPPYSIDANLLHTSYEGKSLEDPYIEPDYTMLSKSVIPELASDTPEYIEISFKNGDPHAINNVPLSPANLLQQLNIIGGRHGIGIIDIVENRYIGIKSRGVYETPGGTILLHAHRAIESITLDREAAHLKDEIMPRYAKLIYNGYWWTTERKMLQALIDKSQDKVNGVVRLKLYKGSVMVVGRTSENSLYSHNLASFDSSGNYNHTDAEGFIKINSLRLRNS

SEQ ID NO: 5509 - DNA, 1185 bp, Ehrlichia ruminantium
  CDS (1)..(1185): transl_table=11
atgaaaaaaatagttctagcttattctggtgggttagatacttctgttatattaaaatggttacaagaaaattataattgtgaagtagtagtatttaccgcagatataggacaagaagacgacatgtctgttattcaaaaaaaagcagctgcgttaaatgtaaaggaaatttttatagaagatttaaaggaagaatttgttagagatttcgtattccctatgtttagagcaaacactatatatgagggatattacctacttggaacatctatagcaagaccattaatagccaaaagacaaattgaaatagctcatcttacaggagcagatgctgtagcacatggtgcaactggaaaaggaaacgaccaagtaagatttgagtttggatattattgttgtgatccaaacataaaagtaattgctccttggcgtcagtgggaattaacatcaagacacagtcttatagaatatgcaagaaaaaataacataaatgttcctttagataaagtaaatgaaccaccatattcaatagatgcaaatttattacatatctcatacgaaggaaagtctcttgaagatccatatgttgaaccagattatactatgctttccagatcattgacaccagagctagcaagtagtattccggaatacatagaaattacctttgaacaaggagatccaatagcaatcaatgacatatcactttcaccagctaatttattacatcaattaaataagattggtggaaaacatggtataggaattgttgacatagtagaaaatcgttacataggaataaaatcaaggggaatatatgaaactcctggaggaacaattcttctacatgcacatcgtgctatagaaagcataacattagatagagaatctgctcatcttaaagatgagattatgccaaaatatgcaaagttaatatataatggttattggtggactactgaaaggaaaatgctacaatcattaatagataaatcacaagaaaaagttaatggaactgtacgcataaagctatataagggatcagttatagttgtaggtcgtaaatctaataatagcttatattcatataatttagcaagctttgatagtgaatctcagggttacgatcacaaagacgcagaaggatttataaaagttaattctttaaggttaaaaaaatcttaa

SEQ ID NO: 5510 - protein, 394 aa, Ehrlichia ruminantium
MKKIVLAYSGGLDTSVILKWLQENYNCEVVVFTADIGQEDDMSVIQKKAAALNVKEIFIEDLKEEFVRDFVFPMFRANTIYEGYYLLGTSIARPLIAKRQIEIAHLTGADAVAHGATGKGNDQVRFEFGYYCCDPNIKVIAPWRQWELTSRHSLIEYARKNNINVPLDKVNEPPYSIDANLLHISYEGKSLEDPYVEPDYTMLSRSLTPELASSIPEYIEITFEQGDPIAINDISLSPANLLHQLNKIGGKHGIGIVDIVENRYIGIKSRGIYETPGGTILLHAHRAIESITLDRESAHLKDEIMPKYAKLIYNGYWWTTERKMLQSLIDKSQEKVNGTVRIKLYKGSVIVVGRKSNNSLYSYNLASFDSESQGYDHKDAEGFIKVNSLRLKKS

SEQ ID NO: 5511 - DNA, 1203 bp, Frankia sp
  CDS (1)..(1203): transl_table=11
gtgaccgaacgcgtcgtgcttgcctactcgggcggcctcgacacgtccgtggccatcggttggatcggcgccgagaccggcgccgacgtcgtcgcgctggcggttgacgtcggccagggcggcgaggacctcgaggccatccggcagcgcgccctcacctgtggcgcggtcgagtcgatcgtcgtcgacgcccgtgaggagttcgccgagtccttcgtcgctccggcgattaagagcaatgcgctctacatggaccggtatccgttgatctcgtccctgtcgcgacccgtcatcgtcaggcatctggtcgccgcggcccgcgagcacggggcggacgccatcgcgcacggctgcaccggcaagggcaacgaccaggtgcgcttcgaggtcggggtggcggcgctcgcccccgggctgagcgtgctcgccccggtgcgcgactcggggatgacccgggacaaggcgatcgccttcgcggaggaacgcggcctgccgatcgacgtgtcgaagaaatcgccgtattccatcgaccagaacctgtggggccgcaccgccgagtgcggcgtcctcgaggacccgtgggcccagccgccggaggatgtcttcgtctactccgcggaccccaccgtcgcgcggatccccgacgaggtgaccatctcgttcatcgacggtgtcccggtggggttggacgggcgctccctcccgctcgccgatctcgtcgccgagctcaacgtccgggcgggcgcccacggcgtgggccggatcgacctgatcgaggaccggctcgtcggcatcaagagccgggagatctacgagtgcccggcggcgatcacgctgctaacggcccaccgggacctcgaggacctcacgcttgagcgggacgtcgcccggttcaagcggggcatcgaccagcggtggggtgagatcgtctacgacggtctgtggtactcgccgctgaagagcgcgttggacgccttcgtcgactccgccagcgccggagtgtccggggaggtgcggatccggctcgtgggtggcgtcgcccaggtcgtcggccggcgcagcccggccagtctgtacgaccacgcactggccacctacgacgccggcgaccagttcgaccagcgcgacgcccgcgggttcatcgagctctggggtctgccgacgaaggtctgggcggcgcgcgagcagcggctgaacccgtga

SEQ ID NO: 5512 - protein, 400 aa, Frankia sp
MTERVVLAYSGGLDTSVAIGWIGAETGADVVALAVDVGQGGEDLEAIRQRALTCGAVESIVVDAREEFAESFVAPAIKSNALYMDRYPLISSLSRPVIVRHLVAAAREHGADAIAHGCTGKGNDQVRFEVGVAALAPGLSVLAPVRDSGMTRDKAIAFAEERGLPIDVSKKSPYSIDQNLWGRTAECGVLEDPWAQPPEDVFVYSADPTVARIPDEVTISFIDGVPVGLDGRSLPLADLVAELNVRAGAHGVGRIDLIEDRLVGIKSREIYECPAAITLLTAHRDLEDLTLERDVARFKRGIDQRWGEIVYDGLWYSPLKSALDAFVDSASAGVSGEVRIRLVGGVAQVVGRRSPASLYDHALATYDAGDQFDQRDARGFIELWGLPTKVWAAREQRLNP

SEQ ID NO: 5513 - DNA, 1221 bp, Geobacillus kaustophilus
  CDS (1)..(1221): transl_table=11
atggcaaatccgaaattggtgctggcatactctggtggtttagatacatcagttgcgatcaagtggcttcaggagcgcggctatgatgtgatcgcgtgctgcttggaccttggcgaagggaaagacctcgatttcgtgaaagaaaaagcgctcaaagtcggcgcgatgaaatcgtacgtgatcgacgtcaaagacgagtttgcgaacgagtatgcactcatcgccttgcaggcgaacgcgttgtacgaagggaaatatccgctcgtttcggcgctgtcgcgtccgctcatcgcgaaaaaactcgttgaaatcgccgagcttgaaggcgcggtggcggtggcccacggctgcacggggaaagggaacgaccaagtgcgctttgaagtgtcgatcaaagcgctcaatccagatttggacgtgatcgccccggtgcgcgagtggagctggtcgcgcgaggaagaaatcgaatacgcgaaaaagcacggcattccaattccggttgaccttgacagcccgttttccatcgaccaaaacttgtggggacgaagcaacgagtgcggcattttggaagacccgtgggcggcgccgccggaagaggcgtatgagctgacggcttcgcttgagaacgcgccggatgtgccggatgtcatcgagatcggctttgaacaaggcgtgccggtgacgttaaacgggaaggcgtatccgcttgcgcaattgattttggagctgaatgcgttggccggcaagcatggcgtcggccgcatcgaccacgtcgaaaaccgccttgtcggcatcaagtcgcgcgaagtgtacgaatgcccaggggcgatcacgctcattaaagcgcataaagagctggaagacttgacattggtgagagaagtcgcccatttcaaaccgatcatcgaacaaaaaatcgccgaagtcatttacaacggcctttggttctcaccgctgaaagacgcgttggtcgcgtttttgaaagaaacgcagaaaaacgtcaccggcgtcgtgcgcgtgaagctgtttaaaggccatgcgatcgtcgaagggcgcaaatcgccgttctcgctctatgatgaaaaattggcaacatacacgtccgaagatgaatttgaccatcaagcggcggtcggattcatttcgctgtacggcctgccgacgaaagtgcacagcatcgtgaacaagcaaaacaaggcgtcagtgccgaccggccaatga

SEQ ID NO: 5514 - protein, 406 aa, Geobacillus kaustophilus
MANPKLVLAYSGGLDTSVAIKWLQERGYDVIACCLDLGEGKDLDFVKEKALKVGAMKSYVIDVKDEFANEYALIALQANALYEGKYPLVSALSRPLIAKKLVEIAELEGAVAVAHGCTGKGNDQVRFEVSIKALNPDLDVIAPVREWSWSREEEIEYAKKHGIPIPVDLDSPFSIDQNLWGRSNECGILEDPWAAPPEEAYELTASLENAPDVPDVIEIGFEQGVPVTLNGKAYPLAQLILELNALAGKHGVGRIDHVENRLVGIKSREVYECPGAITLIKAHKELEDLTLVREVAHFKPIIEQKIAEVIYNGLWFSPLKDALVAFLKETQKNVTGVVRVKLFKGHAIVEGRKSPFSLYDEKLATYTSEDEFDHQAAVGFISLYGLPTKVHSIVNKQNKASVPTGQ

SEQ ID NO: 5515 - DNA, 1221 bp, Geobacter metallireducens
  CDS (1)..(1221): transl_table=11
atggccaaagtgcacaaagacgtgaaaaagatcgtcctcgcctactcgggcgggctcgacacctccatcatcctcaagtggctcaagaacgagtacggctgcgaggtcatagccttctccgccgacctgggccagggcgacgagcttgccccgatccgcgacaaagccttcgctaccggcgccgacaaggtctatatcgacgatctgaaggaagagttcgtcagggacttcgtattccccatgttccgcgccaacgccatctacgagggtcactacctcctgggcacctccatcgcccggccactcatcgccaagcgccagatggagatcgcgaagatcgagggagccgacgccgtatcccatggcgccaccggcaaggggaacgatcaggtccgtttcgagctggcctactaccactttgacccggccatcacggttgtggtcccgtggcgggagtggaagctcaacagccgccaggccctggtgaactacgccaagaaaaacgggattccgatcccggtcaccaagaagcgtccctggtcctcggaccgcaacatgcttcacatctccttcgaagggggtatcctggaggatacctgggccgagccccccgagaacatgtacgtgctcaccaaggcgccggagaaggcccccaacaagccccagttcgtggagatcgagttcaagaacggcaacgccgtggccgttgacggcgagaagatgagcccggcccagcttctggcccacctgaactacatcggcggcgagcacggcatcggccgggtggacctgctggagaaccgttccgtggggatgaagtcacggggcgtgtacgagacccccggcggcaccatcctgcgcgaggcccactcggcggtggagcagatcaccatggaccgcgaagtcatgagaatccgcgactcccttatccccgagtacgcccgccaggtctattccggctactggttctccccggagcgggaaatgctccagaccctgattgacgactcccagaagtgcgtgaacggcgtggcccgggtgaagctctacaaggggcattgccgcaccgtaggccgcaagtccgagaccaactccctcttcaacctggatttcgccaccttcgagaaggatcaggtattcaaccaggccgacgccaccggcttcatcaagatcaactccctgcggctgcggatcagggcgctcatgcaggggaaaaagtag

SEQ ID NO: 5516 - protein, 406 aa, Geobacter metallireducens
MAKVHKDVKKIVLAYSGGLDTSIILKWLKNEYGCEVIAFSADLGQGDELAPIRDKAFATGADKVYIDDLKEEFVRDFVFPMFRANAIYEGHYLLGTSIARPLIAKRQMEIAKIEGADAVSHGATGKGNDQVRFELAYYHFDPAITVVVPWREWKLNSRQALVNYAKKNGIPIPVTKKRPWSSDRNMLHISFEGGILEDTWAEPPENMYVLTKAPEKAPNKPQFVEIEFKNGNAVAVDGEKMSPAQLLAHLNYIGGEHGIGRVDLLENRSVGMKSRGVYETPGGTILREAHSAVEQITMDREVMRIRDSLIPEYARQVYSGYWFSPEREMLQTLIDDSQKCVNGVARVKLYKGHCRTVGRKSETNSLFNLDFATFEKDQVFNQADATGFIKINSLRLRIRALMQGKK

SEQ ID NO: 5517 - DNA, 1221 bp, Geobacter sulfurreducens
  CDS (1)..(1221): transl_table=11
atggccaaagcgcacaaagacgtcaagaagatcgtccttgcctattcgggcggactcgacacatccatcatcctcaagtggctcaagaacgagtacggctgcgaggtcatcgccttctccgccgatctgggccaaggcgacgaactggcgccgatccgcgacaaggccatcgcaaccggcgccgacaaggtctacatcgacgacctgaaggaagaattcgtcaaggacttcgtattccccatgttccgcgccaacgccatttacgaggggcactacctcctgggcacctccatcgcccgccccctcatcgccaagcgtcagatggagatcgcgaagatcgagggtgccgacgccgtttcccacggcgccaccggcaaggggaacgaccaggtccgcttcgagctggcctactaccactttgacccggccatcaccgtggttgccccctggcgcgagtggaagctcaacagccgccaggccctggtgaactacgccaggaagaacgggatcccgatcccggtcaccaagaagcgtccctggtcctcggaccgcaacctcctccacatctccttcgagggcggcatcctggaggatacctgggccgagccccccgagaacatgtacgtgctgaccaaggcgccggaaaaggcccccaacaagccccagttcgtggagatcgaattcaaaaacggcaatgccgtggccgttgacggcgagaagatgagcccggcccagctcctggctcacctgaactacatcggcggcgagcacggtatcggccgggtcgatctcctggagaaccgctccgtgggcatgaagtcccggggcgtgtacgagacccccggcggcaccatcctgcgcgaggcccactcggcggtggagcagatcaccatggaccgcgaggtcatgcggatccgcgactccctcatccccgagtacgcccgccaggtctatgccggctactggttctcgccggagcgggagatgctccagaccctgatcgacgattcccagaagtgcgtgaacggcgtggcccgggtgaaactctacaaggggcactgccgtaccgtggggcgcaagtccgagaccaactctctcttcaacctggacttcgccaccttcgaaaaggatcaggtcttcaaccaggccgacgccaccggcttcatcaagatcaactccctgcggctgcggatcaggtcgctcatgcaggggaagaagtag

SEQ ID NO: 5518 - protein, 406 aa, Geobacter sulfurreducens
MAKAHKDVKKIVLAYSGGLDTSIILKWLKNEYGCEVIAFSADLGQGDELAPIRDKAIATGADKVYIDDLKEEFVKDFVFPMFRANAIYEGHYLLGTSIARPLIAKRQMEIAKIEGADAVSHGATGKGNDQVRFELAYYHFDPAITVVAPWREWKLNSRQALVNYARKNGIPIPVTKKRPWSSDRNLLHISFEGGILEDTWAEPPENMYVLTKAPEKAPNKPQFVEIEFKNGNAVAVDGEKMSPAQLLAHLNYIGGEHGIGRVDLLENRSVGMKSRGVYETPGGTILREAHSAVEQITMDREVMRIRDSLIPEYARQVYAGYWFSPEREMLQTLIDDSQKCVNGVARVKLYKGHCRTVGRKSETNSLFNLDFATFEKDQVFNQADATGFIKINSLRLRIRSLMQGKK

SEQ ID NO: 5519 - DNA, 1197 bp, Gloeobacter violaceus
  CDS (1)..(1197): transl_table=11
atgcgggcgaagaaagtcgtactggcctactcgggcggcgtggacaccagcgtgtgcattccttatctaaagcacgaatggggtgtggagcaggtggtggccctggcggccgatctgggccagggtgaagatctcgaagccgtccgccagaaggccctcgcctccggcgccgaccaggcaatcgtccaggatgcccgcgaagattttgtctacgactacgcctttgcggccctgcaggccaacgccctctacgaggggcgctacccgctcgccaccgccctcgcccggccactcatcgcccggatcctcgtcaagtgcgcccaggcggtaggggccgacgccgtcgcccacggctgcacgggcaagggcaacgaccaggtgcgcttcgacgtgtctatcggcgcgctcgacccgaaactgaaagtgctcgcccccgcccgcgagtggggcatgtcccgcgaggagacgatcgcctatggcgagcgctacggcatccccgccccggtcaagaaaaaatcgccctactcgatcgacttcaacctgctgggccgctccgtcgagtgcggcgtcctcgaagatccctgggcggaaccgcccgaggaggtctacgcgatgaccaaatgcgtggcggacacccccgaccagcccacctacatcgaactggagttcgagcgcggcgtgccggtggctttgaatggagcgtccttgggcggggtgaagctggtgggcgaactcaaccgcctggccggggagaacggcgtcgggcgcatcgacatggtcgaaaatcgcctggtcgggattaaatcgcgcgaaatttacgaatgcccggccggggtggtgctggtcctggcgcaccaggccctcgaagcgctcaccctgccccgggaggtgaccgcctacaagcgcggtgtcgaggacacctacgcccaactggtctacaacggtctgtggtacagtccgctgcgcggcgccctcgacgggttcatcgacttcacccagcaacgggcgagcggtgtggtgcgcgtgcgcctgcacaaaggaaccgccaccgtcgtgggccgcaaaagtccctattcgctctacgacgtggagctggccacctactccgaaggggacagcttcgatcacaaagccgccgagggctttatttatgtctggggcctgcccacgcgcatttatgcgcaggtgcgcaaataa

SEQ ID NO: 5520 - protein, 398 aa, Gloeobacter violaceus
MRAKKVVLAYSGGVDTSVCIPYLKHEWGVEQVVALAADLGQGEDLEAVRQKALASGADQAIVQDAREDFVYDYAFAALQANALYEGRYPLATALARPLIARILVKCAQAVGADAVAHGCTGKGNDQVRFDVSIGALDPKLKVLAPAREWGMSREETIAYGERYGIPAPVKKKSPYSIDFNLLGRSVECGVLEDPWAEPPEEVYAMTKCVADTPDQPTYIELEFERGVPVALNGASLGGVKLVGELNRLAGENGVGRIDMVENRLVGIKSREIYECPAGVVLVLAHQALEALTLPREVTAYKRGVEDTYAQLVYNGLWYSPLRGALDGFIDFTQQRASGVVRVRLHKGTATVVGRKSPYSLYDVELATYSEGDSFDHKAAEGFIYVWGLPTRIYAQVRK

SEQ ID NO: 5521 - DNA, 1233 bp, Gluconobacter oxydans
  CDS (1)..(1233): transl_table=11
atgagcgcccaccaggacgtcaagaaagttgtgctcgcctattctggcggcctggacacttcggtaatcctccgctggctccagaagacctataactgcgaggtcgtcaccttcaccgccgatctcggtcagggcgaagagctcgaacccgcccgcaagaaggccgagatgttcggcgtcaaggagatcttcgtcgaggatctgcgcgaaaccttcgtgaaagatttcgtgttcccgatgttccgggccaacacgctttacgaaggccagtacctgctgggcacgtccatcgcccgtccgctgatcgcacagcgccagatcgagatcgccgaagccgtcggtgccgatgccgtggctcatggcgcgaccggcaagggcaacgatcaggtccgcttcgagctcggctattattcgctcaagccggacgtgaaggtcatcgcaccctggcgcgagtgggatctgacgtcccgcacgaagctcctcgctttcgctgaagagaaccagatcccggtcaccaaggacaagcgcggcgaagcccccttctccgtggatgcgaacctcctgcactcctcttccgagggcaagctgctcgaagatccgtcgatcggcgccgaggaaatcgtcttccagcgcacgatctcgccggaagccgcacccgacgttgcaaccgaaatcaccattgatttcgtcagcggtgacccggttgccatcaacggcgttgagatgacgccggcaaccctgctgacccgtctgaacgaactgggccgtgacaacggtatcggccgtctcgacatcgtggagaaccgcttcgtgggcatgaagtcccgcggcatctacgagacgccgggcggcacgatcctgctggcggcccaccgttcgatcgaaagcatcacgctcgaccgcgaagctgcccatctcaaggacagcatcatgccgcgctatgccgagatcatctataacggcttctggttctcgcctgagcgccggatgcttcaggccctgatcgacaccagccagcattccgtgaccggccgtgtccgcatgcgcctgtacaagggcaatgtgacctgtgtgggtcgtgaaagcccgcacagcctgtatgatacccgcgtcgtgactttcgaggacgacgaaggcgcctataatcagcaggacgcccagggcttcatcaagctcaacgccctgcgcctgcggcttggcggccagatcggccgtcgcggcggtacgctctga

SEQ ID NO: 5522 - protein, 410 aa, Gluconobacter oxydans
MSAHQDVKKVVLAYSGGLDTSVILRWLQKTYNCEVVTFTADLGQGEELEPARKKAEMFGVKEIFVEDLRETFVKDFVFPMFRANTLYEGQYLLGTSIARPLIAQRQIEIAEAVGADAVAHGATGKGNDQVRFELGYYSLKPDVKVIAPWREWDLTSRTKLLAFAEENQIPVTKDKRGEAPFSVDANLLHSSSEGKLLEDPSIGAEEIVFQRTISPEAAPDVATEITIDFVSGDPVAINGVEMTPATLLTRLNELGRDNGIGRLDIVENRFVGMKSRGIYETPGGTILLAAHRSIESITLDREAAHLKDSIMPRYAEIIYNGFWFSPERRMLQALIDTSQHSVTGRVRMRLYKGNVTCVGRESPHSLYDTRVVTFEDDEGAYNQQDAQGFIKLNALRLRLGGQIGRRGGTL

SEQ ID NO: 5523 - DNA, 1335 bp, Haemophilus influenzae
  CDS (1)..(1335): transl_table=11
atgtcaaatactattctacagaatttacctaaaggacaaaaagtagggatcgctttctctggtggtttagacactagtgcagcattactttggatgcgtcaaaaaggcgcagtgccttatgcttacaccgctaatttagggcaacccgatgaagatgattacaacgcaatccctaaaaaagccatggcgtatggtgctgaaaatgctcgcttaattgattgtcgtgctcagcttgctcacgagggaattgccgcaattcaatgtggtgcattccatatttctacaggcggaattccttatttcaacacgactccacttggtcgcgcagtaacaggcacaatgctcgttgcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtacctgtggcattaaatggcaaacattttgataatgctgttgatcttattctagaagccaatcgtattggtgggcgtcatggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacgcttgaacttcgtcgtggtaacgacttcacaattttaaataccgaatcgccaaacttaacctacgaagcagagcgtttaagtatggaaaaagtggaagatgcaccatttgatcctattgatcgtatcggtcaattaacaatgcgtaatttagatgtatcagacacccgaggtaaacttggcatctatgcacaaacaggtttattaagcgcaattaaagattccgtattgccacaattaggcaaaaaataa

SEQ ID NO: 5524 - protein, 444 aa, Haemophilus influenzae
MSNTILQNLPKGQKVGIAFSGGLDTSAALLWMRQKGAVPYAYTANLGQPDEDDYNAIPKKAMAYGAENARLIDCRAQLAHEGIAAIQCGAFHISTGGIPYFNTTPLGRAVTGTMLVAAMKEDDVNIWGDGSTFKGNDIERFYRYGLLTNPNLKIYKPWLDVQFIEELGGRLEMSQFLIENGFDYKMSVEKAYSTDSNMLGATHEAKDLEQLSTGMKIVKPIMGVAFWDEKVEIKPETVTVTFEDGVPVALNGKHFDNAVDLILEANRIGGRHGLGMSDQIENRIIEAKSRGIYEAPGMALLHIAYERLVTGIHNEDTIEQYRINGIRLGRLLYQGRWFDPQALMLRETAQRWVAKAITGTVTLELRRGNDFTILNTESPNLTYEAERLSMEKVEDAPFDPIDRIGQLTMRNLDVSDTRGKLGIYAQTGLLSAIKDSVLPQLGKK

SEQ ID NO: 5525 - DNA, 1263 bp, Haloarcula marismortui
  CDS (1)..(1263): transl_table=11
atgccagaaggaaacggaaccgtcgcgctcgccttctcgggcgggctcgacacgacagtttgcgtatcgctgctgaaagaagagtacggctacgacgaggtcatcggcgttaccgtcgacgttggccagcccgactacgagttcgaggaggccgaggagaccgccgaggcactgggcgtcgaacagcacgtcgtcgacgccaccgaggagttcgcagacctctgtatggaagccgtcaaggctaacgctgactaccagggctacccgctcgggaccgctctcgcgcgcccggtcatcgccaaagccattctctcagtcgccgaagatgagggctgttcggccgtcgcacacggctgtaccggcaagggcaacgaccaactccgcttcgagtccgtctggcgcgactccgacctcgatgtcatcgcaccggtccgcgaactcgggctgacccgcgagtgggagaacgagtacgccgcggagaagggcctgcccgtcgagggcggcgacggcggtcgctactcgatcgacacgaacctctggagccgctccatcgagggatctgaactcgaagacccgagcactattccagccgacgacatctacaagtggacggacaacccctcggacaaggatgccgaactcgtcgaggtcgaatttgaagacggcgttcccgttgccgtcgacggcgaggaactcggcggggtcgaactcatcgaacaactcaacaagcaggcgggtgcccacggtatcggtcgcacggacatgatggaggaccgcatgctcgggctgaaagtccgcgagaactacgagcaccccgccgcgacggtgctgctgacggcccacgaggcgctcgaaggactggtgctcacacaagaagaacgccagttcaaggctcaggtcgatcaggagtggtcccagaaggcctatcagggcctcgtcgatgcgccgctgacgggcgcactcgaagcgttcatcgacgacaccaacgagcgcgtcactggcactgtgacggtgaaactcgaaggcggccactgccgcccggtctcgcgcgagtccgactacgccgtctacagcgagtcggcggcctcgttcaacgaggaggatgtctccggcggtatcacccagcaggacgcgaccggcgtcgcgaagtaccacggcttccagtcccgcctcgcgaacaagattctggacgatgcgaaaaaaggggcagccgtaacggacggcagcggcgaccacgccgcgagcgaggacacggaggagtaa

SEQ ID NO: 5526 - protein, 420 aa, Haloarcula marismortui
MPEGNGTVALAFSGGLDTTVCVSLLKEEYGYDEVIGVTVDVGQPDYEFEEAEETAEALGVEQHVVDATEEFADLCMEAVKANADYQGYPLGTALARPVIAKAILSVAEDEGCSAVAHGCTGKGNDQLRFESVWRDSDLDVIAPVRELGLTREWENEYAAEKGLPVEGGDGGRYSIDTNLWSRSIEGSELEDPSTIPADDIYKWTDNPSDKDAELVEVEFEDGVPVAVDGEELGGVELIEQLNKQAGAHGIGRTDMMEDRMLGLKVRENYEHPAATVLLTAHEALEGLVLTQEERQFKAQVDQEWSQKAYQGLVDAPLTGALEAFIDDTNERVTGTVTVKLEGGHCRPVSRESDYAVYSESAASFNEEDVSGGITQQDATGVAKYHGFQSRLANKILDDAKKGAAVTDGSGDHAASEDTEE

SEQ ID NO: 5527 - DNA, 1191 bp, Halobacterium salinarium
  CDS (1)..(1191): transl_table=11
atgccatcaggaaccgtcgcgctcgccttctcgggcgggctcgacacgacagtctgtgtcccgctgttgaaagaggagtacggctacgacgacgtgatcggcgtcaccgtcgacgtcgggcagcccgacgccgagttcgcggcggcccgggagaccgccgccgcgctgggcgtcgagcaccacgtcgtcgacgccacggccgagttcgccgcgctgtgtttcgacgccgtgcgggccaacgcgacctaccaggggtatccgctcggcaccgcgcttgcccgcccggtcatcgccgacgccatcctgtcggtggccgaagccgagggctgtgcggcgctggcccacggctgcacggggaagggaaacgaccagttgcgcttcgaggcggtgtggcgcgccagcgaccacgacgtgtgtgcgcccgtccgcgagctcgggttgacccgcgagtgggagatcgagtacgccgccgagcgcgacctcccggtggaggcgggcaacgagggcgagtggagcatcgacacgaacctctggagtcgcagcgtggagggcggccacctggaggagcccgactaccagccgcccgcggacatctacgcgtggaccgacgcgccgagcggtgagacgggcaccgtcgacatcaccttcgaggccggggtgccggttgccgtcgacgggacggcgatggagccggtggcgctcatcgaggcgctgaacgaccgcgcggggagctacggcgtcggccgcacggacatgctcgaagaccgcatgctggggttgaaagtccgcgagaactacgagcatccggccgcgaccacgctgctggcggcccacaaggccttggaggggctcgtgttgacgaaggccgagcgggatttcaccgcggcggtgagccagcagtgggcgcaaaaggcctacgagggggtcgtcgagcatccgctgatggacgcgctgaacgggtatctggacgaaacccagtcggcggtcagtggcacggtgaccatcgccttcgagggcgggcgggcgcgcccgatcgcccgcgagagcgagcacgcggtgtactccgcggacgcggcgtcgttcaacaccgagaccgtggcggggatcgagcaggccgacgccacgggggtcgcgaagtaccacggcttccagtcgcggttggcgaacgcggcgttcgacggcaacaaatga

SEQ ID NO: 5528 - protein, 396 aa, Halobacterium salinarium
MPSGTVALAFSGGLDTTVCVPLLKEEYGYDDVIGVTVDVGQPDAEFAAARETAAALGVEHHVVDATAEFAALCFDAVRANATYQGYPLGTALARPVIADAILSVAEAEGCAALAHGCTGKGNDQLRFEAVWRASDHDVCAPVRELGLTREWEIEYAAERDLPVEAGNEGEWSIDTNLWSRSVEGGHLEEPDYQPPADIYAWTDAPSGETGTVDITFEAGVPVAVDGTAMEPVALIEALNDRAGSYGVGRTDMLEDRMLGLKVRENYEHPAATTLLAAHKALEGLVLTKAERDFTAAVSQQWAQKAYEGVVEHPLMDALNGYLDETQSAVSGTVTIAFEGGRARPIARESEHAVYSADAASFNTETVAGIEQADATGVAKYHGFQSRLANAAFDGNK

SEQ ID NO: 5529 - DNA, 1215 bp, Helicobacter hepaticus
  CDS (1)..(1215): transl_table=11
atggcagcgattaaaaaggttgttttggcatatagtggcggacttgatacgagtgtgattttaaaatggctcggagataattatcattgtgaggtggtaacctttacagctgatattggacagggtgaagaggttgagcctgcacgagaaaaggctttaaagcttggtataaaaagtgaaaatatttttattgaagatttaagagaggagtttatcaaagattttgtctttcctatgtttcgtgcaaatacaatttatgagggagaatatttgcttggcacaagcattgcacgccctcttattgcaaaaagacttgttgagattgctaaaagtgttggggctgatgccatagcacacggagcgacaggaaagggaaatgaccaagtgcgatttgagctcggagcctacgcgcttaatccagatattaaagtcattgcgccttggcgtgaatgggatttgaatagtcgtgaaaaactcttagcctatgcagaatctgcagggattgctattgaaaaaaagcaaaataaatcgccttattcaatggacgcaaacttattgcatattagctatgagggacagattctagaagacccaaatgtagaaccagaagaggatatgtggcgatggagtgtttcaccacttaatgcgccagataagccagaatctattagcattgagtttcaaaatggcgatggcgtggcgataaatggagaaaagctaagtcctgcgaatttttgggtaaatctcaatgagctaggcggaaagcacggcattgggcggcttgatttggtagaaaatcgctatgtgggtatgaaatctcgtgggtgttatgaaacacccggaggcacaatatatttaaaagctcatcgtgcgatagaatctttgtgtcttgatagggaagaggcacatttaaaagattctataatgccaaagtatgcagagctcatttataatggctattggtttagcccagagcgcgaggcattacaagcacttattgataagacacagcaaaaagtaagtggagtagtgcgccttaagctctataaagggaatgtcattgttatagggcgagaatctaaaaattctttatttaatgcagcatatagcacttttgaggaagattctgtatataatcaaaaagatgccgcagggtttattaaacttaatgctttacgctttatcatcgcaggaaaggcaaatagggacaaataa

SEQ ID NO: 5530 - protein, 404 aa, Helicobacter hepaticus
MAAIKKVVLAYSGGLDTSVILKWLGDNYHCEVVTFTADIGQGEEVEPAREKALKLGIKSENIFIEDLREEFIKDFVFPMFRANTIYEGEYLLGTSIARPLIAKRLVEIAKSVGADAIAHGATGKGNDQVRFELGAYALNPDIKVIAPWREWDLNSREKLLAYAESAGIAIEKKQNKSPYSMDANLLHISYEGQILEDPNVEPEEDMWRWSVSPLNAPDKPESISIEFQNGDGVAINGEKLSPANFWVNLNELGGKHGIGRLDLVENRYVGMKSRGCYETPGGTIYLKAHRAIESLCLDREEAHLKDSIMPKYAELIYNGYWFSPEREALQALIDKTQQKVSGVVRLKLYKGNVIVIGRESKNSLFNAAYSTFEEDSVYNQKDAAGFIKLNALRFIIAGKANRDK

SEQ ID NO: 5531 - DNA, 1242 bp, Hyphomonas neptunium
  CDS (1)..(1242): transl_table=11
atgtccaacgctgcttccgccccgaaaaaggtcgttctcgcctattccggaggtctcgacacctcgatcatcctcaaatggctgcaggttgagtttggctgtgaggttgtcaccttcaccgccgaccttggccagggcgaggaactggaaccggcccgcaagaaggcgctggccgccggggtgaagccggaaaacatcttcatcgaggatgtgcgcgaggaattcgtgcgcgatttcgtcttcccgatgttccgcgccaacgccgtgtatgaaggcgtctatctgctgggcacctcgattgcccggccgctgatcgccaagcgccagatcgagattgccgacatggtcggcgcggacgcagtctgtcatggcgccaccggcaaggggaatgatcaggtccggtttgagctgggctattatggccttaatccggacatcaaggtgatcgcgccgtggcgcgactgggcgttcaaatcccggaccgaccttttgaagttcgccgaggaacacggcatcgagatcgccaaggacaagcgcggcgaagcgccgttctcggtggacgctaacctgctgcactcttcctccgagggcaaagtgctggaaaacccggccgagcctgcgccggaattcgtgcacatgcgcacggtcagcccggaagatgcgcctgaccaggccgaggtgatcaccatcagctttgaaaaaggcgacgcggtggcgatcaatggcgaggcgatgagcccggcgacgctgctcaccgcgctcaacgcttacggcaagaagcacggcattggccggctcgacttgttggaaaaccgcttcgtcggcatgaagtcgcgcggtatttacgagacgccgggcgggacgatcctgctggtggcccaccggggcatcgagcaggcgacgctcgaccggggcgcggcccaccttaaagacgagctgatgccgaaatatgccgagctgatctataacggcttctggtggagcccggagcgcgagatgctgcaggcggccatcgaccattcgcagcgctgggtgaccggcgatgtgacgatgaagctctacaagggcaacgcctatctgatcggccgttcgtctccctacagtctgtactcggagaagatcgtgaccttcgaggacgaccacggcgcttacgaccagaaggatgcggccggcttcatcaagctcaacgcgctgcgtttgcgccttctggcgggccgcgaccggaagttcggcaagaactga

SEQ ID NO: 5532 - protein, 413 aa, Hyphomonas neptunium
MSNAASAPKKVVLAYSGGLDTSIILKWLQVEFGCEVVTFTADLGQGEELEPARKKALAAGVKPENIFIEDVREEFVRDFVFPMFRANAVYEGVYLLGTSIARPLIAKRQIEIADMVGADAVCHGATGKGNDQVRFELGYYGLNPDIKVIAPWRDWAFKSRTDLLKFAEEHGIEIAKDKRGEAPFSVDANLLHSSSEGKVLENPAEPAPEFVHMRTVSPEDAPDQAEVITISFEKGDAVAINGEAMSPATLLTALNAYGKKHGIGRLDLLENRFVGMKSRGIYETPGGTILLVAHRGIEQATLDRGAAHLKDELMPKYAELIYNGFWWSPEREMLQAAIDHSQRWVTGDVTMKLYKGNAYLIGRSSPYSLYSEKIVTFEDDHGAYDQKDAAGFIKLNALRLRLLAGRDRKFGKN

SEQ ID NO: 5533 - DNA, 1212 bp, Idiomarina loihiensis
  CDS (1)..(1212): transl_table=11
atgagcaatgtaaaaaaagtggtactggcctattctggtggcctggatacctcggcgattgtgccctggttaaaagaaaactatggctgtgaagtggtggcctttgtggccgacgttgggcagggagcagaagagctggaaggcgttgaggaaaaggccaaagcttcaggtgcttctgaatgccatgtggtggacttaaaggacgaattcgttaaaaactatgtgtacccgaccctgaaaaccggcgcaatttatgaaggcacttacttattgggcaccgctatggcgcggccgataattgccaaagctcaggttgaagtggcgcgtaaagtcggtgctgacgcactgtctcacggttgtactggtaaaggtaacgatcaggtgcggtttgagtcttgttatgcggccttagcaccagacttacaagtgattgcgccctggcgggaatgggagttaagcagccgggagtctttgctaggttatctggcggaacgtaatattccctgttcagcttcagcgaccaaaatctacagccgcgacgctaacgcctggcatatttcgcacgaaggtggcgaacttgaagacccctggtgcgagcctaccgagaaggtctggactatgacggcatcgccggagcaggcaccggacaaacccgaatacctttgtgttacggtggaaaacggtgaaattgtggcggtgaataaccaggcgctgtcgccttttgaatgcttgagtgttttaaatgacgttgctgctaagcacggtgttggccgcgtggatattgtggagaaccgtctggtgggaatgaaaagccgcggttgttatgaaaccccgggcggtaccgtgatgatggcagcgttgcaggctattgatgaactggtgctggacaaagtcagtcgtagctggaaaactcagttgagcgagcagtttgcgcaattattgtacgatggtcgctggtttacccctttgcagcaatcggttatggctgcggcacagtcgttatgcgcaacagccagtggagaggtggttctgaagctttataaaggctcggtaaccgcggtacagaaacgttcgccgcacagcttgtacagcgaggattttgctacctttggtgccgatgaggtttacaaccaggcacatgccgaaggctttatccggttgttctctcttccgagccggattgcggcgctgcaaaaacaacaaaagggatag

SEQ ID NO: 5534 - protein, 403 aa, Idiomarina loihiensis
MSNVKKVVLAYSGGLDTSAIVPWLKENYGCEVVAFVADVGQGAEELEGVEEKAKASGASECHVVDLKDEFVKNYVYPTLKTGAIYEGTYLLGTAMARPIIAKAQVEVARKVGADALSHGCTGKGNDQVRFESCYAALAPDLQVIAPWREWELSSRESLLGYLAERNIPCSASATKIYSRDANAWHISHEGGELEDPWCEPTEKVWTMTASPEQAPDKPEYLCVTVENGEIVAVNNQALSPFECLSVLNDVAAKHGVGRVDIVENRLVGMKSRGCYETPGGTVMMAALQAIDELVLDKVSRSWKTQLSEQFAQLLYDGRWFTPLQQSVMAAAQSLCATASGEVVLKLYKGSVTAVQKRSPHSLYSEDFATFGADEVYNQAHAEGFIRLFSLPSRIAALQKQQKG

SEQ ID NO: 5535 - DNA, 1197 bp, Lactococcus lactis subsp
  CDS (1)..(1197): transl_table=11
atgatgggaaacaaaaaaattgtcttggcatattcgggtggattggatacaagtgttgctgtaaaatggttgactgataaaggatttgacgtcattgctgactgcatggacgttggtgaaggaaaagacttgaattttattcatgataaggcgcttcaagtaggggcagtggaatctgttgttttggattgcaaggaagaattcgctaaaatatttgttggagctgcactcaaaggaaatttaatgtatgaaaataaatatcctttagtatccgctttgagtcgccctttgattgctcaaaaattagtagaagtagccaaagaaaaaggggcaacggctattgctcatggttgtacaggaaaaggaaatgaccaagtgcgttttgaagtagccatccattcccttgcgcctgagcttgaagtcattgctccagttcgtgaatggcattgggctcgtgaagaagaaatcgaatatgccaatcaaaatggtgttcctattcctgctgatttagacaatccctactcaattgacatgaatttatggggacgtgcgattgaagctggtgttcttgaaaatccttggaatacttgtccagaggatgctttctttatgactaattctgtagagaacgctccaaacgaagctgaatttatcgaggttgagtttaaagaaggattaccaatcgccttaaatggaaaaagcttagaattgcatgaaatcattaaaaaagtgaatattattgcaggaaaacatggaattggtcggattgaccatattgaaaatcgcctggttgggattaaatcccgtgaattttatgaatgtcctgctgccattactttattaaaagcacataaagatttggaagatttaactttcgttcgagaacttgcacattttaaaccagttcttgaaaatgaattagcaaacttgatttacaatggtttgtggttcaatcctgctactaaggctttgatcgcttatcttgatgaaactcaaaaagtagttaacgggattgtaaaaattaaattatataaaggtttagcaacaccagtgggacgtaaatcaactaattcgctttacagcgaaaaattagcaacatatactgctgcagatgagtttgaccaagcagcggcagttggatttattaaattgtggggtctacctactcaagtcaatgctcaagtaaatctcaaataa

SEQ ID NO: 5536 - protein, 398 aa, Lactococcus lactis subsp
MMGNKKIVLAYSGGLDTSVAVKWLTDKGFDVIADCMDVGEGKDLNFIHDKALQVGAVESVVLDCKEEFAKIFVGAALKGNLMYENKYPLVSALSRPLIAQKLVEVAKEKGATAIAHGCTGKGNDQVRFEVAIHSLAPELEVIAPVREWHWAREEEIEYANQNGVPIPADLDNPYSIDMNLWGRAIEAGVLENPWNTCPEDAFFMTNSVENAPNEAEFIEVEFKEGLPIALNGKSLELHEIIKKVNIIAGKHGIGRIDHIENRLVGIKSREFYECPAAITLLKAHKDLEDLTFVRELAHFKPVLENELANLIYNGLWFNPATKALIAYLDETQKVVNGIVKIKLYKGLATPVGRKSTNSLYSEKLATYTAADEFDQAAAVGFIKLWGLPTQVNAQVNLK

SEQ ID NO: 5537 - DNA, 1236 bp, Lactobacillus plantarum
  CDS (1)..(1236): transl_table=11
atggtcaaacaaaatgataaaattattctcgcttattctggtggtttagatacgtcggtcgcaattagttggttgaaggataagggctatgatgttgtggcctgcggaattgatgttggtgaaggcaaggacatggatgcaatcaaagaaaaggccctaaaattaggggctgtttcatcatatatgattgatgctaagcaagaatttgctgaagaatatgcgttaattgctttacaaggtcataccttgtatgaaggtgaatacccgctggtctcagcactttcacgtcctttaattgctaagaagttagtcacattagccaagcaagagcacgctgttgcaattgcccatggttgtactgggaagggtaatgatcaggttcggtttgaggttgctatccatgctcttgcaccggatatcaagatcgaagcgcctgtacgtgattggcactggtcacgggaagaagaaatcgattacgctaaggaacacaatattcccgtaccaatcaatttggacagcccttactcgattgacgaaaacttatggggccgggccaatgaatgtggcattctagaagatccatggcagggcgcgcctgccgatgcgtttgaccggacgaaggccttagctgatacgccggatacgccaacgactttggaaatcacttttgaagctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagttcgggtacaactcttcaagggtaacgttattactgaggggcggaagtcacccaactcactatatgatacgaacttggcaacctatacatcagcggattcatttgaccaacaagcggcagttggtttcattaagctatggggcctaccaacgcaagttaatgcccaagtccaagcgaaggctcaggccgaagctaagactgataaggcacacgcctaa

SEQ ID NO: 5538 - protein, 411 aa, Lactobacillus plantarum
MVKQNDKIILAYSGGLDTSVAISWLKDKGYDVVACGIDVGEGKDMDAIKEKALKLGAVSSYMIDAKQEFAEEYALIALQGHTLYEGEYPLVSALSRPLIAKKLVTLAKQEHAVAIAHGCTGKGNDQVRFEVAIHALAPDIKIEAPVRDWHWSREEEIDYAKEHNIPVPINLDSPYSIDENLWGRANECGILEDPWQGAPADAFDRTKALADTPDTPTTLEITFEAGVPVALDGESLNLADLIIKLDQIAGEHGIGRIDHIENRLVGIKSREVYEAPAATVLLKAHKDLEDLTFERELAHFKPIIEQKLADTIYNGLWFSPLMEAMVAFLKQTQQVVNGVVRVQLFKGNVITEGRKSPNSLYDTNLATYTSADSFDQQAAVGFIKLWGLPTQVNAQVQAKAQAEAKTDKAHA

SEQ ID NO: 5539 - DNA, 1218 bp, Legionella pneumophila subsp
  CDS (1)..(1218): transl_table=11
atgaaaaaggttattaaaaaaatcgcattagcttattcaggtggcttggatacctccatcatgatcccttggcttaaagagcattatgagcatgctgaagtaatcgctgtgatttgtgatttagggcaacaggaagatctcgatgccataaaaaataaagcgctaaaaagcggtgcttccaaagcgtatgtagtcgatgtgaagaatgagtttgccactcaatatctttggcctttggtaaaatcaggtgctttatatgaagatcaatacattctgggcactatttcaaggccactaattgctcaaaagcttgttgaaattgctttgacggagcaagtaaatgccgttgcacatggagccaccggtaaagggaatgatcaagtgcgttttgaatattcgattaaggcacttgcacctcagcttgaaattattgctccctggagaacttgggatattaaatcaagacaggaagcaattgtgtatgctaaagcgcatggcattgaggtaccagtgactcccaaagcgccttattctagagatcataacatttggtatatttctcatgaaggtggtgtgctcgaagatccttctcaggaaatgccgaatgacgtgttattaatgactgctcctgtatcacagactcctgatgaagaggaagtggttgttcttgatttcaaaaagggggttccagtcgccttaaatggacaagaactttctccagtggatctcttaaattcattaaatcaaaaagcagggcagcatggtattggagtggcggacattgttgaaaatcgattagttggaatgaaaattcgagggatttatgaagcacctgctgctgccgtgctttataaggcacataaactactggagagtttatgtctcactcgttctacgttacatctgaagcaatctttacagcaaacttatgccaatttggtttatgaaggaagatggttttctcaaaccaaacaggctttggatgcattcattgatgtgacgcagcagcatgtcacaggctgtgttaagttaaagttattcaaaggaaacattatccctgccggtatgcattctccctatagcttgcatcatcccgaattggctacttttgaagaggataatgtatacaaccaaaaagatgcggaaggattcattaacctcttttctttatccgctaaaatttatagccaggtacatcagggggggaattatgactaa

SEQ ID NO: 5540 - protein, 405 aa, Legionella pneumophila subsp
MKKVIKKIALAYSGGLDTSIMIPWLKEHYEHAEVIAVICDLGQQEDLDAIKNKALKSGASKAYVVDVKNEFATQYLWPLVKSGALYEDQYILGTISRPLIAQKLVEIALTEQVNAVAHGATGKGNDQVRFEYSIKALAPQLEIIAPWRTWDIKSRQEAIVYAKAHGIEVPVTPKAPYSRDHNIWYISHEGGVLEDPSQEMPNDVLLMTAPVSQTPDEEEVVVLDFKKGVPVALNGQELSPVDLLNSLNQKAGQHGIGVADIVENRLVGMKIRGIYEAPAAAVLYKAHKLLESLCLTRSTLHLKQSLQQTYANLVYEGRWFSQTKQALDAFIDVTQQHVTGCVKLKLFKGNIIPAGMHSPYSLHHPELATFEEDNVYNQKDAEGFINLFSLSAKIYSQVHQGGNYD

SEQ ID NO: 5541 - DNA, 1212 bp, Leptospira interrogans serogroup Icterohaemorrhagiae serovar
  CDS (1)..(1212): transl_table=11
atggcgcaaaacaaacctgttaagaaaatcgttctcgcttattccggtggattggatacgtccgtaattcttacctggttgaaagatacatacggttgcgaagtaatcgcttttactgcggatataggtcaaaaggaagaactttccggactagaagaaaaaggaattaaaacaggagcttctaaggtttatatccaagatttgcgtttagagtttgctagagattttattttcccagccattcaaggaaatgcaatttatgaaatgaggtatcttcttggaacctctttggctcggcctttaattgccaaggcaatggtagaagtggccgaaaaagaaggtgcagacgcatttgcacacggggccactggcaaaggaaatgaccaagttcgctttgaattaggagtcaaatccttagctcctgaaaaaacaatcatcgctccttggagaatctggagttttggcggtagatcagatctaattgaatacgcaaaatccaaaggaattccagttccagtaactgcggaaaaaccgtattcgatggaccgcaatctaatgcatatatcttatgaaggtggaatattagaagatccttataaagaaccagatgagaaaatgtttttattaacaacctctcccgaaaaagctcccgatgctcctgaatatttggaactcgatttcgaagaaggaaattgtgtagcaatcaacggtaagaaaatgaatcctcttgaaatcatggaaacgctcaatacgattgcgggcaaacatggagtgggaagagttgacatcgttgaaaaccgactcgtaggaatcaaatctagaggagtttacgaaactcccggcgggactatattatttttagctcatagagacttagaatcgattacgatcgatcgagacacacaacatcataaagataaactttccatcgaatttgcagaactcatttataacggacattggttttcttccagaatgaaagcagttcgagcttttattacagaaacacaaagatatgttagtggaaccgtaagaataaaactttacaaagggatttgttctgttgtaggaagaaaatcccaagtatctctttacaacccagaaatggcgactttcgaaaaagaagaattatacaatcagaaagacgccgaaggttttataaacatctacggcttacccgctcaagaaacggcaaggcttcgcaaaaaatga

SEQ ID NO: 5542 - protein, 403 aa, Leptospira interrogans serogroup Icterohaemorrhagiae serovar
MAQNKPVKKIVLAYSGGLDTSVILTWLKDTYGCEVIAFTADIGQKEELSGLEEKGIKTGASKVYIQDLRLEFARDFIFPAIQGNAIYEMRYLLGTSLARPLIAKAMVEVAEKEGADAFAHGATGKGNDQVRFELGVKSLAPEKTIIAPWRIWSFGGRSDLIEYAKSKGIPVPVTAEKPYSMDRNLMHISYEGGILEDPYKEPDEKMFLLTTSPEKAPDAPEYLELDFEEGNCVAINGKKMNPLEIMETLNTIAGKHGVGRVDIVENRLVGIKSRGVYETPGGTILFLAHRDLESITIDRDTQHHKDKLSIEFAELIYNGHWFSSRMKAVRAFITETQRYVSGTVRIKLYKGICSVVGRKSQVSLYNPEMATFEKEELYNQKDAEGFINIYGLPAQETARLRKK

SEQ ID NO: 5543 - DNA, 1212 bp, Leptospira interrogans
  CDS (1)..(1212): transl_table=11
atggcgcaaaacaaacctgttaagaaaatcgttctcgcttattccggtggattggatacgtccgtaattcttacctggttgaaagatacatacggttgcgaagtaatcgcttttactgcggatataggtcaaaaggaagaactttccggactagaagaaaaaggaattaaaacaggagcttctaaggtttatatccaagatttgcgtttagagtttgctagagattttattttcccagccattcaaggaaatgcaatttatgaaatgaggtatcttcttggaacctctttggctcggcctttaattgccaaggcaatggtagaagtggccgaaaaagaaggtgcagacgcatttgcacacggggccactggcaaaggaaatgaccaagttcgctttgaattaggagtcaaatccttagctcctgaaaaaacaatcatcgctccttggagaatctggagttttggcggtagatcagatctaattgaatacgcaaaatccaaaggaattccagttccagtaactgcggaaaaaccgtattcgatggaccgcaatctaatgcatatatcttatgaaggtggaatattagaagatccttataaagaaccagatgagaaaatgtttttattaacaacctctcccgaaaaagctcccgatgctcctgaatatttggaactcgatttcgaagaaggaaattgtgtagcaatcaacggtaagaaaatgaatcctcttgaaatcatggaaacgctcaatacgattgcgggcaaacatggagtgggaagagttgacatcgttgaaaaccgactcgtaggaatcaaatctagaggagtttacgaaactcccggcgggactatattatttttagctcatagagacttagaatcgattacgatcgatcgagacacacaacatcataaagataaactttccatcgaatttgcagaactcatttataacggacattggttttcttccagaatgaaagcagttcgagcttttattacagaaacacaaagatatgttagtggaaccgtaagaataaaactttacaaaggggtttgttctgttgtaggaagaaaatcccaagtatctctttacaacccagaaatggcgactttcgaaaaagaagaattatacaatcagaaagacgccgaaggttttataaacatctacggcttacccgctcaagaaacggcaaggcttcgcaaaaaatga

SEQ ID NO: 5544 - protein, 403 aa, Leptospira interrogans
MAQNKPVKKIVLAYSGGLDTSVILTWLKDTYGCEVIAFTADIGQKEELSGLEEKGIKTGASKVYIQDLRLEFARDFIFPAIQGNAIYEMRYLLGTSLARPLIAKAMVEVAEKEGADAFAHGATGKGNDQVRFELGVKSLAPEKTIIAPWRIWSFGGRSDLIEYAKSKGIPVPVTAEKPYSMDRNLMHISYEGGILEDPYKEPDEKMFLLTTSPEKAPDAPEYLELDFEEGNCVAINGKKMNPLEIMETLNTIAGKHGVGRVDIVENRLVGIKSRGVYETPGGTILFLAHRDLESITIDRDTQHHKDKLSIEFAELIYNGHWFSSRMKAVRAFITETQRYVSGTVRIKLYKGVCSVVGRKSQVSLYNPEMATFEKEELYNQKDAEGFINIYGLPAQETARLRKK

SEQ ID NO: 5545 - DNA, 1215 bp, Listeria innocua
  CDS (1)..(1215): transl_table=11
atgacgaaagaaaaaatcgtattagcttactctggtgggttagatacttctgttgcaattcagtggctagtggaatcaggttatgaagttatcgcatgttgtttagacgttggtgaagggaaaaatttggattttattaaagaaaaagcgattactgtcggtgcaagtgcatcttatacaattgatgccaaggaagaatttgccgaaaactttgctttaatcgcccttcaagctcatgcttattatgaaggaaaatatccacttatttctgctttaagtcgtcctttaatcgcgaaaaaattagtagaagtagctcgtcaagaaggtgcctctgctatcgctcatggttgtactggtaaaggaaatgaccaagttcggtttgaagtagcgatccacgcccttgctcctgatttaaaagtcgtttcccctgtccgggactggaaatggtctagagaagaagaaatcaattacgccaaagaacataacatccccgttccaattgatttagataatcctttctcgattgaccaaaacctttggggtagaagtaacgaatgtggtgtgcttgaaaacccatggacaacgccaccagaagcggcttacgacttaacagttagcttagaagatgcacctgacacggcggatattgtcgaaattacatttgatgccggtattcctatttctcttaatggcgaaaatatgagcctagcaaatttaattcttactttaaacgaaattgctggaaaacatggcgttggtagaattgaccatatcgaaaatcgtttagttggtattaaatcacgtgaagtatacgaatgtcccgccgcagtcactttgattactgcacataaagaattagaagatttaacttttgttcgtgaagtggcacatttcaaacctattattgaacaaaaaatcagcgaaacaatttacaatggcttatggttttcgcctttaacagaagcattaattgccttcttaaaatccacgcaaaaattcgtgaacggtacgattcgcgtaaaactatttaaaggtcatgccatcgtcgaaggaagaaaatcaccgaattcgctttatgatgaaaacttagcgacttatacttcttccgatacattcgaccaagatgcagctgttggtttcatcaagctatttggactaccaacgaaagtgagcgcagaagtcaattcaaaagttacaataacaactgaggtgtaa

SEQ ID NO: 5546 - protein, 404 aa, Listeria innocua
MTKEKIVLAYSGGLDTSVAIQWLVESGYEVIACCLDVGEGKNLDFIKEKAITVGASASYTIDAKEEFAENFALIALQAHAYYEGKYPLISALSRPLIAKKLVEVARQEGASAIAHGCTGKGNDQVRFEVAIHALAPDLKVVSPVRDWKWSREEEINYAKEHNIPVPIDLDNPFSIDQNLWGRSNECGVLENPWTTPPEAAYDLTVSLEDAPDTADIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALIAFLKSTQKFVNGTIRVKLFKGHAIVEGRKSPNSLYDENLATYTSSDTFDQDAAVGFIKLFGLPTKVSAEVNSKVTITTEV

SEQ ID NO: 5547 - DNA, 1215 bp, Listeria monocytogenes serotype 4b
  CDS (1)..(1215): transl_table=11
atggcgaaagaaaaaatcgtattagcttactcaggtgggttagatacttctgtggcaattcagtggttagtagaatcaggttatgaagttattgcatgttgcttagatgttggtgaaggcaaaaatttggattttattaaagaaaaagccattactgttggagcaagtgaatcctacacgattgatgcaaaagaagaattcgcggaggattttgcgttaattgccctgcaagcccacgcatattatgaaggaaaatatccgcttatttccgctttaagtcgtccgttaattgcgaaaaaattagtagaagtagctcgtcaagaaggtgcctctgctatcgctcatggttgtactggtaaaggaaatgaccaagttcggtttgaagtagcgattcatgcacttgctcctgatttaaaagttgtttcccctgtccgtgattggaaatggtctagagaagaagaaatcaattacgccaaagaacataacatccctgttccaattgatttagataatcctttctcgattgaccaaaacctttggggtagaagtaacgaatgtggggtgcttgaaaacccatggacaacaccaccagaagcagcttacgacttaacagtgagtttagaagacgcaccagatacgccagatattgttgaaattacgtttgatgccggtattccaatttctctaaatggagaaaatatgagcctagcaaatttaatccttactttaaatgaaattgctggaaaacatggtgtcggtagaatcgatcatatcgaaaatcgtttagttggcattaaatcacgtgaagtatatgaatgtccggccgcagtcactttgattactgcacataaagaattagaagatttaacttttgttcgtgaagtggcacatttcaaacctattatcgaacaaaaaatcagcgaaacaatttacaatggcctatggttctcacctttgacagaagcattagttgctttcttaaaatccacgcaaaaattcgtgaacggaacgattcgtgtaaaactgtttaaaggccatgccattgtggaaggaagaaaatcaccaaattcgctttatgatgaaaacctagcgacttacacgtcttccgatacattcgaccaagatgcagcagttggtttcatcaagctttggggattaccaacgaaagtaagcgcagaagttaattcaaaagtgacaataacaactgaggtgtaa

SEQ ID NO: 5548 - protein, 404 aa, Listeria monocytogenes serotype 4b
MAKEKIVLAYSGGLDTSVAIQWLVESGYEVIACCLDVGEGKNLDFIKEKAITVGASESYTIDAKEEFAEDFALIALQAHAYYEGKYPLISALSRPLIAKKLVEVARQEGASAIAHGCTGKGNDQVRFEVAIHALAPDLKVVSPVRDWKWSREEEINYAKEHNIPVPIDLDNPFSIDQNLWGRSNECGVLENPWTTPPEAAYDLTVSLEDAPDTPDIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALVAFLKSTQKFVNGTIRVKLFKGHAIVEGRKSPNSLYDENLATYTSSDTFDQDAAVGFIKLWGLPTKVSAEVNSKVTITTEV

SEQ ID NO: 5549 - DNA, 1215 bp, Listeria monocytogenes
  CDS (1)..(1215): transl_table=11
atggcgaaagaaaaaatcgtattagcttactcaggtgggttagatacttctgtggcaattcagtggttagtagaatcaggttatgaagttattgcatgttgcttggatgttggtgaaggcaaaaatttagattttattaaagaaaaagccattactgtcggagcaagtgaatcctacacgattgatgcgaaagaagaatttgccgaggattttgcgttaattgctcttcaagcccatgcttattatgaaggaaaatatccacttatttcagctttaagccgtccgttaattgcgaaaaaattagtagaagtcgctcgtcaagaaggcgcttctgctatcgctcatggttgtactggtaaaggaaatgaccaagttcggtttgaagtagcgattcatgcacttgctcctgatttaaaagtcgtttctcctgtccgtgattggaaatggtctagagaagaagaaatcaattacgccaaagaacatgacatccctgtcccaattgatctagataatcccttctcgattgaccaaaacttgtggggtagaagtaatgaatgtggtgtgcttgaaaacccatggacaacaccgccagaggcagcttacgacttaacagtgagtttagaagatgcaccagacacagcagatattgttgaaatcacctttgatgctggtattcctatttctcttaatggagaaaatatgagcctagctaatttaattcttactttaaatgaaattgctggaaaacatggtgttggtagaattgatcatatcgaaaatcgtttagttggtattaaatcacgtgaagtatacgaatgtccggccgcagtcactttgattacagcacataaggaattagaagatttaacctttgttcgtgaagtggcacatttcaaacctatcatcgaacaaaaaatcagtgaaacaatttacaatggcctatggttctctcctttaacagaagcattagttgccttcttaaaatctacacaaaaattcgtgaacggcaccatccgcgtcaaattatttaaaggtcatgccattgtagagggaagaaaatcgccaaattcactttatgatgaaaacttagcaacttacacgtcttccgatacatttgaccaagatgcagcagttggtttcatcaagctttggggattaccaacaaaagtgaacgcagaagttaattcaaaagtgacaataacaaccgaggtgtaa

SEQ ID NO: 5550 - protein, 404 aa, Listeria monocytogenes
MAKEKIVLAYSGGLDTSVAIQWLVESGYEVIACCLDVGEGKNLDFIKEKAITVGASESYTIDAKEEFAEDFALIALQAHAYYEGKYPLISALSRPLIAKKLVEVARQEGASAIAHGCTGKGNDQVRFEVAIHALAPDLKVVSPVRDWKWSREEEINYAKEHDIPVPIDLDNPFSIDQNLWGRSNECGVLENPWTTPPEAAYDLTVSLEDAPDTADIVEITFDAGIPISLNGENMSLANLILTLNEIAGKHGVGRIDHIENRLVGIKSREVYECPAAVTLITAHKELEDLTFVREVAHFKPIIEQKISETIYNGLWFSPLTEALVAFLKSTQKFVNGTIRVKLFKGHAIVEGRKSPNSLYDENLATYTSSDTFDQDAAVGFIKLWGLPTKVNAEVNSKVTITTEV

SEQ ID NO: 5551 - DNA, 1185 bp, Methanosarcina acetivorans
  CDS (1)..(1185): transl_table=11
atggtaaagaaagttgcacttgcatattccggtgggcttgacacctctgtgtgcatccccatcctcaaggaaaagtacgggtacgatgaagtaattacaatttcagtagacgtcggccagcccgaagaagagatcaaaaaagctgatgcaaaagccgagaagatcagcaacaaacactacacgatcgatgcaaaggaagagttcgtaaaagactacatcttccccctgatcaaagccaacggagactacgaaggctatgtcatgggcacatcggtagcccgcccgctgattgccaaaaaagtggtggaagctgccattaaagaaggcgcagtcgcccttgcccacggctgtaccggaaaaggcaacgaccagctccgcttcgaagccgtcttccgccagaccgacatggacgtaatcgcccccatgcgggagatgaacctgacccgcgagtgggaaatcgactacgcaaaagagcacggaatcccggtagaagttacaaaagccaagccctggagcgttgacgaaaatatctggagccgcagcatcgaaggcggaaagcttgaagacccctcctttgtcccgccggaagagatcttcgagtggaccaaatccgcagaagatgccccgaacgagcccaggatcgttgacatcgactttgaagccggagtccctgtagccctcgacggcgaaaagctcggcggttacgcccttgtcaggaagctgaacgaaattgcaggcgagaacggcgtcggcaggacagatatgatcgaagaccgtgtccttggcttaaaagcccgcgagaactacgagcacccggctgcaaccgtcctcctcgcagcccacgccgacctcgagaaactcgtcctgacccgcggggaactgaagttcaagaagatcgtcgacgaacagtggtccgaacttgcctattacgggcttgttgacgagccgctttatgccgacctcaacgcctttatcgacaagtcccaggaaagggtcacgggtacagtgaaagtgaagctctacaaaggcgcacttactatccttgcccgcagctcgccaaatgcactttattctgaggatctggtttcttttgacagccagaccattgaccagaaggatgcggaagggtttgcgaagtatcacgggttccaggcgaggatgtacaggaaagtaatggagaaataa

SEQ ID NO: 5552 - protein, 394 aa, Methanosarcina acetivorans
MVKKVALAYSGGLDTSVCIPILKEKYGYDEVITISVDVGQPEEEIKKADAKAEKISNKHYTIDAKEEFVKDYIFPLIKANGDYEGYVMGTSVARPLIAKKVVEAAIKEGAVALAHGCTGKGNDQLRFEAVFRQTDMDVIAPMREMNLTREWEIDYAKEHGIPVEVTKAKPWSVDENIWSRSIEGGKLEDPSFVPPEEIFEWTKSAEDAPNEPRIVDIDFEAGVPVALDGEKLGGYALVRKLNEIAGENGVGRTDMIEDRVLGLKARENYEHPAATVLLAAHADLEKLVLTRGELKFKKIVDEQWSELAYYGLVDEPLYADLNAFIDKSQERVTGTVKVKLYKGALTILARSSPNALYSEDLVSFDSQTIDQKDAEGFAKYHGFQARMYRKVMEK

SEQ ID NO: 5553 - DNA, 1191 bp, Methanosarcina barkeri
  CDS (1)..(1191): transl_table=11
atggcaaagaaagttgcacttgcatattcaggagggcttgacacctcggtgtgcatccctatccttaaggaaaagtacggatacgacgaagtagttacgatttcagtcgatgtaggccagcctgaagaggaaatcaagcgggcagacgcaaaagcagagaagatcagcaacaagcattatacgatcgatgcaaaggaagagttcgttaaagattacgtcttcccactgatcaaagccaacggaagttacgaaggctatgtaatgggaacttcaattgcccgcccgttgatcgcgaaaaaagtggtcgaggctgccaggaaagaaggagcagtagcccttgcccacggctgcacaggaaaaggcaatgaccagctccgtttcgaggccgttttccgccagaccgacatggatgttattgccccgatgcgggagatgaacctgacccgcgagtgggaaatcgactacgcaaaagagcacggaatcccggtggaagtcacaaagtccaagccctggagcgttgacgaaaacatctggagccgcagtatcgaaggcggcaggcttgaagacccttcgtttgtcccgccggaagagatcttcgagtggacaacctcgcctgaaaaagcccctgaacagcccagggttgttgacatcggctttgaagcaggtgttccggtttcccttgacggcgaaaaaatgagcggctacgcctttgtgaagaaaatgaatgaaattgcaggcgaaaacggcgttggtcgaactgatatgattgaagaccgcgtgctcggcttaaaagcccgcgagaactacgaacacccggctgcaaccgttcttcggcagcccaacagccgacctttgagaaactcgtccttgacccgcagcgaactcaagttcaagaagatcgtggacgaccagtggtctgaacttgcctattacgggcttgtggacgagccgctttatgccgatctgaacgcctttatcgacaagtcccaggaaagagttacaggtatagtgaaagtcaggctctacaaaggcgccctcacgatccttgcccgcagctcaccgaatgccctctattctgaagacctggtttcgtttgacagccagaccattgaccagaagggctcagaagggtttgcgaagtatcacgggttccaggccaggatgtacaggaaggtaatggataagcagtaa

SEQ ID NO: 5554 - protein, 396 aa, Methanosarcina barkeri
MAKKVALAYSGGLDTSVCIPILKEKYGYDEVVTISVDVGQPEEEIKRADAKAEKISNKHYTIDAKEEFVKDYVFPLIKANGSYEGYVMGTSIARPLIAKKVVEAARKEGAVALAHGCTGKGNDQLRFEAVFRQTDMDVIAPMREMNLTREWEIDYAKEHGIPVEVTKSKPWSVDENIWSRSIEGGRLEDPSFVPPEEIFEWTTSPEKAPEQPRVVDIGFEAGVPVSLDGEKMSGYAFVKKMNEIAGENGVGRTDMIEDRVLGLKARENYEHPAATVLRQPNSRPLRNSSLTRSELKFKKIVDDQWSELAYYGLVDEPLYADLNAFIDKSQERVTGIVKVRLYKGALTILARSSPNALYSEDLVSFDSQTIDQKGSEGFAKYHGFQARMYRKVMDKQ

SEQ ID NO: 5555 - DNA, 1188 bp, Methanosarcina barkeri
  CDS (1)..(1188): transl_table=11
atggcaaagaaagttgcacttgcatattcaggagggcttgacacctcagtgtgcatccctatccttaaggaaaagtacggatacgacgaagtagttacgatttcagtcgatgtcggccagcctgaagaggaaatcaagcgggcagacgcaaaagccgagaagatcagcaacaagcattatacgatcgatgcaaaggaagagttcgttaaagattacgtcttccccctgatcaaagccaacggaagctacgaaggctatgtaatgggaacctcaattgcccgcccgttgatcgcaaaaaaagtggtcgaggctgccaggaaagaaggagcagtagcccttgcgcacggctgcacaggaaaaggcaatgaccagctccgtttcgaggccgttttccgccagaccgacatggatgttatcgccccaatgcgggaaatgaacctgacccgcgagtgggaaatcgactatgcaaaagagcacggaatcccggtggaagtcacaaagtccaagccctggagcgttgacgaaaacatctggagccgcagcatcgaaggcggcaggcttgaagacccctcttttgtcccgccggaagagatcttcgagtggacaacctcgcctgaaaaaacccctgaacagcccaggattgttgacatcggttttgaagctggagtcccggtttcccttgacggcgaaaaaatgagcggctacgcccttgtgaagaaaatgaatgaaatcgcaggcgaaaacggcgttggcagaaccgatatgattgaagaccgcgtgctcggcttaaaagctcgcgagaactatgaacacccggctgcaaccgttcttctggcagcacacgccgacctcgagaaactcgtcctgacccgcagcgaactcaagttcaagaagatcgtggacgaccagtggtccgaacttgcctattacgggcttgtggacgagccgctttatgccgacctgaacgcttttatcgacaagtcccaggaaagggttacaggtacagtgaaagtcaggctctacaaaggcgccctcacaatcctttcccgcagctcgccgaatgctctctattctgaagacctggtttcgtttgacagccagaccattgaccagaaggactcagaagggtttgcgaagtatcacgggttccaggcgaggatgtacaggaaggttatggataagcagtaa

SEQ ID NO: 5556 - protein, 395 aa, Methanosarcina barkeri
MAKKVALAYSGGLDTSVCIPILKEKYGYDEVVTISVDVGQPEEEIKRADAKAEKISNKHYTIDAKEEFVKDYVFPLIKANGSYEGYVMGTSIARPLIAKKVVEAARKEGAVALAHGCTGKGNDQLRFEAVFRQTDMDVIAPMREMNLTREWEIDYAKEHGIPVEVTKSKPWSVDENIWSRSIEGGRLEDPSFVPPEEIFEWTTSPEKTPEQPRIVDIGFEAGVPVSLDGEKMSGYALVKKMNEIAGENGVGRTDMIEDRVLGLKARENYEHPAATVLLAAHADLEKLVLTRSELKFKKIVDDQWSELAYYGLVDEPLYADLNAFIDKSQERVTGTVKVRLYKGALTILSRSSPNALYSEDLVSFDSQTIDQKDSEGFAKYHGFQARMYRKVMDKQ

SEQ ID NO: 5557 - DNA, 1185 bp, Methanococcoides burtonii
  CDS (1)..(1185): transl_table=11
atgtcaaagaaagtagcacttgcgtattccggaggacttgacacatctatctgtatccctctcctcaaggaagaatacggatacgatgaagtaattacagtagcagtcgatgtgggacagccaaaggaagatgtcgcacaggcagaagagaaagcaaagaagatcagtgacaagcatttcacgcttgatgttcgcgaagagttcgtgaacgactatatcttcccgcttataagagccaacggcgactacgaaggctatgtaatgggcacatccattgcacgcccgctcatcgccaagaaggtagttgagatagcagagcaggaaggcgcagttgcactcgcacacggttgcaccggcaaaggcaacgaccaacttcgtttcgaggcagtgttcaggctcaccgacatggatgtcatcgcacctatgagagagatgaacctcacccgtgaatgggagatcgaatacgctaaagaacatggcatacctgtgggagtcaccactgcaaagccatggagcgttgatgagaacatctggagcagaagcatcgaaggcggaaagctcgaagaccctggatatatccctcctgaagagatatacaaatggacaacagctccggaagatgcacctgacgctcagatcatcgagatcggattcgagaacggtgtgccggtatcccttgatggtcagaagatgggcggtgtcgaacttatcgagaagatgaacatcattgcaggaacacatggcgtaggtcgtaccgacatgatcgaggaccgtgtcctcggactcaaggcacgtgagaactacgaacatcctgcagcaacagttctgcttgcggcacacaaagacctcgaaaagctcgtgcttacccgtgcagagctcaagttcaaggcaacggtcgacgcccagtggtctgagcttgcatactacggcctcgtggatgaacccctctacgatgacctcaatgctttcattgacaagacacaggaacgtgtcgcaggtacagtaacaatgaagctctacaaaggtagcgtcctcgttcttgcaaggacatccccgtatgccctttactcagaagagctcgtatcctttgatggcacaagcatcgaccagaaggatgctgaagggtttgccaaatatcacggattccaggcacgcctgtacagaaaattcgtagttaagaactaa

SEQ ID NO: 5558 - protein, 394 aa, Methanococcoides burtonii
MSKKVALAYSGGLDTSICIPLLKEEYGYDEVITVAVDVGQPKEDVAQAEEKAKKISDKHFTLDVREEFVNDYIFPLIRANGDYEGYVMGTSIARPLIAKKVVEIAEQEGAVALAHGCTGKGNDQLRFEAVFRLTDMDVIAPMREMNLTREWEIEYAKEHGIPVGVTTAKPWSVDENIWSRSIEGGKLEDPGYIPPEEIYKWTTAPEDAPDAQIIEIGFENGVPVSLDGQKMGGVELIEKMNIIAGTHGVGRTDMIEDRVLGLKARENYEHPAATVLLAAHKDLEKLVLTRAELKFKATVDAQWSELAYYGLVDEPLYDDLNAFIDKTQERVAGTVTMKLYKGSVLVLARTSPYALYSEELVSFDGTSIDQKDAEGFAKYHGFQARLYRKFVVKN

SEQ ID NO: 5559 - DNA, 1227 bp, Methylococcus capsulatus
  CDS (1)..(1227): transl_table=11
atgtcaagctcaaacgtcaagaaagtcgctctggcctactccggcggcctcgacacctcggtcattttgaagtggctgcaagaaacctatggctgtgaagtcgtgaccttcaccgccgatctcggccagggcgaggaagtcgagcctgcccgcgccaaagcccaggccatgggcgtcaaggaaatctacatcgacgacctacgcgaggagttctcccgtgacttcgtcttccccatgttccgcgccaatgccatctatgaaggcgaatatctgctgggcacctccatcgcccgcccgctgatcgccaaacgcctgatcgagatcgccaacgaaaccggcgccgatgccatcgcccacggcgccaccggcaagggcaacgaccaggtgcgcttcgaactgggcgcctatgccctgcggccggacattcgcgtcatcgccccctggcgggagtgggaactgacctcgcgcgaaaccctgctggcctatgccgaaagccggggcatcccaatcgaaatgaagcgcggcaaaacctcgccctattccatggatgccaatctgctgcacatctcctacgaaggcggcatcctggaagacccttgggccgagccggaggaaaccatgtggcgctggtccgtctcgcccgaaaacgctccggaccggccgacctatgtcgagttgacctacgaacacggtgacatcgtcgccatcgatggcgaacggatgacagccgcggcggttctggcccgcctgaatcagttgggcggcgccaacggcatcggccggctcgacattgtggaaaaccgttacgtcggaatgaaatcacgcggctgctacgagacccccggcggtaccatcatgctgaaggcgcaccgcgccatcgagtccatcacgctggaccgggaggtcgcccatctcaaggatgagctgatgccacgctacgccagcctgatctacaacggctattggtggagcccggaacgccggatgctgcagcagatgatcgatgcctcccaggcaacggtgaacggtgtagtgcgggtgaagctgtataaaggcaacgtcagcgtcgtcggccgcaagtcggagtccaacagcctgttcgacatgaacatcgccaccttcgaggacgaccgtggcgcctatgaccagaaggacgcggaaggcttcatcaagctcaacgcgttgcgcctgcgcatcgccggccggaaaggcgcgagcttcgcataa

SEQ ID NO: 5560 - protein, 408 aa, Methylococcus capsulatus
MSSSNVKKVALAYSGGLDTSVILKWLQETYGCEVVTFTADLGQGEEVEPARAKAQAMGVKEIYIDDLREEFSRDFVFPMFRANAIYEGEYLLGTSIARPLIAKRLIEIANETGADAIAHGATGKGNDQVRFELGAYALRPDIRVIAPWREWELTSRETLLAYAESRGIPIEMKRGKTSPYSMDANLLHISYEGGILEDPWAEPEETMWRWSVSPENAPDRPTYVELTYEHGDIVAIDGERMTAAAVLARLNQLGGANGIGRLDIVENRYVGMKSRGCYETPGGTIMLKAHRAIESITLDREVAHLKDELMPRYASLIYNGYWWSPERRMLQQMIDASQATVNGVVRVKLYKGNVSVVGRKSESNSLFDMNIATFEDDRGAYDQKDAEGFIKLNALRLRIAGRKGASFA

SEQ ID NO: 5561 - DNA, 1221 bp, Methylobacillus flagellatus
  CDS (1)..(1221): transl_table=11
atgagtgatgtgaacaaagtcgtgctggcctattccggcggcctggatacctctgtgatcctgaagtggctgcaggatacctaccagtgtgaagtggtgacctttacagcagatatcggccaaggtgaggagctcgaacctgcgcgcgaaaaagccaggcaatttggcgtcaaggaaatctatattgatgacctacgcgaagaatttgtgcgcgacttcgtattcccgatgttccgcgccaataccgtctatgaaggcgaatacctgctcggcacttcgattgcgcgaccactgatcgccaagcgcctgatcgagatcgcccaggaaaccaatgccgatgcggtctcgcatggggctactggcaagggcaatgaccaggtgcgcttcgagctgggagcctatgcgctcaaccccaacatcaagatcattgcgccttggcgcgaatgggacttgctcagccgtgaaaagctcctggcttatgccgagaagcatggcatcccggtcgaaatgaagcatcgtcaaggcggtagcccttacagtatggatgccaaccttctgcatatctcctacgaaggtcgtcacttagagaacccggcggcggaagccgaggaggatatgtggcgttggacggtatcgccagagcgcgcgccagatgaagccgagtaccttgagattgaatatcgcaacggtgaccccatctcattgaatgggaagacactgaaaccacatgaactgcttgcggaactgaaccgcctgggcggcaagcatggcattggtcgtctcgacctggtggaaaaccgctatgtaggcatgaagtcgcgcggctgttacgagaccccgggcggcaccatcctgctcaaggcgcaccgcgcgatcgagtccatcaccctggatcgcgaagtggcccacctgaaggacgacctgatgccgcgctatgcaagcatgatctacaacggttactggtggagccctgaacgcctggccttgcaggcattgatcgaccatacgcagcagaccgtcaatggctgggtcaagctcaagctgtacaagggcaatgtgatcgtgacgggccgtgattcagggacagattcgctgtttgacccgaatatcgcgaccttcgaggacgatgccggtgcctatgatcaccgcgatgcgggtgggttcatcaagctgaatgccttgcgcctgcgtattgcagctaatctgcgcaacaaaaaataa

SEQ ID NO: 5562 - protein, 406 aa, Methylobacillus flagellatus
MSDVNKVVLAYSGGLDTSVILKWLQDTYQCEVVTFTADIGQGEELEPAREKARQFGVKEIYIDDLREEFVRDFVFPMFRANTVYEGEYLLGTSIARPLIAKRLIEIAQETNADAVSHGATGKGNDQVRFELGAYALNPNIKIIAPWREWDLLSREKLLAYAEKHGIPVEMKHRQGGSPYSMDANLLHISYEGRHLENPAAEAEEDMWRWTVSPERAPDEAEYLEIEYRNGDPISLNGKTLKPHELLAELNRLGGKHGIGRLDLVENRYVGMKSRGCYETPGGTILLKAHRAIESITLDREVAHLKDDLMPRYASMIYNGYWWSPERLALQALIDHTQQTVNGWVKLKLYKGNVIVTGRDSGTDSLFDPNIATFEDDAGAYDHRDAGGFIKLNALRLRIAANLRNKK

SEQ ID NO: 5563 - DNA, 1188 bp, Methanococcus jannaschii
  CDS (1)..(1188): transl_table=11
atggagagaatagctgtcttagcgtattctggaggattggatacaagctgttgcttaaaattattggaagataagtatggttataaggtagtttctgtctgtgtggatgttggacagccagaagaagagataaaagaagttgaagagaaagctaaaaaattaggagttttaaagcactacacaatagatgcaaaggaagaattcgttaaagattacatatttagagctataaaggcaaatgcaatgtatgaaggctatcccctatcaacagcattagcgagacctttaattgctcataaggttgttgaaatagctgaggaagttggagctgaggcagttgctcatggatgcactggaaagggtaacgaccagttcagatttgaaacaactataagaattaaagctccacatttgaaaattattgcaccaattagggacttaaacctaacaagggctgaagaaattgagtatgctaaagaaaaaggaatcccaatcccaacggaaagtaaaaaatacagtatagatgaaaacttatggggaagaagtattgaaggtagtgagttagaaaaccctgactttgttccaccagaagagatatatgcatggactaaaaacccagttgaagataaagaggaagagattgttgagattgagtttaaggagggcgttccagtagctataaatggagaaaaattagaaccagttgagttaataaagaaagctaatgagattgctggaaagcatggtgttggaagaatagatattattgaggatagaatcataggattaaaatcaagagaaaactatgaatgtcctggagctgttttgttattaactgctcataaagctttagagcagttagttttaacaagggatgagcttagatttaaagagatcgttgatagtttatacggagagttaatttataaaggactttggtttgatccattaagggaggatttagatgcttttatagacaaaactcaagagagagttactggaactgtgaaagttaagttatttggaggaactgcaagagttgttggtagagatagtccttacgctttatacagtaaggaattagtttcatttgatgagaaggagattgaccagaaagaattggctggaatggttaagtatcatggattacaggcaatgttatatgagatgaggaaaaagagaaaataa

SEQ ID NO: 5564 - protein, 395 aa, Methanococcus jannaschii
MERIAVLAYSGGLDTSCCLKLLEDKYGYKVVSVCVDVGQPEEEIKEVEEKAKKLGVLKHYTIDAKEEFVKDYIFRAIKANAMYEGYPLSTALARPLIAHKVVEIAEEVGAEAVAHGCTGKGNDQFRFETTIRIKAPHLKIIAPIRDLNLTRAEEIEYAKEKGIPIPTESKKYSIDENLWGRSIEGSELENPDFVPPEEIYAWTKNPVEDKEEEIVEIEFKEGVPVAINGEKLEPVELIKKANEIAGKHGVGRIDIIEDRIIGLKSRENYECPGAVLLLTAHKALEQLVLTRDELRFKEIVDSLYGELIYKGLWFDPLREDLDAFIDKTQERVTGTVKVKLFGGTARVVGRDSPYALYSKELVSFDEKEIDQKELAGMVKYHGLQAMLYEMRKKRK

SEQ ID NO: 5565 - DNA, 1185 bp, Methanopyrus kandleri
  CDS (1)..(1185): transl_table=11
atgtcgcgggtggttctcgcgtattcaggaggcttggatacctcggtttgcatcgagctcctgcgggagcggtacgggtacgacgaggtgatcacggtgaccgcggacgtgggtcagccggaggaggagctgcgggaggcggaggagaaggcacggaagctcgcggatgagcacttcacggtcgactgtgtggacgagttcgtgtgtgagtactgctggcgagccgtgaaggcgaacgcgacgtacgaggggtaccctctgagcacggcgctggcccgaccgctgatcgcgcagaaggtcctggaagtggcgcgtgatgtggacgcggacgcggtcgcacacgggtgcacggggaagggcaacgaccagttccggttcgagtcgtatttgcgggcgcacggcggtgaggagttcgagatcgtggctccggttcgggacctgaacctcacgcgcgacgaggagatcgcgtacgccgaggagcggggtatccccgtcccggtggacgtcgacagtccctacagcgtggacgagaacctatggggtcgatcgatcgagggcggcgtcctggaggacccctccgaggaaccgccggaggaggtcttcgagtggaccgtcagtcccgcggaggccccggacgagcccgaggtcgtggagatcgagttcgaggacggcgtgcccgtggaggtggacgggcgggacgacccggtcgagatcgtccggtacctgaacgagaccgcgggcgagcacggcgtgggtcgcatcgatatcatcgaggaccgggtgatcgggctgaagtcacgcgaggtgtacgaggcaccggcggcggtgacgctgctcgaggcgcaccgggcgctggaggcgttcaccctgacacgccgggagctgtcgctgaaggcctcgctggaggaggagtgggcgcgactcgtctacgacgggctgtggttcaaccccctgcgcgagcacctggaggccttcttcgactcgacgcagcggcacgtggaggggaccgtgcgcgtgaagctgttcaagggctccgcgaccgtgatctcacgggagtccccgcgagcgctctacgaggaggagttgatatcgtacgaagaaaagcagttcgatcagcggacggccgaaggagccgtgaagcttcacggactccaggaacggttggctttaaggcgtcgtgggtga

SEQ ID NO: 5566 - protein, 394 aa, Methanopyrus kandleri
MSRVVLAYSGGLDTSVCIELLRERYGYDEVITVTADVGQPEEELREAEEKARKLADEHFTVDCVDEFVCEYCWRAVKANATYEGYPLSTALARPLIAQKVLEVARDVDADAVAHGCTGKGNDQFRFESYLRAHGGEEFEIVAPVRDLNLTRDEEIAYAEERGIPVPVDVDSPYSVDENLWGRSIEGGVLEDPSEEPPEEVFEWTVSPAEAPDEPEVVEIEFEDGVPVEVDGRDDPVEIVRYLNETAGEHGVGRIDIIEDRVIGLKSREVYEAPAAVTLLEAHRALEAFTLTRRELSLKASLEEEWARLVYDGLWFNPLREHLEAFFDSTQRHVEGTVRVKLFKGSATVISRESPRALYEEELISYEEKQFDQRTAEGAVKLHGLQERLALRRRG

SEQ ID NO: 5567 - DNA, 1194 bp, Methanococcus maripaludis
  CDS (1)..(1194): transl_table=11
atgcaagaaaaaattgcagttttggcatattctggagggcttgacacgagctgctgtttaaaattactcgaagacaaatacgactacaaggtaatttcagtagctgtagatgtaggccagcctgaagacgatttaaaagaaccagaagaaaaagcaaaaaaattcggtgtattaaaacactatactatcgatgcaaaggaagaattcgcaaaagattacatatttagggctattaaagcaaatgcgctttacgaaggatacccattatcaaccgctcttgcaagacctttaattgctataaaaattgcagaacttgcacaagaagttggagcaagcgcaatttcacacggatgtactggaaaaggaaacgaccagttcagatttgaatctgtaatgagagcaaaaacacctgaaattgaaattgtagcgccaatcagagatttaaaccttacaagaactgaagaaatagcatatgcaaaagaaaaaggaattccagttccagtagacttagaaaaaccattcagtatcgatgaaaatttatggggaagaagtattgagggcggaattttagaagacccaatgactgaaactccaaaagaatgttttgcatggactgttgacccaacagatgcacaggacaaagaagaatacgtagaaattgacttcgaagaaggggttcctgtagcaatcaacggggatgcattggaagcagtttcattaataagaaaagtaaacgaaattgcaggaagaaatggcgttggaagagtagatattgtagaagatagagttttaggcttaaaatcaagagaaaactatgaatgccctggtgcaatgcttttaataactgcacacaaagctctcgaacagctcgttttaaccagagaagaactcgtattcaaagaaatggttgattcaaaatacgcagatttagtatacaaaggactctggcacgaaccattaagactcgatttagatgcgttcattgataaaacgcaaacaagaatgaacggaaaagtagttttaaaactctacaaaggttcaatgagaatcgctggaagagaaagtaaagatgcaatctacaacgaagaaatggtttcatttgaaaacaaagaaatggaccagagagaaattgtcggaatggttaaattccacggtctccaagcagcaatctatgaaggattaacaagaaaataa

SEQ ID NO: 5568 - protein, 397 aa, Methanococcus maripaludis
MQEKIAVLAYSGGLDTSCCLKLLEDKYDYKVISVAVDVGQPEDDLKEPEEKAKKFGVLKHYTIDAKEEFAKDYIFRAIKANALYEGYPLSTALARPLIAIKIAELAQEVGASAISHGCTGKGNDQFRFESVMRAKTPEIEIVAPIRDLNLTRTEEIAYAKEKGIPVPVDLEKPFSIDENLWGRSIEGGILEDPMTETPKECFAWTVDPTDAQDKEEYVEIDFEEGVPVAINGDALEAVSLIRKVNEIAGRNGVGRVDIVEDRVLGLKSRENYECPGAMLLITAHKALEQLVLTREELVFKEMVDSKYADLVYKGLWHEPLRLDLDAFIDKTQTRMNGKVVLKLYKGSMRIAGRESKDAIYNEEMVSFENKEMDQREIVGMVKFHGLQAAIYEGLTRK

SEQ ID NO: 5569 - DNA, 1200 bp, Methanobacterium thermoautotrophicum
  CDS (1)..(1200): transl_table=11
ttgaaggtgattgctgtggataaagtggttcttgctttcagtggaggccttgacacatcagtatgtatcaaactcctcgaggaaaagtataacatggaggtaataacggcctgtgtggatgttggtcagccgcgggatgaaattgaaagaccggccatggttgccaaggaactcggaaactacagacactacacagtagatgcaaggcgggagttcgcagaggactacatatttccagccataaaggccaatgcggtttacgagggttaccccctcagcaccgcccttgcaaggcccttgatagctaaaaagatagttgaagtggccgagaaggagggtgcatctgccatagcccatggatgcaccggtaagggtaacgaccagttccgtttcgaggccgttataaggtcaacgacggacctggatgtcatcgcccccataagggacctcaacctcacaaggacagaggagatggagtacgccaggtcctgtgggataccgctcccctcagacaagctctacagtatcgatgagaacctctggggacgtgcaatagagggggacatccttgaagaccccatggttgagccccctgaggatgcctttgaatggacaaagcccatccacgagacccctgaggatcctgaggtcattgaaatcggtttccacggcggggtcccggttgcattgaatggtgaggaactggagccagttgaactcataggccttgcaaatgaggtggcaggaaaacacggtatcggtagggttgacataatggaggaccgtataataggtatgaaaagccgcgaaatctatgagacacctgcagccttcctgctcctggaggcccacaggggcctggagcagctcacactcacaaggagtgagctcaggtttgctgacataataagcagcacctatgctgaactggtgtacagtgggctgtggcatgaccccctccgtgaggaccttgacatggcagtaaaccacatgcagaggcgtgtcaccggtacagtcagggttaaactccacaggggcagcatgcgcgtcattggaagggagtcaccctacagcctgtacagtgaggagatagtttcatttgaggataaaaccctcgatcagagggagatggccgggatggtcaaaaactatgccctccaggctgcgatatacagcagggtgtgcaggaaggagaactga

SEQ ID NO: 5570 - protein, 399 aa, Methanobacterium thermoautotrophicum
MKVIAVDKVVLAFSGGLDTSVCIKLLEEKYNMEVITACVDVGQPRDEIERPAMVAKELGNYRHYTVDARREFAEDYIFPAIKANAVYEGYPLSTALARPLIAKKIVEVAEKEGASAIAHGCTGKGNDQFRFEAVIRSTTDLDVIAPIRDLNLTRTEEMEYARSCGIPLPSDKLYSIDENLWGRAIEGDILEDPMVEPPEDAFEWTKPIHETPEDPEVIEIGFHGGVPVALNGEELEPVELIGLANEVAGKHGIGRVDIMEDRIIGMKSREIYETPAAFLLLEAHRGLEQLTLTRSELRFADIISSTYAELVYSGLWHDPLREDLDMAVNHMQRRVTGTVRVKLHRGSMRVIGRESPYSLYSEEIVSFEDKTLDQREMAGMVKNYALQAAIYSRVCRKEN

SEQ ID NO: 5571 - DNA, 1194 bp, Methanococcus vannielii
  CDS (1)..(1194): transl_table=11
atgcaggaaaaaattgcagttttagcatactctggagggcttgatacaagctgctgcttaaaattacttgaagataagtataattataaagtagtttctgttgcagtcgatgtagggcagcctgaggacgacttaaaagaacctgaagaaaaggcaaagaaacttggtgttttaaagcattatactattgatgcaaaggaagaatttgcagttgactatatttttagggcaataaaggcaaatgcgctttatgaaggttaccccttatcaacggctcttgcaagaccgctgattgctataaaaattgcagaacttgcaaaagaaattggggcggatgcaatttcacacggctgtactggaaaaggaaatgaccaatttagatttgagtccgtaataagaacaaaagcacctgaaattgaaataattgccccggtaagggatttaaaccttacaagaacagaagaaatccaatatgcaaaagaaaaaggaattccaattccagttgatttagaaaaaccatttagtatcgatgaaaacttatggggtagaagtattgaaggcggaattttagaaaacccaatgattgaaactccaaaagagtgttttgcatggactgttgacccgaaaatagcaaaagatgaagaagagtacgtagaaattgaatttaaggcaggggttccagttgcaataaacgggcaaaaatttgatgctattaatgtaataaaagaagcaaataaacttgctgggagaaacggcgttggtagggtagatattatagaagatagggttttaggccttaaatcaagagaaaattatgaatgccccggtgcaattttattaataactgcacataaggcacttgagcaactcgttttatcaagagaagaattagtatttaaagaaatggtggattcaaagtatgcagacttaatttacaaaggactatggcacgaacctttaagacatgatttagatgcatttgtagacaaaacgcaagaaagaatgaatggaatagttcgggcaaaactttacaaaggttctttaagaattgttggaagggaaagcgaatgtgcactttatcaagaaaacatggtttcattcgagaataaggacatggatcagagagaaatcgtaggaatggttaaattccacggacttcaagctgcaatttttgaaagtcttaggaataaataa

SEQ ID NO: 5572 - protein, 397 aa, Methanococcus vannielii
MQEKIAVLAYSGGLDTSCCLKLLEDKYNYKVVSVAVDVGQPEDDLKEPEEKAKKLGVLKHYTIDAKEEFAVDYIFRAIKANALYEGYPLSTALARPLIAIKIAELAKEIGADAISHGCTGKGNDQFRFESVIRTKAPEIEIIAPVRDLNLTRTEEIQYAKEKGIPIPVDLEKPFSIDENLWGRSIEGGILENPMIETPKECFAWTVDPKIAKDEEEYVEIEFKAGVPVAINGQKFDAINVIKEANKLAGRNGVGRVDIIEDRVLGLKSRENYECPGAILLITAHKALEQLVLSREELVFKEMVDSKYADLIYKGLWHEPLRHDLDAFVDKTQERMNGIVRAKLYKGSLRIVGRESECALYQENMVSFENKDMDQREIVGMVKFHGLQAAIFESLRNK

SEQ ID NO: 5573 - DNA, 1227 bp, Moorella thermoacetica
  CDS (1)..(1227): transl_table=11
atgaaaggagtctttactgtggccgaaaaggtagttctcgcctattccggcgggctggatacctccattattatcccctggctcaaggaaacctatggttatgaggttatcgccgtggccgtcgatgtcggccagggagaagagctggaacccctggaggaaaaggctataaagagcggggccagcaagatctatattctggataaaaagaaggagtttgtggaggagtacatctggcccaccctcaaggccggcgctgtttacgagggcaagtacctcctgggcacctccttcgcccggcccctcattgccaaatgcctggtggaggtcgccgcacaggaaggggccacggccgtggcccacggagccaccggcaagggcaacgaccaggtgcgtttcgaactgggggttaaggccttaaatccccagctaaaggtcatcgctccctggcggatctggaacatccgctcccgggaagaggccatggactacgccgccgcccggggcatcccggtgccggtgactaaagaccggccctacagcatggaccgtaacctctggcacttgagccacgagggaggcgatctcgaggatccctggaatgcacccggggacgacctttacctgataatcaccccgccggaacaggccccggataaaccgacttatgtaaccatcgactttgaaaagggtattccggtagccgtggacggggaaaaactggacgccgtcgccctggtggagaagctcaatgacctggcggcggccaacggtgtgggcatagttgacattgtagaaaatcgcctggttggtatgaagtcccggggcgtttatgaaacccccggggggacgatcctctatacagcccaccgggaactggagtacctcaccctggaccgcatgaccatgcatttcaaagaaatggtggccgccaagtacgccgagctggtttacgacggcaactggttctcacccttgaaaaaagccctggacgcctttgtggacagcacccaggagacggtgacgggcacggtgcgtctaaaactctataaaggcagctgcaccccggccggggtcaaatcaccttattccatctacaacgaggacctggtcaccttcggtgccggcggtgactacgaccataaggacgccaccggtttcatcaacctcttcggcctgcccttgaaggtacgggcgctgatggaacaaaaaactggactgagatag

SEQ ID NO: 5574 - protein, 408 aa, Moorella thermoacetica
MKGVFTVAEKVVLAYSGGLDTSIIIPWLKETYGYEVIAVAVDVGQGEELEPLEEKAIKSGASKIYILDKKKEFVEEYIWPTLKAGAVYEGKYLLGTSFARPLIAKCLVEVAAQEGATAVAHGATGKGNDQVRFELGVKALNPQLKVIAPWRIWNIRSREEAMDYAAARGIPVPVTKDRPYSMDRNLWHLSHEGGDLEDPWNAPGDDLYLIITPPEQAPDKPTYVTIDFEKGIPVAVDGEKLDAVALVEKLNDLAAANGVGIVDIVENRLVGMKSRGVYETPGGTILYTAHRELEYLTLDRMTMHFKEMVAAKYAELVYDGNWFSPLKKALDAFVDSTQETVTGTVRLKLYKGSCTPAGVKSPYSIYNEDLVTFGAGGDYDHKDATGFINLFGLPLKVRALMEQKTGLR

SEQ ID NO: 5575 - DNA, 1215 bp, Moritella abyssi
  CDS (1)..(1215): transl_table=11
atgacacaaacagttaagaaagtagtagtagcgtattctggtggtttagatacttcagtgattttaccttggttacaagagaactatgacaattgtgagattgtcgcgttgtttgttgccgatgtaggtcagggcgctgaagaacttgaaggcattgaagcgaaagcattagcttcaggtgcatctgagtgttacgtggttgatctaaaagatgaactcgtagaaaactatatctaccctacgcttaaaaccggtgctgtctatgaaggtacgtatcttttaggtacgtcaatggcacgtcaatccattgccaaagcacaagttgaaattgcccgcaaagtcggcgctgatgcactttgtcatggttgtaccggtaaaggtaatgatcaaattcgttttgaatcatgctttgcagcactagcaccagagctaacggttattgcaccttggcgtatttgggacttaaccagccgtgaatcactgcttgaatacttagctgaacgtgatattccaaccgccgcatctggcactaagatttatagccgtgatgccaatgcttggcacatctctcatgaaggtggcgagttagaagacccatggaaccaaccttctaagcaagtttggaccatgacggttgatccaattgacgcaccgaatgaacctgaatttttgactatatctgttgttaaaggtgagatcactgcggtgaacggtgaggaaatgtaccttataatacgctatacgtatcttaatgaaaaagcagctgcacatggtgttggccgtgttgatatcgttgaaaaccgtttagtcggtatgaaatcacgtggttgttatgaaacaccgggtggtacggttatggttgaagcattacgtggtatcgaagagttagtattagataaaatcacacgtaaatggaagcatactgttgccgctgaattctcacatcttgtctatgatggtcgttggttcacaccgctatgtgcttcattacttgctgctgcaggtacattagcagaagaaatgaacggtgaagtgatcgttaaaatgtataaaggctcagtacaggcagtacagaagcaatcaccaaacagcctttatagtgaagagtttgccacatttggtgatgataatgtgtatgatgaccaaagccatgcggaaggtttcatccgcttatattcgttgtctagtcgtattaaagctttagctagcaagtaa

SEQ ID NO: 5576 - protein, 404 aa, Moritella abyssi
MTQTVKKVVVAYSGGLDTSVILPWLQENYDNCEIVALFVADVGQGAEELEGIEAKALASGASECYVVDLKDELVENYIYPTLKTGAVYEGTYLLGTSMARQSIAKAQVEIARKVGADALCHGCTGKGNDQIRFESCFAALAPELTVIAPWRIWDLTSRESLLEYLAERDIPTAASGTKIYSRDANAWHISHEGGELEDPWNQPSKQVWTMTVDPIDAPNEPEFLTISVVKGEITAVNGEEMYLIIRYTYLNEKAAAHGVGRVDIVENRLVGMKSRGCYETPGGTVMVEALRGIEELVLDKITRKWKHTVAAEFSHLVYDGRWFTPLCASLLAAAGTLAEEMNGEVIVKMYKGSVQAVQKQSPNSLYSEEFATFGDDNVYDDQSHAEGFIRLYSLSSRIKALASK

SEQ ID NO: 5577 - DNA, 1215 bp, Moritella profunda
  CDS (1)..(1215): transl_table=11
atgaaaatgacacaaacagttaagaaagtagtagtagcgtattctggtggtttagatacttcagtgatcttaccttggttacaagagaactatgacaattgtgagattgtcgcgtttgttgccgatgtcggtcagggcgctgaagaacttgaaggcattgaagcgaaagcattggcttcaggtgcatctgagtgttacgtggttgatctaaaagatgagctcgtagaaaactatatttatccaacgcttaaaaccggtgctgtctatgaaggtacgtaccttttaggtacgtcaatggcacgtccaatcattgccaaagcacaagttgaaattgcccgtaaagtcggcgctgatgcactttgtcatggttgtaccggtaaaggtaatgatcaaattcgttttgaatcatgctttgcagcccttgctccagagctaacggttattgcaccttggcgtatttgggacttaaccagccgtgaatcactgcttgaatacttagctgaacgtgacattccaaccgccgcatctgcgactaagatttatagccgtgatgccaatgcttggcacatttctcatgaaggcggcgagttagaagacccatggaaccaaccttctaagcaagtttggaccatgacggttgatccaattgatgcaccgaatgaacctgaatttttgactatatctgttgttaaaggtgagatcactgcggttaacggcgaagcaatgtcgccttataatacgcttatgtatctaaatgaaaaagccgctgcccatggtgttggtcgtgttgatatcgtggaaaaccgtttggtaggtatgaaatcacgtggttgttatgaaacaccaggtggtacggtaatggttgaagcgttacgtggtatcgaagaattagtattagataaaaccacacgtaaatggaaacaaactgttgccgctgaattctctcatcttgtttatgatggccgttggttcacgccactatgtgcatcattacttgctgctgcaggtacattagcagaagagatgaacggcgaagttatcgttaagatgtacaaaggttcagtacaagcaatacagaagaaatcgccaaacagcctttatagtgaagagtttgccacatttggtgatgataatgtttatgaccaaagccatgcggaaggtttcatccgcttatattcgttgtctagccgtattaaagctttagctagcaagtag

SEQ ID NO: 5578 - protein, 404 aa, Moritella profunda
MKMTQTVKKVVVAYSGGLDTSVILPWLQENYDNCEIVAFVADVGQGAEELEGIEAKALASGASECYVVDLKDELVENYIYPTLKTGAVYEGTYLLGTSMARPIIAKAQVEIARKVGADALCHGCTGKGNDQIRFESCFAALAPELTVIAPWRIWDLTSRESLLEYLAERDIPTAASATKIYSRDANAWHISHEGGELEDPWNQPSKQVWTMTVDPIDAPNEPEFLTISVVKGEITAVNGEAMSPYNTLMYLNEKAAAHGVGRVDIVENRLVGMKSRGCYETPGGTVMVEALRGIEELVLDKTTRKWKQTVAAEFSHLVYDGRWFTPLCASLLAAAGTLAEEMNGEVIVKMYKGSVQAIQKKSPNSLYSEEFATFGDDNVYDQSHAEGFIRLYSLSSRIKALASK

SEQ ID NO: 5579 - DNA, 1197 bp, Mycobacterium bovis
  CDS (1)..(1197): transl_table=11
atgtcagagcgcgtcatcctggcctattccggcggtctggacacctcggtggcgatcagctggataggcaaggagaccggccgtgaggtggtggcggtggcgatcgacctcgggcagggcggcgagcacatggacgtcatacggcagcgggcgctggactgcggcgcggtggaggctgtcgtcgtcgacgcccgcgacgagttcgccgaaggctactgcctgcccaccgtgctgaacaacgcgctgtacatggaccgctacccgctggtgtcggcgatcagccggccgctgatcgtcaaacacctggtcgccgcggcgcgcgagcacggcggcggcatcgtcgcgcacggctgcaccggcaagggcaacgaccaggtccggttcgaagtcgggttcgcctcgctggcaccggatttagaggtgttggcgccggtgcgcgactacgcgtggacgcgggagaaggcgatcgcgttcgccgaggagaacgcgatcccgatcaacgtcaccaaacgttcgccgttctccatcgaccagaacgtctggggccgcgcggtggagaccggcttcttagagcacctgtggaatgccccaaccaaggacatctacgcctacaccgaagaccccacgatcaactggggggtccccgacgaggtgatcgtcggcttcgaacgcggcgtgccggtgtccgtcgacggcaagccggtgtcgatgctggcggcgatcgaggagctcaaccgccgcgccggagcgcaaggtgtcgggcgcctcgacgtcgtggaggatcggctggtgggcatcaagagccgcgagatctacgaggcgcccggcgcgatggtgctgatcaccgcgcacaccgaactcgaacacgtcaccctggagcgtgagctgggccggttcaaacgccagaccgaccagcgctgggccgaactggtctacgacgggctgtggtactcgccgctgaaggccgcgctggaggctttcgtcgccaagacccaggagcacgtgtccggcgaggtgcggctggtgctacacggcggccacatcgcggtcaacggccggcgcagcgcggaatcgttgtacgacttcaacctggccacctacgacgagggcgacagcttcgaccagtccgccgcccgcggcttcgtctacgtgcacgggctgtcctccaagctcgccgcccgccgggatctgcggtga

SEQ ID NO: 5580 - protein, 398 aa, Mycobacterium bovis
MSERVILAYSGGLDTSVAISWIGKETGREVVAVAIDLGQGGEHMDVIRQRALDCGAVEAVVVDARDEFAEGYCLPTVLNNALYMDRYPLVSAISRPLIVKHLVAAAREHGGGIVAHGCTGKGNDQVRFEVGFASLAPDLEVLAPVRDYAWTREKAIAFAEENAIPINVTKRSPFSIDQNVWGRAVETGFLEHLWNAPTKDIYAYTEDPTINWGVPDEVIVGFERGVPVSVDGKPVSMLAAIEELNRRAGAQGVGRLDVVEDRLVGIKSREIYEAPGAMVLITAHTELEHVTLERELGRFKRQTDQRWAELVYDGLWYSPLKAALEAFVAKTQEHVSGEVRLVLHGGHIAVNGRRSAESLYDFNLATYDEGDSFDQSAARGFVYVHGLSSKLAARRDLR

SEQ ID NO: 5581 - DNA, 1200 bp, Mycobacterium leprae
  CDS (1)..(1200): transl_table=11
ttgatgccggaacgtattatcctggcgtattcgggggggctggatacctcggtggcgatcaactggatcggcaaggaaactagccatgaggtcgtggcagtggtgattgatctcggccagggcggcgaggacatggaggtcgtacgtcaacgggcgttggactgcggagctgttgaggctatcgttgtcgatgcccgtgacgagttcgctgaaggctattgcttgcccaccgttttgaacaacgcgctgtatatggatcggtacccgttggtgtccgcgatcagcaggccgctgatcgtcaagcacctggtcgcggccgcacgtgcgcacggcggcagcatcgtcgcgcacggttgtaccggcaagggtaacgaccaggtccgattcgaagtcggattcgcttcgctggcaccggatctcgaaatattggcgccggtgcgcgactacgcatggacacgagagaaggcgatcgctttcgccgaagagaacgccatccccatcaatgtcaccaaacgttcgccgttctcgattgaccagaatgtttggggccgcgcagtggaaaccggtttcctggaacacttgtggcacgcacctactaaagaggtttattcctacactgacgaccccaccatcaattggaacacgcccgatgaggtgatcgtcggttttgagcacggagttccggtgtcgattgacggtagtccggtgtccatgctgggcgccatcgaggcactcaaccgacgcgctggcgcgcaaggcgtcgggcgtctcgacgttgtcgaagaccggctggtaggcatcaagagccgcgagatttacgaggcacccggagcaatggtgctcatcaccgcgcacgccgaactcgagcacgtcacgctggagcgtgagttgggacgcttcaagcgtcagaccgatcgacgctgggccgaattggtgtatgacggattgtggtattcgccgctgaagaccgcactggagagttttgtcgccgctacgcaacaacacgttaccggtgaagttcgaatggtgttacatggaggccatattgcggtgaatgggcggcgcagcgccgaatccctatacgatttcaatttggccacctacgacgaaggggataccttcgatcaatccgctgctcgcggcttcgtctacgtgtacgggttaccgtcgaagctcgcggcacgtagggacttacggtga

SEQ ID NO: 5582 - protein, 399 aa, Mycobacterium leprae
MMPERIILAYSGGLDTSVAINWIGKETSHEVVAVVIDLGQGGEDMEVVRQRALDCGAVEAIVVDARDEFAEGYCLPTVLNNALYMDRYPLVSAISRPLIVKHLVAAARAHGGSIVAHGCTGKGNDQVRFEVGFASLAPDLEILAPVRDYAWTREKAIAFAEENAIPINVTKRSPFSIDQNVWGRAVETGFLEHLWHAPTKEVYSYTDDPTINWNTPDEVIVGFEHGVPVSIDGSPVSMLGAIEALNRRAGAQGVGRLDVVEDRLVGIKSREIYEAPGAMVLITAHAELEHVTLERELGRFKRQTDRRWAELVYDGLWYSPLKTALESFVAATQQHVTGEVRMVLHGGHIAVNGRRSAESLYDFNLATYDEGDTFDQSAARGFVYVYGLPSKLAARRDLR

SEQ ID NO: 5583 - DNA, 1197 bp, Mycobacterium paratuberculosis
  CDS (1)..(1197): transl_table=11
atgtcagaacgcgtcatcctggcgtattccggcggtctggacacctcggtggccatcagctggatcggcaaggagaccggccgtgaggtcgtagcggtggcgatcgacctcggccagggcggcgaagacatggaggtcatccgccagcgcgccctggactgcggcgcggtggaggccgtcgttgtggacgcccgcgacgaattcgccgagggctattgcctgcccaccatccgcaacaacgccctctacatggaccgctacccgctggtgtcggcgatcagccggccgctgatcgtcaagcacctggtggccgcggcccgcgagcacggcggcagcaccgtcgcgcacggctgcaccggcaagggcaacgaccaggtccgcttcgaggtcggattcgcttcgctggcaccggatctcgaggtgctggccccggtgcgcgattacgcgtggacgcgggagaaggcgatcgcgttcgccgaggagaacgccatcccgatcaacgtgaccaaacgctcgccgttctccatcgaccagaacgtgtggggtcgcgcggtggaaaccggtttcctggaacacctttggaacgcgcccaccaaggacgtctacgcctacaccgaggaccccacgctgaactggagcacccccgacgaggtgatcgtcgggttcgagcgcggggttccggtgtccatcgacggcaagccggtgtcggtgctgggcgccatcgaggaactcaacgcccgcgccggcgccaagggggtagggcgcctggacgtcgtggaggaccggctggtgggcatcaagagccgcgagatctacgaggcgcccggcgccatggtgctcatcaccgcgcacaccgagctcgagcacgtcaccctggagcgggagctgggccggttcaagcggcacaccgatcagcgctgggccgagctggtgtacgacgggttgtggtattcgccgctgaaggctgcgctggaaagcttcgtcgacaagacccaggagcacgtcaccggcgagatccgaatggtgttgcacggcggccacattgcggtcaacggccggcgcagcgccgaatcgctctacgacttcaacctggccacctacgacgagggcgacagcttcgaccagtcggcggcgaagggtttcgtctacgtgcacgggctgtcgtcgaagatcgcctcccgccgggaccagcggtga

SEQ ID NO: 5584 - protein, 398 aa, Mycobacterium paratuberculosis
MSERVILAYSGGLDTSVAISWIGKETGREVVAVAIDLGQGGEDMEVIRQRALDCGAVEAVVVDARDEFAEGYCLPTIRNNALYMDRYPLVSAISRPLIVKHLVAAAREHGGSTVAHGCTGKGNDQVRFEVGFASLAPDLEVLAPVRDYAWTREKAIAFAEENAIPINVTKRSPFSIDQNVWGRAVETGFLEHLWNAPTKDVYAYTEDPTLNWSTPDEVIVGFERGVPVSIDGKPVSVLGAIEELNARAGAKGVGRLDVVEDRLVGIKSREIYEAPGAMVLITAHTELEHVTLERELGRFKRHTDQRWAELVYDGLWYSPLKAALESFVDKTQEHVTGEIRMVLHGGHIAVNGRRSAESLYDFNLATYDEGDSFDQSAAKGFVYVHGLSSKIASRRDQR

SEQ ID NO: 5585 - DNA, 1203 bp, Mycobacterium sp
  CDS (1)..(1203): transl_table=11
atgtccgaacgcgtcatcctggcgtactccggcggtctggacacctcggtggcgatcagctggatcggcaaggagaccgggcgcgaggtggtggcggtcgccatcgacctcggtcagggcggcgaggacatggacgtcgtgcgccagcgtgccctcgactgcggtgcggtcgaagccgtcgtcatcgacgcccgcgacgagttcgccgaggactactgcctgcccgcgatccagtccaacgcgctctacatggaccgctatccgctggtgtccgcgctcagccggccgctgatcgtcaaacacctcgtggacgccgcccgcgaacacaagggcggcatcgtcgcgcacggctgcacgggcaagggcaacgaccaggtccgcttcgaggtcgggttcgcctcgctggcaccggacctcgaggtgctcgccccggtccgcgactatgcgtggacgcgcgagaaggcgatcgcgttcgccgaggagaacgcgatcccgatcaacgtcaccaagcgctcaccgttctcgatcgaccagaacgtgtggggccgcgcggtggagaccggattcctcgagcacctgtggaacgcgcccaccaaggacgtctacgactacaccgaggatccgacactcaactggagcacccccgacgaggtgatcgtcgggttcgacaagggtgtgccggtgtccatcgacggccgcgacgtgaccgtgctgcaggcgatcgaggaactcaaccgccgtgcgggcgcgcagggtgtgggccgcctcgacgtcgtcgaggaccggttggtcggcatcaagagccgcgagatctacgaggcccccggtgcgatggtgctcatcacagcgcacaccgaactcgaacacgtcacgctggaacgcgaactcggccggttcaagcgcaccaccgaccagaagtggggtgagctggtctacgacgggctgtggttctccccgctgaagaccgcgctcgagtcgttcgtcgccaagacgcaggaacacgtcagcggtgagatccggctggtgctgcacggcggccacatcgccgtgaatggacgccggagccaggaatctctgtacgacttcaacctggccacctacgacgagggcgacaccttcgaccagtcctcggccaagggcttcgtgcacgtgcacggcctgagctcgagcatctccgcgcgccgcgacctcggcatcaagtga

SEQ ID NO: 5586 - protein, 400 aa, Mycobacterium sp
MSERVILAYSGGLDTSVAISWIGKETGREVVAVAIDLGQGGEDMDVVRQRALDCGAVEAVVIDARDEFAEDYCLPAIQSNALYMDRYPLVSALSRPLIVKHLVDAAREHKGGIVAHGCTGKGNDQVRFEVGFASLAPDLEVLAPVRDYAWTREKAIAFAEENAIPINVTKRSPFSIDQNVWGRAVETGFLEHLWNAPTKDVYDYTEDPTLNWSTPDEVIVGFDKGVPVSIDGRDVTVLQAIEELNRRAGAQGVGRLDVVEDRLVGIKSREIYEAPGAMVLITAHTELEHVTLERELGRFKRTTDQKWGELVYDGLWFSPLKTALESFVAKTQEHVSGEIRLVLHGGHIAVNGRRSQESLYDFNLATYDEGDTFDQSSAKGFVHVHGLSSSISARRDLGIK

SEQ ID NO: 5587 - DNA, 1344 bp, Neisseria meningitidis serogroup A
  CDS (1)..(1344): transl_table=11
atgaaccaaaaccatactattttacaaaaccttcccgtcggtcagaaagtcggcatcgccttctccggcggacttgatacctccgccgcgctgttgtggatgaaactcaaaggcgcgctgccttatgcctacactgccaacctcggtcagcccgatgaagacgactacaacgccattcccaaaaaagcgatggaatacggtgcggaaaacgcccgcctgattgactgccgcgcacagctggcacacgaaggcatcgccgccatccaatgcggcgcgttccacgtttccaccggcggcatcgcctacttcaacaccacgcctctgggtcgcgccgtaaccggcactatgcttgtttccgccatgaaagaagacgatgtgaatatttggggcgacggcagcacctacaaaggcaacgacatcgagcgtttctaccgctacggtttgctcaccaatcccgcgctgaaaatctacaaaccctggctcgaccagcaatttatcgacgaactcggcggccgtcatgaaatgagcgaatttttgattgccaacggtttcaactacaaaatgtcggtggaaaaagcctattccaccgattccaatatgctcggcgcgacccacgaagccaaagatttggaatttttgaactcgggcatcaaaatcgtcaaacctattatgggcattgccttctgggacgaaaacgtcgaaatcaaacccgaagaagtcagcgtgcgctttgaagaaggcgtgccggttgcactgaacggcaaagaatacgctgatcccgtcgaactcttcctcgaagccaaccgcatcggcggccgccacggtctgggtatgagcgaccaaatcgaaaaccgcatcatcgaagccaaatcgcgcggcatctacgaagccccgggaatggcgttgttccacatcgcctacgagcgtttggtgaccggtatccacaacgaagacaccatcgaacaataccgcatcaacggcctgcgcctcggacgtttgctctaccaaggccgctggttcgacagccaagccctgatgttgcgcgaaaccgcccaacgctgggttgccaaagccattaccggcgaagtaaccctcgaattgcgtcgcggcaacgactactcgattctgaacaccgaatcgcccaacctgacctaccaacccgaacgcctgagtatggaaaaagtcgaagacgcagcgttcacaccgctcgaccgtatcggacaactgactatgcgcaacctcgacattaccgacacccgcgccaaactgggcatttactcgcaaagcggtttgttggcattgggcgaaggttcggtattgccgcagttgggtaataagcaataa

SEQ ID NO: 5588 - protein, 447 aa, Neisseria meningitidis serogroup A
MNQNHTILQNLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGIAFWDENVEIKPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAITGEVTLELRRGNDYSILNTESPNLTYQPERLSMEKVEDAAFTPLDRIGQLTMRNLDITDTRAKLGIYSQSGLLALGEGSVLPQLGNKQ

SEQ ID NO: 5589 - DNA, 1344 bp, Neisseria meningitidis serogroup B
  CDS (1)..(1344): transl_table=11
atgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataa

SEQ ID NO: 5590 - protein, 447 aa, Neisseria meningitidis serogroup B
MSQNHTILQSLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEVSPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEDAAFTPLDRIGQLTMRNLDITDTRVKLGIYSQSGLLSLGEGSVLPQLGNKQ

SEQ ID NO: 5591 - DNA, 1215 bp, Nitrosomonas europaea
  CDS (1)..(1215): transl_table=11
atggataaagtcaagaaagcagtactggcattttcaggggggctggatacctcagtcattttgaaatggctgcaggatacctatcagtgtgaggtggttacttttacggcggatatcggccagggcgaggagattgagccggcacgtgccaaagccgtacagtttggcatcagggaaatcttcatcgaggatctgcgcgaagagttcgtgcgtgactatgtttttcccatgttccgtgccaatacgatttatgaaggggaatatctgctcgggaccagtattgcccggccgctgattgccaaacgtcaggttgaaattgcgcagcagaccggcgcggatgcggtttctcacggtgctaccgggaagggaaatgaccaggtacgttttgagcttggttactatgcgttgcagccggatattcgggtaattgctccctggcgcgagtgggatctgacttcgcgtgaaaaactgctgacttatgccgagaagcagggtatcccgatcgaaatgaagcagaaggcaggatcgccctacagcatggacgccaatctgctccatatttcttatgaggggcgtgcgctggaagatccggctgcggagccggaggagagtatgtggcgctggacagtctcgcctgaaactgctccgagtgagcctgaatatctggatctggaatatgaacgcggtgatattgttgcattgaacggtgaaaggttgtctcccgcagccattctgaccaggcttaaccagttgggtggaaaacatggtatcggccgtctcgatctggtggaaaaccgttatgtcgggatgaaatcacgcggctgttatgaaacgcctggtggcacgatcatgttgcgtgcccatcgtgcaatcgaatccattacgcttgaccgcgaagttgcgcatttgaaagatgatctgatgccgcgttatgcagcgctgatttataacggttactggtggagtccggaaagaaaactgttgcaggtgctcatcgatgaatcccaggtgaatgtgaatggccgggtcagagtcaaattgtataagggtaatgtgatggttgtcgggcgtgattcccggaccgactcgttatttgaccccgacattgcgacatttgaagaagatggtggggcttatcatcaggctgatgcagcaggtttcatcaagctcaatgcgctgagaatgcggattgcaaaagctctccgcaggtgctga

SEQ ID NO: 5592 - protein, 404 aa, Nitrosomonas europaea
MDKVKKAVLAFSGGLDTSVILKWLQDTYQCEVVTFTADIGQGEEIEPARAKAVQFGIREIFIEDLREEFVRDYVFPMFRANTIYEGEYLLGTSIARPLIAKRQVEIAQQTGADAVSHGATGKGNDQVRFELGYYALQPDIRVIAPWREWDLTSREKLLTYAEKQGIPIEMKQKAGSPYSMDANLLHISYEGRALEDPAAEPEESMWRWTVSPETAPSEPEYLDLEYERGDIVALNGERLSPAAILTRLNQLGGKHGIGRLDLVENRYVGMKSRGCYETPGGTIMLRAHRAIESITLDREVAHLKDDLMPRYAALIYNGYWWSPERKLLQVLIDESQVNVNGRVRVKLYKGNVMVVGRDSRTDSLFDPDIATFEEDGGAYHQADAAGFIKLNALRMRIAKALRRC

SEQ ID NO: 5593 - DNA, 1203 bp, Nocardia farcinica
  CDS (1)..(1203): transl_table=11
atgtccgagcgcgtcgtactcgcctactccggtgggctggacacctccgtcgccatcagctggatcggcaaggagaccggcgccgaggtcgtggccgtcgccatcgatctgggccagggcggcgaggacatgaacgtggtgcgccagcgcgcgctggactgcggtgcggtcgagtcgatcgtgatcgacgcccgcgacgaattcgccgagcagtactgcctgccgaccatccaggccaacgccctctacatgggccagtacccgctggtctcggcgatcagccggccgctgatcgtcaagcacctggtcgaggccgccaagttccacggcgccgacaccgtcgcgcacggctgcaccggcaagggcaacgaccaggtgcgcttcgaggtcggcatcggcgcgctcgcgcccgacctgaacgtgatcgccccggtgcgcgactacgcctggacccgggagaaggccatcgccttcgccgaggagaacaagctcccgatcaacgtcaccaagaagtcgccgttctccatcgaccagaacgtgtggggccgtgccgtcgagaccggcttcctcgaggatctgtggaacgcgccgaccaaggacgtctacgactacaccgccgaccccacggtcaacttcgaggcgcccgacgaactgatcatcaccttcgacaagggtgtgccggtcgccatcgacggccgtccggtcagcgtgctcgaggcgatcgtggagctgaaccaccgcgccggccgccagggcgtcggccgcctggacatggtcgaggaccggctggtgggcatcaagagccgcgagatctacgaggcgccgggcgcgatcaccctgatcaccgcgcaccaggcgctcgagcacgtcaccatcgagcgcgagctgggccgctacaagcgccaggtcgagcagcgctggggcgagctggcctacgacggcctgtggttctccccgctcaagcgcgcgctggacgccttcgtgcaggacacccagcagcacgtgtccggcgacatccggatggtgctgcacggcggctcggccgtggtcaacggccgccgctccgagcagtcgctctacgacttcaacctcgccacctacgacgagggcgacaccttcgaccagtcgctggccaagggcttcgtgcagatccacggcctgtcgtccaaggtggccgcgcgccgcgacctgaaccagaagtag

SEQ ID NO: 5594 - protein, 400 aa, Nocardia farcinica
MSERVVLAYSGGLDTSVAISWIGKETGAEVVAVAIDLGQGGEDMNVVRQRALDCGAVESIVIDARDEFAEQYCLPTIQANALYMGQYPLVSAISRPLIVKHLVEAAKFHGADTVAHGCTGKGNDQVRFEVGIGALAPDLNVIAPVRDYAWTREKAIAFAEENKLPINVTKKSPFSIDQNVWGRAVETGFLEDLWNAPTKDVYDYTADPTVNFEAPDELIITFDKGVPVAIDGRPVSVLEAIVELNHRAGRQGVGRLDMVEDRLVGIKSREIYEAPGAITLITAHQALEHVTIERELGRYKRQVEQRWGELAYDGLWFSPLKRALDAFVQDTQQHVSGDIRMVLHGGSAVVNGRRSEQSLYDFNLATYDEGDTFDQSLAKGFVQIHGLSSKVAARRDLNQK

SEQ ID NO: 5595 - DNA, 1215 bp, Novosphingobium aromaticivorans
  CDS (1)..(1215): transl_table=11
atgtccgatatcaagaaggtcgtcctcgcctactccggcggtctcgacacctccgtcatcctcaagtggctgcaggtcacctacaactgcgaggtggtcaccttcaccgccgacctcggccagggcgaggagctcgaacccgcgcgcgccaaggcaaagctgatgggcgtgcccgatcaccacatctacatcgacgacctgcgcgaggaattcgtgcgcgacttcgtcttcccgatgatgcgcgccaatgcccgctacgagggcgattacctgctcggcacctcgatcgcccgtccgctgatctccaagcgcctgatcgaaatcgcgcgcgaaaccggagccgatgccgtcgcccacggcgcgaccggcaagggcaacgaccaggtccgcttcgaactgtccgcctacgccctcgaaccgggcatcaaggttatcgcgccctggcgcgaatgggatctcaccagccgcaccgcgctgatcgcctgggccgaagcgcaccagattccggtccccaaggacaagcgcggcgaaagcccgttctcgaccgacgccaacctcctccacacctcgtccgaaggcaaggtgctggaagatccgtggcaggaaaccccggactacgtctactcgcgcaccgtcaatccggaagacgcgcccgacacccctgagtacatcaccatcgacttcgagaagggcgatggcgtcgcgctcaacggcgaggccatgtcgcccgccacgctgctcgccgccctcaacgacctcggccgcaagcacggcatcggccgtctcgatctcgtcgagaaccgcttcgtcggcatgaagagccgcggcatgtacgaaacgcccggcggcgagatctatgcccgtgcccatcgcggcatcgaaagcatcaccctcgaccggggcgcggcgcacctcaaggacgagctgatgcccaagtacgcggagctgatctacaacggcttctggttctcgcccgagcgcgagatgctgcaggccgcgatcgatcactcgcaggcccgcgtgaacggcaccgtccggctcaagctctacaagggcagcgcctcggtcgtcggccgcaagtcgcccgacagcctctactccgaacgccacgtgacgttcgaggacgatgccggcgcctacgaccagaaggacgcggcgggcttcatcaagctcaacgccctgcgccttcgcctgctggcgcagcagggccgctga

SEQ ID NO: 5596 - protein, 404 aa, Novosphingobium aromaticivorans
MSDIKKVVLAYSGGLDTSVILKWLQVTYNCEVVTFTADLGQGEELEPARAKAKLMGVPDHHIYIDDLREEFVRDFVFPMMRANARYEGDYLLGTSIARPLISKRLIEIARETGADAVAHGATGKGNDQVRFELSAYALEPGIKVIAPWREWDLTSRTALIAWAEAHQIPVPKDKRGESPFSTDANLLHTSSEGKVLEDPWQETPDYVYSRTVNPEDAPDTPEYITIDFEKGDGVALNGEAMSPATLLAALNDLGRKHGIGRLDLVENRFVGMKSRGMYETPGGEIYARAHRGIESITLDRGAAHLKDELMPKYAELIYNGFWFSPEREMLQAAIDHSQARVNGTVRLKLYKGSASVVGRKSPDSLYSERHVTFEDDAGAYDQKDAAGFIKLNALRLRLLAQQGR

SEQ ID NO: 5597 - DNA, 1254 bp, Oceanobacillus iheyensis
  CDS (1)..(1254): transl_table=11
atgacaaaagaaaagattgtattagcctattctggaggattagacacctctgttgcagttaaatggttacaggataaatataattatgatgtgattgcagttgcattagacgttggagaaggtaaggatttagattttgtgaagaagaaagcattggatgtaggagctatcaaatcctatgttattgatgcgaaaaacttgtttgcggaagaatatgtcttaccagcattacaagcaaatctattatatgaaggaaagtaccctttaatttcagctttatctagaccccttatttctaagattttagtagatattgcagaggaagaaggagcggtagctgttgcacatggctgcactggaaaaggaaatgatcaagtgcgctttgatgtatcatttactgcactaaaccctaaccttaagattgtagcgccggttcgtgaatgggcaatgtcaagagaagaagaaattgagtatgcgaagtcacatgggattccaattccaattaacttggatagtccttacagtattgatcaaaatctatggggcagaagcaatgaatgtgggattttagaagatccatgggcagaggcacctaaagacgcttatgatctaactatagatccagtagatgcacctgaagatccagaagttatccaaattacatttaaaaaaggaaagccagtctctattgatggtaaagaaatgcctctagatgaactaattctacaattaaatacgattgctggtaaacatggtgttggcagaattgatcatgtagaaaatcgtttggtaggaattaaatcaagagagatttatgaagcaccagcagcaacgacgttaattgctgcacatcaggaattagaagcattaacattaccaagagaagtagcggaattcaagccgacaattgagcagaagctagcacaaacggtttattatggattatggtattcacctttaacagaagcactacaatcttttattgagaaaacacaggaacatgtatctggaacagtaaaagtgaagttatataaaggtcatgcacaagtaattggaagagagtctgaaaactccctttatgattttgacttggcgacatacaacaaagcagatgcatttgatcatgatgctgcattaggatttattaaactttggggactacctacgcaggttcactccgctgtaaatggaccacaaggtaaaaaatcaattgaaaaagtagacttggaagtaaaggaagctgtgaaaccatga

SEQ ID NO: 5598 - protein, 417 aa, Oceanobacillus iheyensis
MTKEKIVLAYSGGLDTSVAVKWLQDKYNYDVIAVALDVGEGKDLDFVKKKALDVGAIKSYVIDAKNLFAEEYVLPALQANLLYEGKYPLISALSRPLISKILVDIAEEEGAVAVAHGCTGKGNDQVRFDVSFTALNPNLKIVAPVREWAMSREEEIEYAKSHGIPIPINLDSPYSIDQNLWGRSNECGILEDPWAEAPKDAYDLTIDPVDAPEDPEVIQITFKKGKPVSIDGKEMPLDELILQLNTIAGKHGVGRIDHVENRLVGIKSREIYEAPAATTLIAAHQELEALTLPREVAEFKPTIEQKLAQTVYYGLWYSPLTEALQSFIEKTQEHVSGTVKVKLYKGHAQVIGRESENSLYDFDLATYNKADAFDHDAALGFIKLWGLPTQVHSAVNGPQGKKSIEKVDLEVKEAVKP

SEQ ID NO: 5599 - DNA, 1338 bp, Pasteurella multocida
  CDS (1)..(1338): transl_table=11
atgtcaaacacaattttacagcagcttccaaaaggtcaaaaagtcggtatcgcgttttcaggtggtttagataccagtgcagcattgttatggatgcgtcaaaaaggggctgttccttatgcctataccgcgaacttaggtcaaccagatgaagaggattacaatgcaattccgcgtaaggcgatggaatatggcgcggaaaatgcccgcttaattgattgccgtgcacagcttgctcacgaagggattgcggctattcaaagcggtgccttccatatttcaacaggtggcgtaacgtattttaataccaccccattgggtcgtgcagtaacgggaacgatgttagtgtcggcgatgcgtgaagatgatgtgaatatctggggtgatggcagtaccttcaaaggtaatgatattgagcgtttctatcgttatggtttattaactaatcccaatcttaaaatttataagccatggttagataatcaatttatcgaagaattaggcggtcgtcatgaaatgtcagagttcttgattgcgaatggctttgaatacaaaatgtcagtggaaaaagcctattcaacagattcaaatatgctaggtgccacccatgaagccaaagatcttgaatttttaaatacgggtattcgtattgtaaaaccgattatgggcgtggcattctggcgtgatgatgttgaagtgaaagctgaagaagtcactgtgcgctttgaagaggggattcctgtggcgttaaatggtaaaacattcagcgatcatgttgaattattcctcgaagcaaaccgtattggtgggcgccatggtttaggtatgtcagaccaaattgaaaaccgaattattgaagccaaatcgcgtggtatttatgaggcaccggggatggcgttgttacatattgcctatgagcgcttagtgagtggtatccataatgaagatacgattgaacaataccgtattaacggcttacgtttaggtcgtttactctaccaaggtcgttggtttgatccacaagccttaatgttacgtgaaacggcacaacgctgggttgcgcgtgcgattaccggtgaggtgactttcgaattacgccgtggtaatgattattccattttgaatacggaatcaccaaatttaacttatatgccagagcgtttaagtatggaaaaagtggaaaatgcgccatttgatcctgttgatcgtattggtcaattaacgatgcgcaacttagatatcgtagatacgcgggataagttaggtatttacacgcaaacaggcttactcagtatttcaaaagattctttcttgccacaactaaataagaaaggttaa

SEQ ID NO: 5600 - protein, 445 aa, Pasteurella multocida
MSNTILQQLPKGQKVGIAFSGGLDTSAALLWMRQKGAVPYAYTANLGQPDEEDYNAIPRKAMEYGAENARLIDCRAQLAHEGIAAIQSGAFHISTGGVTYFNTTPLGRAVTGTMLVSAMREDDVNIWGDGSTFKGNDIERFYRYGLLTNPNLKIYKPWLDNQFIEELGGRHEMSEFLIANGFEYKMSVEKAYSTDSNMLGATHEAKDLEFLNTGIRIVKPIMGVAFWRDDVEVKAEEVTVRFEEGIPVALNGKTFSDHVELFLEANRIGGRHGLGMSDQIENRIIEAKSRGIYEAPGMALLHIAYERLVSGIHNEDTIEQYRINGLRLGRLLYQGRWFDPQALMLRETAQRWVARAITGEVTFELRRGNDYSILNTESPNLTYMPERLSMEKVENAPFDPVDRIGQLTMRNLDIVDTRDKLGIYTQTGLLSISKDSFLPQLNKKG

SEQ ID NO: 5601 - DNA, 1215 bp, Photorhabdus luminescens subsp
  CDS (1)..(1215): transl_table=11
atgcatactaaagatatcaaaaaaatcgttcttgcctattctggtggtctggatacttctgccattattccttggctgaaggagcattatggcaactgtgaagttgttgcgtttgttgctgatgtggggcaaagccgtgaagatttggaaggcgtggagcagaaagctttgcgttctggcgcgtcagaatgtcacgttgtggatctgcgtgaggaattcattaaagattatgtttatccggtactgaaaaccggtgctctgtatgaaggtagctatttgttgggcacttcaatggcacgccccattattgctaaagcacaggttgaattggcactgaaagtaggagcagatgcacttgctcatggtgcaacaggtaagggtaacgatcaggttcggtttgaaagcacttatacggcattagcccctcagctaaaagtagttgcaccgtggagagagtgggatttacgttcccgtgaagcgttgctggattatctgaaagcacgagatattccaaccactgcaacattggagaaaatttacagccgtgatgagaatgcgtggcatatctctaccgaaggtggcgtactggaaagcacttggaatgcatccaataaagattgttgggtgtggacagtcgatccagaagaggcaccagatgaagctgaattggttagtgtcatgattgagaaaggcgaggttgttggggtcaacggcaaagtaatgtctccatatcaatgccttgaagcgctgaatattctgggagtaaaacatggtatcggtcgtatcgatatcgtggaaaaccggctggtgggaatgaaatctcgtggttgttatgaaacaccgggaggaaccatcatgatggctgcgttgcgtggtgttgaacaactggttctggaccgcgatagctttaaatggcgtcagcagcttgggctagaaatgtcttatgtcgtttatgacggacgttggtttgccccgctacgtcgatctattcaggcagcggctgagacgttggctgcggatgtcagcggtgaagtagtactgaaactctataaagggcaggtaacagcgatccagaaaagatcaacaaatagcctttattctgaagcgtttgcaacgtttggtgaagatgaggtttacgatcacagccatgcagcaggatttatccgtctgtattctctcccttcgcgcattcgggcattaaatagtaaagagtaa

SEQ ID NO: 5602 - protein, 404 aa, Photorhabdus luminescens subsp
MHTKDIKKIVLAYSGGLDTSAIIPWLKEHYGNCEVVAFVADVGQSREDLEGVEQKALRSGASECHVVDLREEFIKDYVYPVLKTGALYEGSYLLGTSMARPIIAKAQVELALKVGADALAHGATGKGNDQVRFESTYTALAPQLKVVAPWREWDLRSREALLDYLKARDIPTTATLEKIYSRDENAWHISTEGGVLESTWNASNKDCWVWTVDPEEAPDEAELVSVMIEKGEVVGVNGKVMSPYQCLEALNILGVKHGIGRIDIVENRLVGMKSRGCYETPGGTIMMAALRGVEQLVLDRDSFKWRQQLGLEMSYVVYDGRWFAPLRRSIQAAAETLAADVSGEVVLKLYKGQVTAIQKRSTNSLYSEAFATFGEDEVYDHSHAAGFIRLYSLPSRIRALNSKE

SEQ ID NO: 5603 - DNA, 1215 bp, Photobacterium profundum
  CDS (1)..(1215): transl_table=11
atgagtaaggtaactaaagtcgtattagcctattccggcggtctagatacatcagcaatcatcccatggttaaaagaaaactatgactgtgaagttgtcgcttttgtggcagatgttggtcaaggtgcagcagagcttgaaggtattgaagaaaaagcgatcgcatctggcgcatcatcttgttacatcgcggatctaaaagaagaaatggtagcagattacatctacccaagcctcaagacaggtgctatttacgaaggtaagtacttgttgggtacgtcaatggcacgtcctattatcgcgaaagcacaagttgaatgtgcattagccgtcggtgctgatgcagtatgtcatggttgtaccggtaaaggtaacgatcaggttcgttttgaaggtgcgtatgcagcgcttgctcctcaattaacggtgattgcaccgtggcgtgagtgggatctacgtagccgtgaagcattgctagattaccttgccgagcgtgatatcccttgcacggcatcacttgaaaaaatctactctcgtgatgcaaacgcatggcacatttcaaccgaaggtggcgtgttagaaaatacctggaatcagtcgaacgaactgtgctgggtctggacgaaagatcctgagaatgcaccagaaaaagctgaaactgtgtctatcttggtagaaaaaggtgaagttgttgctgtcgatggtgaagcaatgtcgccgtttaatgcccttacttacctaaatgaaaaaggggctgaacacggtgtgggccgtatcgatatcgttgaaaatcgtttggttggtattaagtctcgtggttgttatgaaacgccaggtggcacaatcatgaacgaagcgttacgtgcggtagagcaattagtgcttgataaagagtcgtatgaattccgtgagacggtaggccttaaagcgtcacaccttatctatgatggtcgttggtttaccccgctttgtaaatcgatactagctgcagcagatgaattggctcaagatgtgagtggtgaagttgtagtgaaactgtataaaggtcaagctacagtgattcagaagcgttcaatgaatagcttgtactctgaagagtttgcaaccttcggtgaagatgacgtttacgatcacagccatgctggtggtttcattcgcctttattcgctagcaagtcgtatccgtgcattgaatacacagaaaaaacaaaaataa

SEQ ID NO: 5604 - protein, 404 aa, Photobacterium profundum
MSKVTKVVLAYSGGLDTSAIIPWLKENYDCEVVAFVADVGQGAAELEGIEEKAIASGASSCYIADLKEEMVADYIYPSLKTGAIYEGKYLLGTSMARPIIAKAQVECALAVGADAVCHGCTGKGNDQVRFEGAYAALAPQLTVIAPWREWDLRSREALLDYLAERDIPCTASLEKIYSRDANAWHISTEGGVLENTWNQSNELCWVWTKDPENAPEKAETVSILVEKGEVVAVDGEAMSPFNALTYLNEKGAEHGVGRIDIVENRLVGIKSRGCYETPGGTIMNEALRAVEQLVLDKESYEFRETVGLKASHLIYDGRWFTPLCKSILAAADELAQDVSGEVVVKLYKGQATVIQKRSMNSLYSEEFATFGEDDVYDHSHAGGFIRLYSLASRIRALNTQKKQK

SEQ ID NO: 5605 - DNA, 1188 bp, Picrophilus torridus
  CDS (1)..(1188): transl_table=11
atggaaaaggcattattattatactctggtggactggatacatccgttatggtcaggtggataaaagaaaaaatgaacatggacgttgtaacattaacacttgacataggtaactctgatcttgaagaaataaaagagaaggccttaaagctgggggccattgatgcaataacgcttgatgttaaaaaggaattcgctgataactatatatcaagggagatacatgccaatggcctttacggtgaatacccgctatcaacagcacttgcaaggccgcttatggccgagaaagccgtctcggttgccaatgaaaacgatataaagttcatagcccatggttccactggaaagggaaatgaccaggtaaggtttgaggtctcaataaacgcacttgataataacataaaggtgattgcgcctgtaagggaatggaatatgaccagggcagatgaacttgaatatgcaaaaatgaataatatatatgtaaaatctgatggcaaatactccgttgatgaaaatatatggggtaggtcaatagagggatcatccatagaaaatattaacgaacccgttaatgatgatgcctttgaatgggtaacaccgccccaatactgcggttcaggcgaaccggtttcaattgaattctataaagggctgccatcatcattaaatggtaaaagcatggatcttttgagcataataaaaaatcttaacattattgcaggcaggaacggtataggtataataaacatgatagaatcgaggctcataggtctcaagagccacgaggtctatgaatgccctgccgcatctgttatattaaaagcacacaaatatcttgagaatttaatactaaacaaaaacgaactttctgtgaagaattacatagataatttctggtcaaacatggtttacaatggattatggtttgatccgtcaatggagcacatgaaccaattcgagaaaagctcaaatcagtacataaccggaagcgtaaatttaagactttacaggggaaacatgatcctggaaggcattgagagcccgtactctctatacgattataacacaataaactatgagaccggtgtatttgatcagggctcatcaaagggctttatagatatatacaaaaatgaaaccgtaaggtcaaacagggttaaaaaggcattaacggtgatacattga

SEQ ID NO: 5606 - protein, 395 aa, Picrophilus torridus
MEKALLLYSGGLDTSVMVRWIKEKMNMDVVTLTLDIGNSDLEEIKEKALKLGAIDAITLDVKKEFADNYISREIHANGLYGEYPLSTALARPLMAEKAVSVANENDIKFIAHGSTGKGNDQVRFEVSINALDNNIKVIAPVREWNMTRADELEYAKMNNIYVKSDGKYSVDENIWGRSIEGSSIENINEPVNDDAFEWVTPPQYCGSGEPVSIEFYKGLPSSLNGKSMDLLSIIKNLNIIAGRNGIGIINMIESRLIGLKSHEVYECPAASVILKAHKYLENLILNKNELSVKNYIDNFWSNMVYNGLWFDPSMEHMNQFEKSSNQYITGSVNLRLYRGNMILEGIESPYSLYDYNTINYETGVFDQGSSKGFIDIYKNETVRSNRVKKALTVIH

SEQ ID NO: 5607 - DNA, 1215 bp, Prochlorococcus marinus
  CDS (1)..(1215): transl_table=11
atgcagcaggtaaacaaagttgtactagcctattccggtggagttgatacgagcgtttgtattccatatttaaagaatgaatatggcatttcagaagtggttacttttgtggcagatcttggacaaggcgaggatttggaacttattaggaaaaaagccttaaattcaggtgcatctaaatcaataattggtaatttagttagtagttttgttgagagatatgcttttcctgctattagagcaaatgcactctatctagataaatatcctttatctacagctcttgctaggcctttaattgctgaaaacctggtaaatattgctcgagagattaatgccgatgcagtagctcatggatgtactggtaaagggaatgatcaagttcgatttgatttagcaattaatgctttaggccctgatttgaaaataattactcccgcaagggagtggaatatgagtagggaagaggcaatattgtatggagaaaaatttggtattcctgcaccagtatctaaaaaatcaccatattcaatagacgttaacttacttggtaggagtattgaagccggtatattagaagatcccatgcaagaggcacctgaagatatttttgcaatgacatcatcaattaataattcacctgagtctccgttagatatagaaattatttttaaaaatggcttcccagttggaatcaacaatgaatttttaaatccagtggagattatccaaaaagctaatgttcttgcaggtgaatatggttttggaagaatagatatgatggaagatcgagtggtaggaattaaaagtagagagatttatgaaacgcctggtctcttactattaataaaagctcacaaggaattggaaagtattacattaaatccagatgttattgattttaaaggagtcgtcgaaaaaaaatggggtcaattagtttatcaaggtttttggtttggtcctctcaaggagagtttagatgcttttattgcatcgactcaaacttcagttaatggacgagtaaagattagacttcataaggggaatgcaatagtaattggaagaatctcagaaaataattcactttatagagaggatttggcaacttatagtcaagacgatgtttttaaacattccttagcggagggttttatttatatgtggggtatgtctaataaaatatgggcagagttaaattcaaaaaaaattgattaa

SEQ ID NO: 5608 - protein, 404 aa, Prochlorococcus marinus
MQQVNKVVLAYSGGVDTSVCIPYLKNEYGISEVVTFVADLGQGEDLELIRKKALNSGASKSIIGNLVSSFVERYAFPAIRANALYLDKYPLSTALARPLIAENLVNIAREINADAVAHGCTGKGNDQVRFDLAINALGPDLKIITPAREWNMSREEAILYGEKFGIPAPVSKKSPYSIDVNLLGRSIEAGILEDPMQEAPEDIFAMTSSINNSPESPLDIEIIFKNGFPVGINNEFLNPVEIIQKANVLAGEYGFGRIDMMEDRVVGIKSREIYETPGLLLLIKAHKELESITLNPDVIDFKGVVEKKWGQLVYQGFWFGPLKESLDAFIASTQTSVNGRVKIRLHKGNAIVIGRISENNSLYREDLATYSQDDVFKHSLAEGFIYMWGMSNKIWAELNSKKID

SEQ ID NO: 5609 - DNA, 1209 bp, Prochlorococcus marinus
  CDS (1)..(1209): transl_table=11
atgggagattttcagaaagttgttcttgcttattctggcggagtagacactagtgcttgtattccttatttaaaaaatgaatatggagtcgaagagattattgcttttgcagcggacttgggtcagggcgaagaattagaagttgttcgtaaaaaagctttattagcaggagcaaaggaatctttagttgatgatttaatagaaccttttatacatgattttgcatttcctgctattcgggcaaatgctctttatgaaggtcgttatccattatcaacagcattggcaaggcctttgatagcaagtcgcttagttgagttggcaagagaaatggaagctggtgctgttgctcatggttgtactggaaaaggcaatgatcaagttcgctttgatttggctatttcatcgcttgctccgcatttgaagatattaacccctgcaagagagtggtccatgagtagacaggaattaatttcttatggcgagaaatttggcattcctgcccctgtaagtaaaaaatctccatattcgattgatttaaatcttttagggagaagtattgaagctggtccattggaagatccctttttggcgcctcgagaggaagtgtttcagattacttcttcaattcaagagtcccctgatactcctgaagaaatagaaattcagtttgaagcaggaaatccaattgcaatcaatggagttactttggaccccgtaagcattatcaaaaaggcaaatgcattggctggaaggcatggttttggtcgaatagatatgatagaaaatcgagttgtaggaataaaaagtagagaaatttacgaggctccaggtcttatgcttttaataaaatgtcatcaagagattgaaagcattactttgtctgcagatgttttaagaacaaaagtaggtattgagcggcaatgggctgatttggtttatcaaggtttttggtttagtcctttaaaaaatgctttggatgcttttattgatcgtacacaacttgatgttaacggatcagtaaaaattcaattatttaaaggcaatgctactatccaaggaagacaatcatattctaatagtttatatttacctgatattgctacctatagtgcagaagatcaatatgatcataaatctgcagagggatttatttatgtttggggccttgctaatcgtctatgggcttcaattaatagggacaaatag

SEQ ID NO: 5610 - protein, 402 aa, Prochlorococcus marinus
MGDFQKVVLAYSGGVDTSACIPYLKNEYGVEEIIAFAADLGQGEELEVVRKKALLAGAKESLVDDLIEPFIHDFAFPAIRANALYEGRYPLSTALARPLIASRLVELAREMEAGAVAHGCTGKGNDQVRFDLAISSLAPHLKILTPAREWSMSRQELISYGEKFGIPAPVSKKSPYSIDLNLLGRSIEAGPLEDPFLAPREEVFQITSSIQESPDTPEEIEIQFEAGNPIAINGVTLDPVSIIKKANALAGRHGFGRIDMIENRVVGIKSREIYEAPGLMLLIKCHQEIESITLSADVLRTKVGIERQWADLVYQGFWFSPLKNALDAFIDRTQLDVNGSVKIQLFKGNATIQGRQSYSNSLYLPDIATYSAEDQYDHKSAEGFIYVWGLANRLWASINRDK

SEQ ID NO: 5611 - DNA, 1206 bp, Prochlorococcus marinus
  CDS (1)..(1206): transl_table=11
atggggcgtgcgaagaaggtagtgcttgcttattccggtggtgttgataccagcgtttgcatcccatacctcaagcatgaatggggggtagaggaggtgatcacctttgctgccgatttaggtcagggcgatgagcttgatcccatccgccttaaggctcttgatgctggtgctagtcagtctctggtgggagatttgatagagccttttgtagaacagtttgctttgccggcgattcgtgccaatgctctttacgaaggtcgttatccactgtctacggctttagctcgccccctgattgctcgtcagttggtagaggttgccagggaggtcggggccgatgcggtggctcatggctgtacgggtaaaggcaacgatcaggtgcgttttgatttagccattgcagcactagcacctgatctcaaggtgctaactcccgctcgggaatggagcatgagcagagaggaggcgatcgcctatggcgaacgctgtgggatccctgcccccgtgagtaagaaatcgccttattcgatagatctgaatctgttgggtcggagtattgaagccggtcctcttgaagatctgatggtggctccgcccgaggaggtctttgccatgacctcctcgattgacgctgcaccctctcaggctcaggacattgagatcagttttgaagctggtaatcctgtggctattgatggggtgcgacttgattcggtgggtttgatcaaggaggcgaatcgtcttgctggacggcatggtttcggtcgccttgacatcattgagaatcgggtggttggtatcaagagtcgggagatttatgaaactccagggttacttttattgattcgtgctcatcaggaattggagagtttgacacttgctgcggatgtgttgcgcatgaagcgtcaattggagatgcaatgggctgagctggtctatcagggtctttggttttcccctttgaaggatgctctggatggatttatggatcgcactcagacttatgtgaatggcttggtgcggattcgtctccaaaaaggcaatgccatggtgattggccggagctctgacaccaacagcttgtatatatctgagatggctacctatggcagcgaggataactttgaccacagggctgctgaaggatttatctacatctggggacttccaagtcgcctttgggcagcagctcggcgaggttaa

SEQ ID NO: 5612 - protein, 401 aa, Prochlorococcus marinus
MGRAKKVVLAYSGGVDTSVCIPYLKHEWGVEEVITFAADLGQGDELDPIRLKALDAGASQSLVGDLIEPFVEQFALPAIRANALYEGRYPLSTALARPLIARQLVEVAREVGADAVAHGCTGKGNDQVRFDLAIAALAPDLKVLTPAREWSMSREEAIAYGERCGIPAPVSKKSPYSIDLNLLGRSIEAGPLEDLMVAPPEEVFAMTSSIDAAPSQAQDIEISFEAGNPVAIDGVRLDSVGLIKEANRLAGRHGFGRLDIIENRVVGIKSREIYETPGLLLLIRAHQELESLTLAADVLRMKRQLEMQWAELVYQGLWFSPLKDALDGFMDRTQTYVNGLVRIRLQKGNAMVIGRSSDTNSLYISEMATYGSEDNFDHRAAEGFIYIWGLPSRLWAAARRG

SEQ ID NO: 5613 - DNA, 1215 bp, Prochlorococcus marinus subsp
  CDS (1)..(1215): transl_table=11
atgcagcaggtaaaaaaagttgttcttgcatattctggaggagttgatactagtgtctgcattccatatttaaaaaatgaatacggtatttcagaagttgtaacttttgtagctgatcttggccaaggagatgatttagagattgttagacaaaaagccttaaattcaggtgcaacaaaatctgtgattgggaatttagtagataattttgtagaaaagtatgcttttcctgctattagagcgaatgcactttatggagaaaagtatcctttatcaactgctttggctagaccactgatagctgaaaatctcgtaaatttagcaagagaactaaatgctgatgcagtggcgcacggctgtacaggaaaaggaaatgatcaagtaagatttgatttggctattcatgctttaggacctgatttacagataattacacctgctagagaatggaagatgagtagagaagaagctattttgtatggtgaaaaatttggaattccagctcctgtttctaagaagtctccttattcgattgatgtgaatcttcttggtcgtagtattgaagctggtttattggaagatccaatgcaagaaccagatgaagacgtttttgatatgacttcatctattaataacgcaccaaatgctccaaaagacgtagaaattatatttcaaaatggatttcctattgcaataggaaatgaatttttaagtcctgtagagattattcaaaaggctaattctctagcaggcgaacatggctttggaagaatagatatgattgaagatagagttgtcggtattaagagcagagaaatctatgaggcgcccggccttttacttcttataaaagctcacaaagaattggaaagcataacattaaatccagatgtattagattttaaaaatatagtagaaaaaaaatggggtcaattagtttatcagggattttggtttggtcctctcaagcaagcattagatggttttattgattccactcaatcatctgttaacggtaaggtcaaaataagattacataagggaaatgcgatagtaattggtcgttcttctcaaaataactctctctatagggaagatttggcaacttatagtaaagatgatatttttaatcacaagcaagcagaaggatttatttatatgtgggggatgtccaataaaatatgggcagaattaaattcaaaaaagaataaatag

SEQ ID NO: 5614 - protein, 404 aa, Prochlorococcus marinus subsp
MQQVKKVVLAYSGGVDTSVCIPYLKNEYGISEVVTFVADLGQGDDLEIVRQKALNSGATKSVIGNLVDNFVEKYAFPAIRANALYGEKYPLSTALARPLIAENLVNLARELNADAVAHGCTGKGNDQVRFDLAIHALGPDLQIITPAREWKMSREEAILYGEKFGIPAPVSKKSPYSIDVNLLGRSIEAGLLEDPMQEPDEDVFDMTSSINNAPNAPKDVEIIFQNGFPIAIGNEFLSPVEIIQKANSLAGEHGFGRIDMIEDRVVGIKSREIYEAPGLLLLIKAHKELESITLNPDVLDFKNIVEKKWGQLVYQGFWFGPLKQALDGFIDSTQSSVNGKVKIRLHKGNAIVIGRSSQNNSLYREDLATYSKDDIFNHKQAEGFIYMWGMSNKIWAELNSKKNK

SEQ ID NO: 5615 - DNA, 1203 bp, Prochlorococcus marinus
  CDS (1)..(1203): transl_table=11
atgggaaaggctaacaaagttgttttggcttattcaggaggggtcgatactagtgtttgtattccttacttgaaggaggagtatggagtcgagcatgtaattgcttttgccgcagatcttggacaaggtgatgagctggatgaaatcaaaaaaaaggctatctcagcaggagcttcacaatcactaattggcaatttagtaaagccttttattgaagattttgcctttccagcaattcggtctaatgctttgtatcaaggaagatatcctctttcaactgcattagctagaccattaattgcaaaaaaacttgttgaaattgcaagagaattaaatgctgatggagtcgctcacgggtgtacgggtaaagggaacgatcaagttcgctttgatgtgacaattggagctttagctcctgatttgcaattgcttacaccagcgcgtgaatggggtatgagccgcgaagaaactattgcctatggagaaaaatatggaatagttcctcctgtaagtaaaaaaaatccctactcgattgatttgaatcttttggggagaagtattgaagccggtcctcttgaagatccatttcagatgccatcagaagaggtttttggcatcacttcctctattgctgattcaccaaacgagcctgagatagcagatattttgtttgaaaatggttatccagttgcaattaatggagaagaaatggagccagtatctttgatcaaaaaagctaatagccttgcaggaaagcatggttttggacgtttggatattattgaagacagagtagtgggaattaaaagtcgagaaatttatgaaactccaggattgcttttattaattaaagctcatcaggaaattgagagtttaactttacccgctgacttattagatactaaatctagactggaacgacaatgggcagacttggtttataaaggtttttggtttagtcctctaaaagaagctttggatggatttattaattattctcagaagcaagtcaatggaacagtcagggttaggctttttaagggtaatgtcgatgttattggtcgtaagtcaaaagaaaatagtttgtatatttcagatatgtctacttatggaagtgaggataagttcaatcacaaatccgctgaaggatttatatatgtatggggattgccaagtcgaatttggtcttggataaacaagtaa

SEQ ID NO: 5616 - protein, 400 aa, Prochlorococcus marinus
MGKANKVVLAYSGGVDTSVCIPYLKEEYGVEHVIAFAADLGQGDELDEIKKKAISAGASQSLIGNLVKPFIEDFAFPAIRSNALYQGRYPLSTALARPLIAKKLVEIARELNADGVAHGCTGKGNDQVRFDVTIGALAPDLQLLTPAREWGMSREETIAYGEKYGIVPPVSKKNPYSIDLNLLGRSIEAGPLEDPFQMPSEEVFGITSSIADSPNEPEIADILFENGYPVAINGEEMEPVSLIKKANSLAGKHGFGRLDIIEDRVVGIKSREIYETPGLLLLIKAHQEIESLTLPADLLDTKSRLERQWADLVYKGFWFSPLKEALDGFINYSQKQVNGTVRVRLFKGNVDVIGRKSKENSLYISDMSTYGSEDKFNHKSAEGFIYVWGLPSRIWSWINK

SEQ ID NO: 5617 - DNA, 1218 bp, Pseudomonas syringae pv
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgagccggcgcgcgccaaggctcaggccatgggcgtgaaagaaatctacatcgatgacctgcgcgaagaattcgtgcgtgatttcgtgttcccgatgttccgtgccaacaccgtctatgaaggcgagtacctgctgggcacttccatcgctcgcccgctgatcgccaagcgcctgatcgagatcgccaacgaaaccggcgctgatgccatttcccatggtgccaccggcaaaggcaacgatcaggtgcgtttcgaattgggcgcctacgcgctcaagccaggggtcaaagtgattgctccgtggcgtgaatgggacctgctgtctcgtgaaaagctgatggactacgccgagaagcacaacattccgatcgagcgtcacggcaagaagaaatccccgtactcgatggatgccaatctgctgcacatctcctatgagggcggcgtgctggaagacacctggaccgagcacgaagaagacatgtggcgctggaccaagtcccctgaggacgcgccgaacgttgcaacttatctggagctgacctaccgcaatggcgacatcgttgcgctggacggcgttgagatgacgcctgccactgtgttggcgaccctgaaccgcatcggtggcgaaaacggcatcggacgtctggatatcgttgaaaaccgctacgtgggcatgaagtcccgtggctgctacgagacaccgggcggcaccatcatgctgcgcgctcaccgcgccattgaatcgatcaccctggaccgtgaagtcgcccacctcaaggacgaactgatggccaagtacgccagcctgatctacaccggttactggtggagcccggagcgtcttatgctgcagcagatgatcgacgcgtctcaggcccatgtgaacggtgttgtacgtctgaagctttataagggcaatgtgatcgtcaccggtcgcaagtcggacgattcattgttcgatgccaatattgctacctttgaagatgacgcaggcgcctatgatcaggctgatgcggcaggcttcataaagctcaatgccttgcgtatgcgtattgctgcgaataaaggccgcaagctgttctga

SEQ ID NO: 5618 - protein, 405 aa, Pseudomonas syringae pv
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVEMTPATVLATLNRIGGENGIGRLDIVENRYVGMKSRGCYETPGGTIMLRAHRAIESITLDREVAHLKDELMAKYASLIYTGYWWSPERLMLQQMIDASQAHVNGVVRLKLYKGNVIVTGRKSDDSLFDANIATFEDDAGAYDQADAAGFIKLNALRMRIAANKGRKLF

SEQ ID NO: 5619 - DNA, 1218 bp, Pseudomonas aeruginosa
  CDS (1)..(1218): transl_table=11
atggcggatgtgaagaaggtagtcctggcgtattccggcggcctggatacctcggtaattctgaagtggttgcaagatacctataactgcgaagtggtgaccttcaccgccgacctcggccagggcgaggaagtcgaaccggctcgcgccaaggcccgcgcgatgggcgtcaaggaaatctacatcgacgacctgcgcgaagaattcgtccgcgacttcgtctacccgatgttccgcgccaacaccgtctacgaaggcgagtacctgctgggcacctccatcgctcgtccgctgatcgccaagcgcctgatcgagatcgccaacgagaccggcgccgacgccatctcccacggcgccaccggcaagggcaacgaccaggtccgcttcgagctgggcgcctacgcgctgaagcccggcgtcaaggtgatcgcgccctggcgcgagtgggacctgctgtcccgcgagaagctgatggactatgccgagaagcacggcatcccgatcgagcgccacggcaagaagaagtcgccgtactcgatggacgccaacctcctgcatatctcctacgaagggggcgtgctggaagatacctggaccgagcacgaagaagacatgtggaagtggaccgcttccccggaaaacgcgccggacaccccgacctacatcgagctgacctaccgcaagggcgacatcgtcgccatcgacggcaaggacatgaccccggccgaggtgctcaccgagctgaaccgcgtcggcgggatcaacggcatcggccgcctcgacatcgtcgagaaccgctatgtcggcatgaagtcccgtggctgctacgagacccccggcggcaccatcatgctcaaggcccaccgcgccatcgagtcgatcaccctggaccgcgaagtggcccacctgaaagacgagctgatgcccaagtacgccagcctgatctacaccggctactggtggagcccggagcgcctgatgctgcagcagatgatcgacgcctcgcaggtcaacgtgaacggcgtagtgcgcctgaagctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctga

SEQ ID NO: 5620 - protein, 405 aa, Pseudomonas aeruginosa
MADVKKVVLAYSGGLDTSVILKWLQDTYNCEVVTFTADLGQGEEVEPARAKARAMGVKEIYIDDLREEFVRDFVYPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWKWTASPENAPDTPTYIELTYRKGDIVAIDGKDMTPAEVLTELNRVGGINGIGRLDIVENRYVGMKSRGCYETPGGTIMLKAHRAIESITLDREVAHLKDELMPKYASLIYTGYWWSPERLMLQQMIDASQVNVNGVVRLKLYKGNVVVVGRKSDDSLFDANIATFEEDGGAYNQADAAGFIKLNALRMRIAANKGRTLS

SEQ ID NO: 5621 - DNA, 1218 bp, Pseudomonas fluorescens
  CDS (1)..(1218): transl_table=11
atggcggacgttaacaaggtcgttctggcgtattcgggcggcctggacacttcggtgatcctcaagtggctgcaggatacttacaactgtgaagtagtgactttcactgctgacctgggccaaggcgaagaggtcgagccggcccgcgccaaggcgcaagccatgggcgtcaaagagatctatatcgacgatctgcgcgaagagttcgtgcgtgatttcgtcttcccgatgttccgcgccaacaccgtctacgaaggcgagtacctgctgggtacttccatcgctcgtccgttgatcgccaagcgcctgatcgaaatcgccaacgaaaccggcgccgacgccatttcccatggcgccaccggcaagggcaacgatcaggtgcgtttcgaactgggcgcctacgccctcaagccgggtgtgaaggtgattgccccttggcgcgagtgggacctgctgtcccgcgagaagctgatggactacgccgagaagcacgggatcccgatcgagcgtcacggcaagaagaaatccccgtactcgatggatgccaacctgctgcacatctcctatgaaggtggcgtgctggaagacacctggaccgagcacgaagaagacatgtggcgctggactgtctccccggagaaggccccagataccccgcaatacctggaactgacctaccgcaacggcgatatcgtggcactggacggcgtcgagatgaccccggccaccgtgctggcgaccctgaaccgcatcggtggcgaacacggtatcggtcgtctggacatcgtcgagaaccgttacgtgggcatgaagtcccgcggctgctatgagacacctggcggcaccatcatgctgcgtgctcaccgcgccatcgagtccatcaccctggaccgcgaagtggctcacctcaaagacgagctgatgcccaagtacgccagcctgatctacaccggctactggtggagccctgagcgtctgatgctgcaacagatgatcgacgcctcccaggcccacgtgaatggtgtggtacgcctgaagctgtacaagggcaatgtgatcgtgaccggtcgcaagtctgacgagtcgctgttcgacgccaacatcgctaccttcgaagaggacggcggtgcctacaaccaggcggacgcagctggcttcatcaagctcaacgccctgcgcatgcgcattgccgcgaacaagggtcggaccctggtctga

SEQ ID NO: 5622 - protein, 405 aa, Pseudomonas fluorescens
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWRWTVSPEKAPDTPQYLELTYRNGDIVALDGVEMTPATVLATLNRIGGEHGIGRLDIVENRYVGMKSRGCYETPGGTIMLRAHRAIESITLDREVAHLKDELMPKYASLIYTGYWWSPERLMLQQMIDASQAHVNGVVRLKLYKGNVIVTGRKSDESLFDANIATFEEDGGAYNQADAAGFIKLNALRMRIAANKGRTLV

SEQ ID NO: 5623 - DNA, 1218 bp, Pseudomonas fluorescens
  CDS (1)..(1218): transl_table=11
atggcggacgtaaacaaggtcgttctggcgtattccggcggcctggacacttcggtgatcctcaagtggctgcaggatacttataactgtgaagtcgtgaccttcaccgctgacctgggtcagggcgaagaggtcgagccggctcgcgccaaggcgcaggccatgggcgtcaaagaaatctacatcgacgacctgcgcgaagaattcgtgcgtgacttcgtgttcccgatgttccgcgccaacaccgtttacgaaggcgagtacctgctgggtacttccattgcgcgtccgctgatcgccaagcgtctgatcgaaatcgccaacgaaaccggcgccgacgccatttcccacggcgcaaccggcaagggcaacgaccaggtgcgtttcgaactgggtgcctacgcgctcaagccaggcgtgaaagtgatcgccccttggcgcgagtgggacctgctgtcccgcgagaaactgatggactacgccgagaagcacgcgatcccgatcgagcgtcacggcaagaagaaatccccgtactcgatggacgccaacctgctgcacatctcctatgaaggcggcgtgctggaagacacctggaccgagcacgaagaagacatgtggcgctggaccgtctccccggagaaggctcccgacaccccgcaatacctggaactgacctaccgcaacggcgacatcgtcgcgctggacggcgtcgaaatgactccggccaccgtactggcgaccctgaacaggatcggtggcgagcacggcatcggccgtctggacatcgtcgagaaccgttatgtcggcatgaagtcccgtggctgctacgaaaccccgggcggcaccatcatgctgcgcgctcaccgcgccatcgaatcgatcaccctggaccgcgaagtcgctcacctcaaagacgagctgatgccgaagtacgccagcctgatctacaccggttactggtggagccctgagcgtctgatgctgcaacagatgatcgacgcttctcaggtcaacgtgaacggcgttgtgcgccttaagctgtacaagggcaacgtgatcgtgaccggccgcaagtccgacgattcgctgttcgacgccaacatcgcgaccttcgaagaagacggcggcgcctacaaccaggccgacgcggcgggcttcatcaagctcaacgcactgcgcatgcgtattgctgccaacaagggccgcaagttgttctaa

SEQ ID NO: 5624 - protein, 405 aa, Pseudomonas fluorescens
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHAIPIERHGKKKSPYSMDANLLHISYEGGVLEDTWTEHEEDMWRWTVSPEKAPDTPQYLELTYRNGDIVALDGVEMTPATVLATLNRIGGEHGIGRLDIVENRYVGMKSRGCYETPGGTIMLRAHRAIESITLDREVAHLKDELMPKYASLIYTGYWWSPERLMLQQMIDASQVNVNGVVRLKLYKGNVIVTGRKSDDSLFDANIATFEEDGGAYNQADAAGFIKLNALRMRIAANKGRKLF

SEQ ID NO: 5625 - DNA, 1218 bp, Pseudomonas putida
  CDS (1)..(1218): transl_table=11
atggcggacgtaaaaaaggtcgtactggcgtattccggcggccttgatacttcggtgattctcaagtggctgcaggatacctacaactgcgaagtggtgaccttcaccgctgacctggggcagggcgaagaggtcgaaccggcccgtgccaaggcccaggcaatgggcgttaaagagatctacatcgacgacctgcgcgaagaattcgtgcgtgatttcgtgttcccgatgttccgcgccaacaccgtctacgaaggcgagtacctgctgggtacttccatcgcccgtccgctgatcgccaagcgcctgatcgaaatcgccaacgaaaccggcgctgacgccatttcccatggcgccaccggcaagggtaacgaccaggtgcgcttcgagctgggtgcctatgccctgaagccaggcgtcaaggtcatcgctccatggcgcgagtgggacctgctgtcccgcgaaaagctgatggactacgccgagaagcacggcatcccgatcgagcgccacggcaagaagaagtcgccgtactcgatggacgccaacctgctgcacatctcctacgagggcggtgtcctggaagatacctggaccgagcacgaagaagacatgtggcgctggagtgtctcgcctgagaatgccccggaccaggctacctacatcgagctgacctaccgcaatggtgacatcgttgccatcgacggcgtcgagaaatccccggccaccgtcctggcagacctgaaccgtatcggtggtgccaacggcatcggccgtctggacatcgtcgaaaaccgttacgtcggcatgaagtcgcgcggttgctacgaaacgcctggcggtaccatcatgctcaaggcacaccgtgccatcgagtcgatcaccctggaccgcgaagtcgctcacctgaaagatgagctgatgccaaagtatgccagcctgatctacaccggctactggtggagcccggagcgtctgatgctgcaacagatgatcgatgcttcgcaggtcaacgtgaatggtgtggtgcgcctgaaactgtacaagggcaacgtgaccgtggttggccgcaagtcggacgattcgctgttcgatgccaacatcgccacctttgaagaagatggtggtgcctacaaccaggcagatgctgctggcttcatcaagctcaatgcactgcgtatgcgcattgccgccaacaagggccgttcgctgctctga

SEQ ID NO: 5626 - protein, 405 aa, Pseudomonas putida
MADVKKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWRWSVSPENAPDQATYIELTYRNGDIVAIDGVEKSPATVLADLNRIGGANGIGRLDIVENRYVGMKSRGCYETPGGTIMLKAHRAIESITLDREVAHLKDELMPKYASLIYTGYWWSPERLMLQQMIDASQVNVNGVVRLKLYKGNVTVVGRKSDDSLFDANIATFEEDGGAYNQADAAGFIKLNALRMRIAANKGRSLL

SEQ ID NO: 5627 - DNA, 1218 bp, Pseudomonas syringae pv
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgaaccggcacgcgccaaggctcaggccatgggcgtgaaagaaatctacatcgatgacctgcgcgaagagttcgtgcgcgatttcgtgttcccgatgttccgtgccaataccgtctatgaaggcgagtacctgctgggcacttccattgctcgtccgctgattgccaagcgtctgatcgagatcgccaacgaaaccggcgctgacgccatttcccacggcgcaaccggtaaaggcaatgaccaggtacgtttcgagctgggcgcctacgcgctcaagccgggcgtcaaggtgattgctccgtggcgtgaatgggacctgctgtcgcgcgaaaagctgatggattacgccgagaagcacaatattccgatcgagcgtcacggcaagaagaaatccccgtactcgatggatgccaacctgctgcacatctcctatgaaggcggcgtgctggaagacacctggaccgagcacgaagaagacatgtggcgctggaccaagtcccctgaggacgcgccgaacgttgcaacctacctcgagctgacctatcgcaatggcgacatcgtcgctctggacggcgtcgacatgaccccggctaccgtactcgctaccctgaaccgcattggcggcgaaaacggtatcggtcgtctggacatcgttgaaaaccgttacgtgggcatgaagtcccgtggttgctacgaaaccccgggcggcaccatcatgctgcgtgctcaccgcgccatcgaatcgatcaccctggaccgcgaagtcgcccacctcaaggacgaattgatggtcaagtacgccagcctgatctacacaggttactggtggagccctgagcgtctgatgctgcaacagatgatcgacgcgtcccaggtgcacgtgaacggtgttgtgcgtctgaagctgtataaaggcaacgtgatcgttactggccgcaagtccgacgattcactgttcgacgccaacatcgccacctttgaagacgacgcaggtgcctacgatcaggccgatgcagcgggcttcatcaagctgaatgcgttgcgcatgcgtatcgctgcaaacaaaggccgcaagctgttctga

SEQ ID NO: 5628 - protein, 405 aa, Pseudomonas syringae pv
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVDMTPATVLATLNRIGGENGIGRLDIVENRYVGMKSRGCYETPGGTIMLRAHRAIESITLDREVAHLKDELMVKYASLIYTGYWWSPERLMLQQMIDASQVHVNGVVRLKLYKGNVIVTGRKSDDSLFDANIATFEDDAGAYDQADAAGFIKLNALRMRIAANKGRKLF

SEQ ID NO: 5629 - DNA, 1218 bp, Pseudomonas syringae pv
  CDS (1)..(1218): transl_table=11
atggcggacgtaaacaaggtagttctcgcgtattccggtggcctggatacttcggtaatcctcaagtggctgcaagatacgtacaactgcgaagtggtgacctttaccgctgacctgggtcagggtgaagaagtcgagccggcacgcgccaaggctcaggccatgggcgtgaaagaaatctacatcgatgacctgcgcgaagagttcgtgcgcgatttcgtcttcccgatgttccgtgccaacactgtctatgaaggcgagtacctgctgggtacctccatcgcccgtccgttgatcgccaaacgtctgatcgagatcgccaacgaaaccggcgctgacgccatttcccacggcgcaaccggcaagggtaacgaccaggtacgtttcgagctgggtgcctacgcgctcaagccaggcgtcaaggtcatcgctccgtggcgcgaatgggatctgctgtcgcgtgagaaactgatggactacgccgagaagcacaacattcccattgagcgtcacggcaagaagaaatctccgtactccatggacgccaacctgctgcacatctcttatgaaggcggcgtgctggaagacacctggaccgagcacgaagaagacatgtggcgctggaccaagtcccctgaggacgcgccaaacgttgcgacctaccttgagctgacctatcgcaatggcgacatcgttgccctggatggtgtcgaaatgaccccggccactgtgctcgcgaccctgaaccgcatcggtggcgaaaacggtatcggccgtctggatatcgttgaaaaccgttatgtgggcatgaagtcccgtggctgctacgagacgcctggtggcaccatcatgctgcgtgctcaccgtgccatcgagtcgatcaccctggaccgcgaagtcgcccacctcaaggacgaactcatggccaagtatgccagcctgatctacacaggttactggtggagccctgagcgcctgatgctgcagcagatgatcgacgcgtcccaggttcacgtgaacggcgttgtgcgtctgaagttgtacaagggcaatgtgatcgtcaccggtcgcaagtcggatgattcgctgttcgacgccaacattgccaccttcgaagacgacgcaggtgcctacgatcaggccgatgcagcgggcttcatcaagctcaacgcattgcgcatgcggattgccgccaacaagggccgcaagctgttctga

SEQ ID NO: 5630 - protein, 405 aa, Pseudomonas syringae pv
MADVNKVVLAYSGGLDTSVILKWLQDTYNCEVVTFTADLGQGEEVEPARAKAQAMGVKEIYIDDLREEFVRDFVFPMFRANTVYEGEYLLGTSIARPLIAKRLIEIANETGADAISHGATGKGNDQVRFELGAYALKPGVKVIAPWREWDLLSREKLMDYAEKHNIPIERHGKKKSPYSMDANLLHISYEGGVLEDTWTEHEEDMWRWTKSPEDAPNVATYLELTYRNGDIVALDGVEMTPATVLATLNRIGGENGIGRLDIVENRYVGMKSRGCYETPGGTIMLRAHRAIESITLDREVAHLKDELMAKYASLIYTGYWWSPERLMLQQMIDASQVHVNGVVRLKLYKGNVIVTGRKSDDSLFDANIATFEDDAGAYDQADAAGFIKLNALRMRIAANKGRKLF

SEQ ID NO: 5631 - DNA, 1233 bp, Pyrococcus furiosus
  CDS (1)..(1233): transl_table=11
gtgagaatagtgttggcttattcaggtggattggatacttcggtgatactaaaactaatgcaggaaaagctgggagctgaagtaataactgttactgttgatgttgggcagaaggatgacttcgaaaaaatagaagagaaggcctacaagtttggtgccgtgaagcactactacatagatgccaaggaggaattcgccgagaactatgtttgtaaagctataaaagcaaatgctctttacgaaaatgcgtatcctctttcaacggccctagctaggcctcttatagtagaaaagttagttgaggttgcaaagaaggagggggctggaataatagctcatggttgtacaggaaagggaaatgatcaggtgcgctttaacctaggaattaaggccttgatgcctgaggctgaaattctccagccagtagctgagtggaaccttacaagggattgggaaatggagtatgcaaagaagcatggaattcctgtaagtgacaagatatatagcatagatgaaaacatctggggaaggagcattgaaggtggggtacttgaagatccatcaatagaacctccagaagaggtctttgaatggacagtatctatagaaaaagctccagacaaaccagaatatgtgactattggctttgaaaatggagttccagtttcacttaatggggaaaaaatgaagcttctcgagctaattctaaagctcaacgaaatcgctggtaagcatggggttggaaggattgaccatattgaggataggagtgttgggattaagagcagggaggtttatgaagcccctgcggctgttactctaataaaggctcatcaggacttagaaaagttaactttaacaaagtgggttatagaattcaagagtatagtggactctaagtggtcttggcttgtatataatggcctatggtatgaaccacttaggttagccttagaagggttcatagatgaagctgaaaaggctgtcaacggcgaagttacagtcaagctgtggaaaggaaatgcaattgtcgttggaaggaaatcggacaatgccctctacgatgtaaagatggcaacttatgaaaagttcagcacatttgatcagaagcttgcaaagggattcatagagctctttggaatgcagagtgttctagcttataatatgcttcatggagtccactccacctcaaatatttcggaaattaaagaggcaataaagactttggagtga

SEQ ID NO: 5632 - protein, 410 aa, Pyrococcus furiosus
MRIVLAYSGGLDTSVILKLMQEKLGAEVITVTVDVGQKDDFEKIEEKAYKFGAVKHYYIDAKEEFAENYVCKAIKANALYENAYPLSTALARPLIVEKLVEVAKKEGAGIIAHGCTGKGNDQVRFNLGIKALMPEAEILQPVAEWNLTRDWEMEYAKKHGIPVSDKIYSIDENIWGRSIEGGVLEDPSIEPPEEVFEWTVSIEKAPDKPEYVTIGFENGVPVSLNGEKMKLLELILKLNEIAGKHGVGRIDHIEDRSVGIKSREVYEAPAAVTLIKAHQDLEKLTLTKWVIEFKSIVDSKWSWLVYNGLWYEPLRLALEGFIDEAEKAVNGEVTVKLWKGNAIVVGRKSDNALYDVKMATYEKFSTFDQKLAKGFIELFGMQSVLAYNMLHGVHSTSNISEIKEAIKTLE

SEQ ID NO: 5633 - DNA, 1338 bp, Ralstonia solanacearum
  CDS (1)..(1338): transl_table=11
atggaaaccatcctgcaacacgttcccgtcggccagaaggtcggcatcgccttctccggcggcctggacaccagcgcggccctgcgctggatgaagaacaagggcgccctgccctatgcctacaccgccaatctcggccagcccgacgaggaagactacgatgccatcccccgcaaggccctggaatacggtgcagagaaggctcgcctgatcgactgccgcccgcaactggccaatgaaggcattgccgccatccaggccggcgccttccacatcagcaccggcggcatcacctacttcaacaccacgccgttgggccgcgccgtgaccggcaccatgctggtggccgccatgaaggaagacgacgtccacatctggggcgacggctccaccttcaagggcaatgacatcgagcgcttctaccgctacggcctgctgaccaacccggccctgaagatctacaagccgtggcttgaccagaccttcatcgacgagctgggcggccgcgccgaaatgtcggccttcatgacgaaggaaggtttcggctacaagatgagcgccgaaaaggcctactccaccgactccaacatgctgggcgccacccacgaggccaaggacctggagcatctgaacagcggcatccgcatcgtcaacccgatcatgggcgtggcgttctggaagcctgaagtcgaagtcaaggccgaagaggtttcgatcaccttcgacgaaggccgccccgtggccgtcaacggccgcgaaattgccgacccggtggagatgttcctggagctgaaccgcatcggcggccgccacggcctgggcatgagcgaccagatcgaaaaccgcatcatcgaagccaagagccgcggcatctacgaagccccgggcatggcgttgctgcacatcgcctacgagcgcctggtcaccggcatccacaacgaggacaccatcgagcagtaccgcatcaatggcctgcgcctaggccgcctgctgtaccagggccgctggttcgacccgcaggccatcatgctgcgcgaaaccgcccaacgctgggtggcccgcgccgtgaccggtaccgtgacgctggagctgcgccgcggcaacgattactccatcctgaacaccgagtcgcccaacctgacctacgcgcccgagcgcctgtcgatggaaaaggtcgaagacgcaccgttcagcccggccgaccgcatcggccagctgaccatgcgcaacctggacctgatggacacccgcgacaagctggccatctactccaaggccggcctgctgtccctgggcaccagcagcgcgctgccccagctcggcggcgacaagaagtaa

SEQ ID NO: 5634 - protein, 445 aa, Ralstonia solanacearum
METILQHVPVGQKVGIAFSGGLDTSAALRWMKNKGALPYAYTANLGQPDEEDYDAIPRKALEYGAEKARLIDCRPQLANEGIAAIQAGAFHISTGGITYFNTTPLGRAVTGTMLVAAMKEDDVHIWGDGSTFKGNDIERFYRYGLLTNPALKIYKPWLDQTFIDELGGRAEMSAFMTKEGFGYKMSAEKAYSTDSNMLGATHEAKDLEHLNSGIRIVNPIMGVAFWKPEVEVKAEEVSITFDEGRPVAVNGREIADPVEMFLELNRIGGRHGLGMSDQIENRIIEAKSRGIYEAPGMALLHIAYERLVTGIHNEDTIEQYRINGLRLGRLLYQGRWFDPQAIMLRETAQRWVARAVTGTVTLELRRGNDYSILNTESPNLTYAPERLSMEKVEDAPFSPADRIGQLTMRNLDLMDTRDKLAIYSKAGLLSLGTSSALPQLGGDKK

SEQ ID NO: 5635 - DNA, 1224 bp, Rhizobium loti
  CDS (1)..(1224): transl_table=11
atgtccaagaccaaagacgtcaagaaagtcgtgctcgcctattccggcggcctcgacacatccatcatcctgaaatggctgcagaccgaactcggcgccgaagtcgtcaccttcaccgccgatctcggccagggtggcgagttggagccggcacgcaagaaggccgagatgatgggcatcaaggacatccgcatcgtcgatgtgcgggaggaattcgtcgccgacttcgtcttcccgatgttccgtgccaacaccgtctatgaaggcacctatctgctcggcacctcgatcgcgcggccgctgatctccaagcaccttgtcgacatcgccagggagaccggcgccgatgcgatcgcccatggcgccaccggcaagggcaacgaccaggtccgcttcgagctgtcggcctatgcgctgaaccccgatatcaaagtcatcgcgccctggcgcgactggtcgttcaagtcgcgcaccgacctgatcaacttcgccgagcagcaccagatcccggtggccaaggacaaaaggggcgaggcgccgttctcggtcgacgccaacctgctgcactcctcttccgagggcaaggtgctggaagatccgtggagcgagccgccggaattcgtccaccagcgcacggtctcgccgatggacgcgccggacaaggtaaccgagatcgagatcgagttcctgaagggcgacccgatcgcgctcaacggcaagaagctgtcgccggcgaccatgctggccgccctcaacgatcttggccgcgacaacggcatcggccggctcgacctggtcgagaaccgtttcgtcggcatgaaatcgcgcggcgtctacgagacgccaggcggcgccatcctgatcgtggcccaccgcgccatcgaatcgatcacgctcgaccgcggcgccgcgcacctcaaggacgagttcatgccgcgctacgccgagctcatctacaacggcttctggttctcgcccgagcgcctgatgctgcaggcgatgatcgacaagagccaggaagacgtcgaaggcacggtacggttgaagctctacaagggcaatgtcatggtcaccggccgcaagtcgaagaagacgctctattccgacgcgctggtcaccttcgaggacgatcgcggcgcctacgaccagaaggacgccgccggcttcatccgcctcaatgcgctgaggctgcgcacgctggctgcgcgcaaccgcaagggctga

SEQ ID NO: 5636 - protein, 407 aa, Rhizobium loti
MSKTKDVKKVVLAYSGGLDTSIILKWLQTELGAEVVTFTADLGQGGELEPARKKAEMMGIKDIRIVDVREEFVADFVFPMFRANTVYEGTYLLGTSIARPLISKHLVDIARETGADAIAHGATGKGNDQVRFELSAYALNPDIKVIAPWRDWSFKSRTDLINFAEQHQIPVAKDKRGEAPFSVDANLLHSSSEGKVLEDPWSEPPEFVHQRTVSPMDAPDKVTEIEIEFLKGDPIALNGKKLSPATMLAALNDLGRDNGIGRLDLVENRFVGMKSRGVYETPGGAILIVAHRAIESITLDRGAAHLKDEFMPRYAELIYNGFWFSPERLMLQAMIDKSQEDVEGTVRLKLYKGNVMVTGRKSKKTLYSDALVTFEDDRGAYDQKDAAGFIRLNALRLRTLAARNRKG

SEQ ID NO: 5637 - DNA, 1218 bp, Rhizobium meliloti
  CDS (1)..(1218): transl_table=11
atggcatcgcataaagacgtgaagaaggtcgttctcgcctattccggcggtctcgacacctcgatcatcctcaaatggctgcagacggaactgggcgccgaagtggtgaccttcaccgcggacctcggccagggcgaagaactggagccggcgcgcaagaaggcggagatgctcggcatcaaggagatctatatcgaggacgtccgcgaggaattcgtgagggacttcgtgttcccgatgttccgcgccaatgccgtctatgaaggcgtctacctgctcggcacctccatcgcccgtccgctgatctccaaacacctcatcgatatcgccaggaagaccggcgccgacgcgatcgcccatggcgcgaccggcaagggcaacgaccaggtccgcttcgaactttcggcttacgcgctcaatccggacatcaagatcatcgccccctggcgcgactggtcgttcaagagccgcaccgatctgctcgaattcgccgagaagcaccagattccggtcgccaaggacaagaagggcgaggcgcctttctccgtcgacgccaacctcctgcactcctcctcggaaggaaaagtgctggaggacccggcccgggaagctcccgaatacgtgcacatgcgcaccatttcgccggaagcggcacctgacaaggcaaccgtcatcaaggtcggcttcgaacgtggcgatgccgtgtcgatcgacggggtacgcatgtcgccggcaacgcttcttgcgaagctcaacgaatacggccgcgacaacggcatcggccgcctggacctcgtcgagaaccgtttcgtcggcatgaagtcgcgcggcgtctacgaaacccccggcggcacgatcctgcttgcggcccatcgtgcgatcgagagcatcacgctcgaccgcggcgcggcgcatctgaaggacgagctgatgccgcgctatgccgagctcatctattacggcttctggttctctccggagcgcgaaatgctgcaggcggcgatcgacaggagccaggagcatgtggaaggcgaagtgacgctgaagctctacaagggcaatgtcatggtcatcggccgcgaaagcggcaagtcgctctattccgacaagctcgtcaccttcgaggacgatcagggcgcctacgaccagaaggatgccgccggcttcatcaagctcaacgcgctgcgtctgcgcacgctggcagcgcgcaaccggtaa

SEQ ID NO: 5638 - protein, 405 aa, Rhizobium meliloti
MASHKDVKKVVLAYSGGLDTSIILKWLQTELGAEVVTFTADLGQGEELEPARKKAEMLGIKEIYIEDVREEFVRDFVFPMFRANAVYEGVYLLGTSIARPLISKHLIDIARKTGADAIAHGATGKGNDQVRFELSAYALNPDIKIIAPWRDWSFKSRTDLLEFAEKHQIPVAKDKKGEAPFSVDANLLHSSSEGKVLEDPAREAPEYVHMRTISPEAAPDKATVIKVGFERGDAVSIDGVRMSPATLLAKLNEYGRDNGIGRLDLVENRFVGMKSRGVYETPGGTILLAAHRAIESITLDRGAAHLKDELMPRYAELIYYGFWFSPEREMLQAAIDRSQEHVEGEVTLKLYKGNVMVIGRESGKSLYSDKLVTFEDDQGAYDQKDAAGFIKLNALRLRTLAARNR

SEQ ID NO: 5639 - DNA, 1335 bp, Rhodopirellula baltica; identical to SEQ ID NO: 5189
  CDS (121)..(1335): transl_table=11

SEQ ID NO: 5640 - protein, 404 aa, Rhodopirellula baltica
MKSCVLAYSGGLDTSVILGWLQDQGYEVHCVYVDLGQPCEDRDAIMEKARTCGAKSSRLVDVREELCRDFAFPVLAWQAKYEQIYLLGTSIARPLISKVCLEVAREVGATAYAHGATGKGNDQCRFQLAAEALDPNIEMIAPWRIKSFRDAFPGRTELIEYCDVKRIPVKASTAKPYSSDENVLHISYEAGKLEELDVNGVELVEFGMGVSPQDAPDKPEEVTIGFESGVPKTLNGKAVNALEMVEQLNDIAGRNGVGRIDMVENRFVGMKSRGVYESPGMTVLYDALMYVEQLTMDRDLMHLRDRMAPEVAEMVYYGFWYTPKMDALMSFIETAQRPVTGEVTLQLYKGNIMVSSRTSPNSLYDEEIATMEGGGSYNQDDAEGFLRIQGLPSRVQGRVSPRKF

SEQ ID NO: 5641 - DNA, 1188 bp, Rhodococcus fascians
  CDS (1)..(1188): transl_table=11
atgagcatcgtcctggcatattccggcggattggacacatccgttgccgtgcactggctcaaagagcgctatcagaccgaggtcatcgcgtactgcgcgaacctcggccaaatcgaggacctcgaggccgtctcgaagcgcgcaaccgcggccggcgcgtcggaagttatcgtcgaagacgtccgagacctgttcctccacgactatgcaatcccggctctcgccgccggcgctgcatacgagggaaaatatcttctggctgcaccgttgtctcgaccgttgatcgccgagcggctggtcagcatcgctcgcgaacgcggtgcatccgcagtcgctcacggtgccacgggcaagggaaacgatcaggtccggttctacacctccgtgcgggcgttggctcccgagctcgacatcctcgcacctgtcatcgattgggaaatgacctcccgcggtagcgaaattgcctacgccgatcgtcacggtatcgatgtgggtgtcagcaagacgacgccgtacagcatcgacaccaatatctggggcaccagcatcgagtgcggggatctcgacctcatcgaccacgctccaccgcccgatgcatggcagatcacgaccgcgccggtgcaggcaccggatcgtccaacaacgatcacgatcgagttcgaagcaggcatccccgtcgctctcgacggccgcaagctcgacctgatcgacctggtcagcgaactcggggacacagcggccgcgaacggtatcgggcgtaccgaaattctcgagagccgcatcgtcggattcaagagccgcggaatctacgaagcacccgctgcaacagttcttctcgctgcacgaaccgatctcgaagcactcgtactggaccgagagacgctccaccacaagcggtccatcgccgaccagtacgcagagttggtctactacggctactggttcaccgatctgcgtgcagcactcgatgcttactgcgcccgtctggctcaccgcgtgacgggcacagtgaccgtcgagctgtacaagggctccgctcgatgcatcggccggacgtccccgaaatacggccgatacagctcggctctggccgattacgaagaggcagacacctttctacacgaagcaggtgccggattcgcgtactgctgggctctcccactcaccgaaggagttgtcactcgatga

SEQ ID NO: 5642 - protein, 395 aa, Rhodococcus fascians
MSIVLAYSGGLDTSVAVHWLKERYQTEVIAYCANLGQIEDLEAVSKRATAAGASEVIVEDVRDLFLHDYAIPALAAGAAYEGKYLLAAPLSRPLIAERLVSIARERGASAVAHGATGKGNDQVRFYTSVRALAPELDILAPVIDWEMTSRGSEIAYADRHGIDVGVSKTTPYSIDTNIWGTSIECGDLDLIDHAPPPDAWQITTAPVQAPDRPTTITIEFEAGIPVALDGRKLDLIDLVSELGDTAAANGIGRTEILESRIVGFKSRGIYEAPAATVLLAARTDLEALVLDRETLHHKRSIADQYAELVYYGYWFTDLRAALDAYCARLAHRVTGTVTVELYKGSARCIGRTSPKYGRYSSALADYEEADTFLHEAGAGFAYCWALPLTEGVVTR

SEQ ID NO: 5643 - DNA, 1227 bp, Rhodobacter sphaeroides
  CDS (1)..(1227): transl_table=11
atgtccgccccgaagaaagtcgtccttgcctattccggcgggctcgacacctcgatcatcctgaagtggctgcagaccgaatatggctgcgaggtcgtgaccttcaccgccgacctcggccagggcgaggagcttgagcccgcccgcgagaaggcggtgatgctgggcatcaagccagaaaacattttcattgaggatgtgcgcgaagagttcgtgcgcgacttcgtcttcccgatgttccgggcgaacgcgctttacgaagggctctatctgctcggcacctcgatcgcgcggccgctgatcgccaagcggctggtcgagatcgcggcccagaccggcgccgacgcggtggcccacggcgccaccggcaagggcaacgaccaggttcgcttcgaactgacggcctatgcgctcgacccggcgatcaaggtgatcgcgccctggcgcgaatgggacctgacttcgcgcacgaaactcctcgaattcgccgaacagaaccagatcccgatcgccaagaacaagcgcggcgaagcgcccttctcggtcgatgcgaacctgctgcacacctcgtccgagggccgcgtgctggagaacccgggcgaggaagccccggattacgtctaccagcgcaccgtcgatcccgagaaggcgcccgacgcgcccgagttcgtggagatcgccttcgagaagggcgatgcggtcgccatcaacggcgaagccatgtcgcccgcgaccatcctcacgaagctcaacgagcttggcggcaagcacggggtgggccgtctcgatctggtggaaaaccgtttcgtcggcatgaagtcgcgcgggatctacgagacgcccggcggcacgatcctgctggaggcccaccgcggcatcgaacagatcacgctcgactcgggcgcaggccacctgaaggattcgatcatgccgcgctatgccgagctgatctacaacggcttctggtacagccccgagcgcgagatgcttcaggcactgatcgacaagtcgcaggaacatgtcaccggcaccgtgcgcgtcaagctttacaagggcttcgcccgcaccgtcgcccgttggtcggagcattcgctttattccgagaagcacgtcaccttcgaggaggatgcgggcgcctacgaccagaaggacgcggccggcttcatccggctgaacgccctgcggctgaagctgatcgcgacacgcaacgcccgcgtgaagggctga

SEQ ID NO: 5644 - protein, 408 aa, Rhodobacter sphaeroides
MSAPKKVVLAYSGGLDTSIILKWLQTEYGCEVVTFTADLGQGEELEPAREKAVMLGIKPENIFIEDVREEFVRDFVFPMFRANALYEGLYLLGTSIARPLIAKRLVEIAAQTGADAVAHGATGKGNDQVRFELTAYALDPAIKVIAPWREWDLTSRTKLLEFAEQNQIPIAKNKRGEAPFSVDANLLHTSSEGRVLENPGEEAPDYVYQRTVDPEKAPDAPEFVEIAFEKGDAVAINGEAMSPATILTKLNELGGKHGVGRLDLVENRFVGMKSRGIYETPGGTILLEAHRGIEQITLDSGAGHLKDSIMPRYAELIYNGFWYSPEREMLQALIDKSQEHVTGTVRVKLYKGFARTVARWSEHSLYSEKHVTFEEDAGAYDQKDAAGFIRLNALRLKLIATRNARVKG

SEQ ID NO: 5645 - DNA, 1200 bp, Rhodococcus sp
  CDS (1)..(1200): transl_table=11
atggccgatcgcgtcgtactcgcctactcgggcgggctggacacctcagtcgccatcagctggatcggcaaggagacgggcaaggaagttgttgctgtcgccatcgatctcggccagggcggcgaggacatggaggtcgtgcgtcagcgtgcactcgactgcggtgcggtcgaatcggtcgtggtggatgcgcgcgacgagttcgccgacgaatactgcctgccgaccatccaggccaacgccctctacatggaccgctacccgctcgtgtcggccatcagccgcccgctgatcgtcaagcacctcgtcgaggccgcgcgtgcccacggcggcaccacggtcgcgcacggctgcaccggcaagggcaacgaccaggtccggttcgaggtcggcttcggatcgctcgcccccgacctcgacgtcatcgcaccggtccgcgactacgcgtggacccgtgagaaggcgatcgcgttcgccgaggagaacgagatcccgatcaacgtctccaagaagtcgccgttctcgatcgaccagaacgtgtggggccgcgccgtcgagaccggcttcctcgaggacctgtggaacgcgcccaccaaggacgtctacgactacacgcaggacccgaccgtcaactggcaggcccccgacgagctgatcatcagcttcgaggccggccgccccgtcgcgatcgacggcaagccggtcagcgtcctcgaagcgatccaggagctcaaccgccgcgcaggcgcacagggcgtcggccgcctcgacgtcgtcgaggaccgtctcgtcggcatcaagagccgtgagatctacgaggctcccggagccatggtcctcatcaacgcccaccaggaactcgagcacgtcacgcaggaacgcgagctcggccgctacaagcgtcagaccgagcagcgctggagcgagctggtgtacgacggcctctggttctccccgctgaaggtcgcgctggacacgttcatcgagaagacgcaggaacgcgtctccggcgacatccggctggtgctgcacggcggtgcgatcatcgtcaacggccgccgcagcaacgagtccctgtacgacttcaacctggccacctacgacgagggcgacacgttcgaccagtcctacgccaagggcttcgtgcagatccacggactgtcctcgaaggtcgcggcgaagcgcgatctgggcctctag

SEQ ID NO: 5646 - protein, 399 aa, Rhodococcus sp
MADRVVLAYSGGLDTSVAISWIGKETGKEVVAVAIDLGQGGEDMEVVRQRALDCGAVESVVVDARDEFADEYCLPTIQANALYMDRYPLVSAISRPLIVKHLVEAARAHGGTTVAHGCTGKGNDQVRFEVGFGSLAPDLDVIAPVRDYAWTREKAIAFAEENEIPINVSKKSPFSIDQNVWGRAVETGFLEDLWNAPTKDVYDYTQDPTVNWQAPDELIISFEAGRPVAIDGKPVSVLEAIQELNRRAGAQGVGRLDVVEDRLVGIKSREIYEAPGAMVLINAHQELEHVTQERELGRYKRQTEQRWSELVYDGLWFSPLKVALDTFIEKTQERVSGDIRLVLHGGAIIVNGRRSNESLYDFNLATYDEGDTFDQSYAKGFVQIHGLSSKVAAKRDLGL

SEQ ID NO: 5647 - DNA, 1230 bp, Rubrobacter xylanophilus
  CDS (1)..(1230): transl_table=11
atgctgggaggcaagaaggtcgtgctggcgtactctggcgggctggacacctcggtgtgcctgaagtggttcgaggagcagggcgcggagccgtacgccctgtacctggacctcggccagggcgagccggcggaggacgtgcgggagaaggccctgcggataggcgcccgggaggtcttcgtgtgggacgcccgggaggagttcgcccgggactacgtggcgccggccataaaggccaacgccctctacggcgggcgctacccgctctttaccgcgctggggcggccgctcatcgccaagaagctcgtggaggcggcccggagggttggcgccacccacatcgcccacggctccaccggcaagggcaacgaccaggtgcgcttcgacgtcaccaccggctccctcgcgccggacctcacggtggtcgccccggtgcgcgactggaacatgaaccgccccgaggagatcgagtacgccagaaagcacggcataccggtgccggtgacgaaggagtccccctacagcgtggaccagaacctctggggccgctccatcgaggccgggccgctggaggaccccgagcacgagcccacccccgacgtcttcgagctcaccgcggagccggaggaggcccccgacgagccgcgctacgtggagatcggcttcgagcggggcctcccgacgagcctcgacggggaaaagctgccgctcgtggagctcatcgaccggctgaacgccatcgccggggagcacggggtcgggcgggtggacatgatcgaggaccgcctggtgggcataaagagccgtgagatctacgaggcccccgcggccctcgtcatcatccaggcccaccgcgagctggagagcctcaccctcacgaaggacgtcctgcgcttcaagcccgccgtcgagcagcgcttcgccgagctgacctacgacggcctctggttcaccccgctcaagagcgccctcgacgccttcgtcgaggagacccagaggaccgtgaccggctccgtgcgcctgaagctctacaaaggctcctccaccgtcgcgggtcgcagcgcgccccgcgccctctacagcaaagacctcgccacctacgacccggagagcaccttcgacgagtccgccgccgccggctttatagccctctgggggctccccgcccgccgctgggccaccgtgaaccccgacccctcgcaggccccgcaaccggcctcccggagatga

SEQ ID NO: 5648 - protein, 409 aa, Rubrobacter xylanophilus
MLGGKKVVLAYSGGLDTSVCLKWFEEQGAEPYALYLDLGQGEPAEDVREKALRIGAREVFVWDAREEFARDYVAPAIKANALYGGRYPLFTALGRPLIAKKLVEAARRVGATHIAHGSTGKGNDQVRFDVTTGSLAPDLTVVAPVRDWNMNRPEEIEYARKHGIPVPVTKESPYSVDQNLWGRSIEAGPLEDPEHEPTPDVFELTAEPEEAPDEPRYVEIGFERGLPTSLDGEKLPLVELIDRLNAIAGEHGVGRVDMIEDRLVGIKSREIYEAPAALVIIQAHRELESLTLTKDVLRFKPAVEQRFAELTYDGLWFTPLKSALDAFVEETQRTVTGSVRLKLYKGSSTVAGRSAPRALYSKDLATYDPESTFDESAAAGFIALWGLPARRWATVNPDPSQAPQPASRR

SEQ ID NO: 5649 - DNA, 1230 bp, Saccharophagus degradans
  CDS (1)..(1230): transl_table=11
atgtctacaaacagttcgatcaaaaaagttgttctagcctattctggcggcttggatacttctgtaattgttaaatggttacaagagacctacaactgtgaagtagtgacctttaccgctgatattggccaaggtgaagaagtggagcccgcgcgtgctaaagccgaagcgttgggtgtgaaagaaatttacattgatgacttgcgcgaagagttcgtacgcgattacgtattcccaatgttccgcgcgaatactatctatgaaggtgaataccttctaggtacctctattgcacgcccacttattgctaagcgcttaattgaaattgccaacgaaactggtgctgatgccatttctcatggtgcgactggtaaaggtaacgatcaggtgcgttttgagctgggtgcatacgcccttaagcctggcattcatgttattgccccatggcgcgattgggatttaacttcccgcgaaacccttatggactactgcgctaagcacaatattcctgttgattacaccaaagcgaagaagaaatcgccttactctatggatgctaacttactgcacatttcttatgaaggcggtattttggaagatccatgggcagaagcagaagaagacatgtggcgctggagtgttagcccagaagctgcgccagatcagcctgaataccttgagcttaccttcaagcacggtgatattgttgccatcgacggcgtagaaatgtctcctgccactgtactcgaaaccttgaacaagcgcggtggtgcacacggcgtgggtcgtttagatatcgtagaaaaccgctatgtaggcatgaagtctcgcggttgttacgaaaccccagggggcaccattatattgcgcgctcacagagcaatcgaatctattactctcgatcgcgaagtggctcaccttaaagattcattaatgcccaagtacgccgaaatgatttataacggttactggtggagcccagagcgtcaaatgttacaaaccgctatcgataactcgcaaggcccagtaaatggcgatgtgcgggttaaattgtataaaggtagcgtaaccgttgtgggtcgtcgttctaacgacagcctatttgacgaaaaaatagcaacattcgaagacgatgctggtgcttacaaccagaaagatgccgaaggctttattaaactcaatgctctgagaatgcgtattgcagctcagaagggacgtaaactgctgtaa

SEQ ID NO: 5650 - protein, 409 aa, Saccharophagus degradans
MSTNSSIKKVVLAYSGGLDTSVIVKWLQETYNCEVVTFTADIGQGEEVEPARAKAEALGVKEIYIDDLREEFVRDYVFPMFRANTIYEGEYLLGTSIARPLIAKRLIEIANETGADAISHGATGKGNDQVRFELGAYALKPGIHVIAPWRDWDLTSRETLMDYCAKHNIPVDYTKAKKKSPYSMDANLLHISYEGGILEDPWAEAEEDMWRWSVSPEAAPDQPEYLELTFKHGDIVAIDGVEMSPATVLETLNKRGGAHGVGRLDIVENRYVGMKSRGCYETPGGTIILRAHRAIESITLDREVAHLKDSLMPKYAEMIYNGYWWSPERQMLQTAIDNSQGPVNGDVRVKLYKGSVTVVGRRSNDSLFDEKIATFEDDAGAYNQKDAEGFIKLNALRMRIAAQKGRKLL

SEQ ID NO: 5651 - DNA, 1410 bp, Salmonella typhimurium
  CDS (67)..(1410): transl_table=11
ttgcataaaaatgcactaaagcagaaaccgatctcattatcagtcaatcaagcagggttctattctatgacgacgattcttaagcatcttccagcaggtcaacgtattggtatcgctttttccggcggtctggacaccagcgccgcgctgctgtggatgcgacaaaaaggagctgtcccatatgcctatactgcgaatctgggacaaccggatgaggatgactatgacgccattcctcgtcgcgcaatggagtatggcgcagagaatgctcgcctgattgattgccgcaagcagttggttgcagaagggatcgcagcgattcagtgcggcgctttccataatacgactggcggactgacctatttcaataccacgccgctgggccgtgccgtaaccggcacgatgctggtcgccgcgatgaaagaagacggcgtgaatatctggggcgacggcagtacctataaaggcaacgatattgaacgtttctatcgttacggcctgctgacgaatgctgaattacagatttacaaaccgtggctggataccgactttatcgatgagctgggtggtcgccatgagatgtctgaatttatgattgcctgcggtttcgactataagatgtcagtcgaaaaagcctactccaccgactccaacatgctcggcgccacgcatgaagcgaaagatctggagtttcttaactccagcgtcaagatcgtcaacccgattatgggcgtgaagttctgggacgagagcgtgaagatcccggcagaagttgtgaccgtccgcttcgagcagggtcaccctgttgccctgaacggtaaaaccttcagcgatgatgttgagatgatgctggaagcgaaccgcatcggcggccgtcacggcctgggtatgagcgaccaaattgaaaaccgcatcattgaagcaaaaagccgcggtatttatgaagcccctgggatggcgctgctgcacatcgcttacgagcgtctgttgaccggtattcacaacgaagacaccattgaacagtatcattctcatggtcgtcagctgggtaaactgctgtatcagggccgctggttcgactcgcaggcgttgatgctgcgtgacggcctgcaacgttgggtcgccagccagattaccggtgaagtgacgctggaactgcgtcgcggcaacgactactccatcctgaacaccgtgtcagacaacctgacctataaggctgagcgtctgaccatggagaaaggcgagtccgtattctcaccggacgatcgtattggccagttgaccatgcgtaatctggacattaccgatacccgcgagaaactgttcggctacgcgaaagcgggtctgttaaccgcctcttccgcgaccggtctgccgcaggttgagaatctggaaaacaaaggcaaataa

SEQ ID NO: 5652 - protein, 447 aa, Salmonella typhimurium
MTTILKHLPAGQRIGIAFSGGLDTSAALLWMRQKGAVPYAYTANLGQPDEDDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEFLNSSVKIVNPIMGVKFWDESVKIPAEVVTVRFEQGHPVALNGKTFSDDVEMMLEANRIGGRHGLGMSDQIENRIIEAKSRGIYEAPGMALLHIAYERLLTGIHNEDTIEQYHSHGRQLGKLLYQGRWFDSQALMLRDGLQRWVASQITGEVTLELRRGNDYSILNTVSDNLTYKAERLTMEKGESVFSPDDRIGQLTMRNLDITDTREKLFGYAKAGLLTASSATGLPQVENLENKGK

SEQ ID NO: 5653 - DNA, 1233 bp, Schizosaccharomyces pombe
  CDS (1)..(1233)
atgccccaagaagtaaaacgttgcgttctcgcctattcaggtggtcttgacacctcctgtatcctcgcctggcttattgaagaaggttgggaggtcatctgctatatggctaatgttggtcaagaggaagattgggatgcagcccgtgaaaaggccttgaaggtgggtgctaagaaggtttacgttgaggacttgcgtgaagagttcatcaatgacaccgtcattcctgctgctcaagctaacgccatttacgaaaatgtttatctcttgggcacttctcttgctcgtcctatcattgctcgccgtcagatccaaatcgccgagaaggaaaactgtatcgctgtctctcacggttgcactggtaagggcaacgatcaagttcgtttcgaattggcatattacgctttgaagccagacgttcaagtcattgctccttggcgtttgcctgtatttttcgagcgcttcgccggtcgtaaggatttgctcgaatatgctgctgctaagggcattcccgttactcaaaccaccaaaaagccttggtctatggatgaaaacattgtacattgctcgtatgaagctggaatcctcgaggatcccagtatgactcctcccaaggacatgtggaagctcaccgttgatcccaaagacgctcctgatgaggttgaagagctcagcattcactttgaaaagggtgctcccaccaaattagagtgcaaggatggtacctttagcggagtcgtttccatcttctaccaattgaacgctatcgctcgtcgtaacggtgttggtcgtatcgatattgttgaaaaccgtttctctggtttgaagagtcgtggttgttacgaaactcctggcttaaccattttgcgtactgctcatatggacttggaaggtttaacaatggaacgtgaagttcgtgctctccgtgaccaattcgttactttcaatctcgctaaaattttgtacaatggacaatttttctctccctgcactcgtatgcttttagcagctaacaacgtttctcaagaggtagtaaacggtgtagttaaactttctgtctacaagggcaatgtcactgtcctcggtcgtaaatctgatactgctcatctttatgacgagaaattgtcatctatggatgagcttggtggatttgaccctacatggacctctggtttcatccaaatcgagtctatgcgtttgcgtaactctgatgaaggaaaacattggatgtaa

SEQ ID NO: 5654 - protein, 410 aa, Schizosaccharomyces pombe
MPQEVKRCVLAYSGGLDTSCILAWLIEEGWEVICYMANVGQEEDWDAAREKALKVGAKKVYVEDLREEFINDTVIPAAQANAIYENVYLLGTSLARPIIARRQIQIAEKENCIAVSHGCTGKGNDQVRFELAYYALKPDVQVIAPWRLPVFFERFAGRKDLLEYAAAKGIPVTQTTKKPWSMDENIVHCSYEAGILEDPSMTPPKDMWKLTVDPKDAPDEVEELSIHFEKGAPTKLECKDGTFSGVVSIFYQLNAIARRNGVGRIDIVENRFSGLKSRGCYETPGLTILRTAHMDLEGLTMEREVRALRDQFVTFNLAKILYNGQFFSPCTRMLLAANNVSQEVVNGVVKLSVYKGNVTVLGRKSDTAHLYDEKLSSMDELGGFDPTWTSGFIQIESMRLRNSDEGKHWM

SEQ ID NO: 5655 - DNA, 1224 bp, Shewanella oneidensis
  CDS (1)..(1224): transl_table=11
atgtctattgagaacaaaaacactggcgtgaaaaaagtcgttttagcctattcgggtggtctagatacttcggccattattccttggttaaaagagaactacgataactgcgaaattattgcgttctgtgctgacgtaggccaaggcgaagaagagctgattggcttgactgaaaaagccttagcctctggcgcatcagaatgccatatcgtcgatctgaaagaagaattcgtaaaagactatatctacccaaccatggcaacgggagcgatttacgaagggacttacttactcggcacctcaatggctcgcccaatcatcgctaaggcgcaggttgaagtggcacgtaaagtgggcgccgatgccctgtgtcacggttgtaccggtaaaggtaacgaccaagtgcgtttcgaaggttgctttgcggcattagcgcctgatttaaaagtgattgccccatggcgtgaatggaccatgcagagccgtgaagatctattggcttacttagctgagcgtaatatcaagacgtcggcttctgccactaagatctacagccgtgatgcaaacgcattccacatctcccatgaaggtggtgagttagaagatccatggaacgagccaagcaaaggtgtgtggacattgactgccgatccagaagatgcgccaaaccaagcagaatatgtgtcattggaagtcgaaaatggtcgtgtgactaaagtgaatggcgaagccttaacgccatatgcggcactgatgaagttgaacgcgattgcggctcctcacggtgtgggtcgtatcgacattaccgaaaaccgtttagtgggcatgaagtcccgtggttgttacgaaacccctggcggcaccgtaatgtttgccgcgctgcgtgccattgaagagttagtactggataaaaccagccgtaattggcgcgagcaagtgggcgcacaaatggctcacttagtgtatgacggtcgttggttcacacctctatgtaagtcgctgctggcggcatctgagtcattagccgagtctgttaatggtgaagttgtggttaaactctacaaaggtcatgcgattgctgttaagaagcgctcgccaaacagcttgtactctgaagcatttgccaccttcggtgaagaccaagtgtacgaccaaaaacacgctgaaggttttatccgtctgtactcgttagcgagccgcatccgcgcgctcaacgctaagtaa

SEQ ID NO: 5656 - protein, 407 aa, Shewanella oneidensis
MSIENKNTGVKKVVLAYSGGLDTSAIIPWLKENYDNCEIIAFCADVGQGEEELIGLTEKALASGASECHIVDLKEEFVKDYIYPTMATGAIYEGTYLLGTSMARPIIAKAQVEVARKVGADALCHGCTGKGNDQVRFEGCFAALAPDLKVIAPWREWTMQSREDLLAYLAERNIKTSASATKIYSRDANAFHISHEGGELEDPWNEPSKGVWTLTADPEDAPNQAEYVSLEVENGRVTKVNGEALTPYAALMKLNAIAAPHGVGRIDITENRLVGMKSRGCYETPGGTVMFAALRAIEELVLDKTSRNWREQVGAQMAHLVYDGRWFTPLCKSLLAASESLAESVNGEVVVKLYKGHAIAVKKRSPNSLYSEAFATFGEDQVYDQKHAEGFIRLYSLASRIRALNAK

SEQ ID NO: 5657 - DNA, 1224 bp, Shewanella sp
  CDS (1)..(1224): transl_table=11
atgtctatcgagaacaaaaacactggcgtgaaaaaagtcgttttagcctattcgggtggtctagatacttcggccattattccatggttaaaagaaacctacgacaactgtgagatcatcgctttttgcgctgacgtaggtcagggtgaagaagaattagtgggtctgactgaaaaggcattagcttctggcgcatcggaatgtcatatcgtcgatctgaaagaagaattcgttaaagattacatctacccaaccatggcaacgggtgctatctacgaaggtacttacttgttaggtacttcaatggcgcgtccaatcatcgcaaaggcgcaggttgaagtagcacgtaaagtgggtgccgatgctctgtgccacggttgtaccggtaagggtaacgaccaagtgcgtttcgaaggttgctttgcggcattagcgcctgatttaaaagtgattgcaccatggcgtgaatggaccatgcagagccgtgaagatctgctggcttacttagctgagcgtaatatcaagacgtcggcttctgcgactaagatctacagccgtgatgccaacgcattccacatttcccacgaaggtggcgagttggaagatccatggaacgagccaagcaaaggtgtgtggacgctgactgccgatccagaagatgcgccaaaccaagcagaatatgtgtcactcgaagtcgaacatggccgtgtgaccaaagtaaacggtgaagcattaacaccttacgctgcactgatgaagctgaatgccatcgctgcaccacatggcgtgggtcgtatcgatatcaccgaaaaccgtttagtgggcatgaagtctcgtggttgttacgaaactccaggcggcactgtgatgtttgctgcgctgcgcgcgattgaagagttagtactggataaaaccagccgtacttggcgcgagcaagtgggtgcccaaatggcgcacttagtgtacgacggtcgttggtttacacctctgtgtaagtcgctgctggcggcatctgagtcattagccgagtctgttaacggtgaagttgtggttaaactctacaaaggtcacgcgattgccgttaagaagcgttcgccaaacagcttgtactcagaagcatttgccaccttcggtgaagatcaagtgtatgaccagaaacacgctgaaggctttatccgtctgtactcgttagcaagccgcattcgcgcgctcaatgctaagtaa

SEQ ID NO: 5658 - protein, 407 aa, Shewanella sp
MSIENKNTGVKKVVLAYSGGLDTSAIIPWLKETYDNCEIIAFCADVGQGEEELVGLTEKALASGASECHIVDLKEEFVKDYIYPTMATGAIYEGTYLLGTSMARPIIAKAQVEVARKVGADALCHGCTGKGNDQVRFEGCFAALAPDLKVIAPWREWTMQSREDLLAYLAERNIKTSASATKIYSRDANAFHISHEGGELEDPWNEPSKGVWTLTADPEDAPNQAEYVSLEVEHGRVTKVNGEALTPYAALMKLNAIAAPHGVGRIDITENRLVGMKSRGCYETPGGTVMFAALRAIEELVLDKTSRTWREQVGAQMAHLVYDGRWFTPLCKSLLAASESLAESVNGEVVVKLYKGHAIAVKKRSPNSLYSEAFATFGEDQVYDQKHAEGFIRLYSLASRIRALNAK

SEQ ID NO: 5659 - DNA, 1344 bp, Shigella flexneri
  CDS (1)..(1344): transl_table=11
atgacgacgattctcaagcatctcccggtaggtcaacgtattggtatcgctttttccggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctataaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgagcaaggtcatccggtggcgctgaacggtaaaacctttagcgacgacgtagaaatgatgctggaagctaaccgcatcggcggtcgtcacggcctgggcatgagcgaccagattgagaaccgtatcatcgaagcgaaaagccgtggtatttacgaagctccggggatggcactgctgcacattgcgtatgaacgtctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaatctggatatcactgatacccgagagaaactttttggttatgccaaaactggcctgctttcctcctctgccacttcaggcctgccgcaggtggagaatatggaaaacaaaggccagtaa

SEQ ID NO: 5660 - protein, 447 aa, Shigella flexneri
MTTILKHLPVGQRIGIAFSGGLDTSAALLWMRQKGAVPYAYTANLGQPDEEDYDAIPRRAMEYGAENARLIDCRKQLVAEGIAAIQCGAFHNTTGGLTYFNTTPLGRAVTGTMLVAAMKEDGVNIWGDGSTYKGNDIERFYRYGLLTNAELQIYKPWLDTDFIDELGGRHEMSEFMIACGFDYKMSVEKAYSTDSNMLGATHEAKDLEYLNSSVKIVNPIMGVKFWDESVKIPAEEVTVRFEQGHPVALNGKTFSDDVEMMLEANRIGGRHGLGMSDQIENRIIEAKSRGIYEAPGMALLHIAYERLLTGIHNEDTIEQYHAHGRQLGRLLYQGRWFDSQALMLRDSLQRWVASQITGEVTLELRRGNDYSILNTVSENLTYKPERLTMEKGDSVFSPDDRIGQLTMRNLDITDTREKLFGYAKTGLLSSSATSGLPQVENMENKGQ

SEQ ID NO: 5661 - DNA, 1230 bp, Silicibacter pomeroyi
  CDS (1)..(1230): transl_table=11
atgtccgcgcccaagaaagttgtcctggcctattccggtggcctcgatacctcgatcatcctgaaatggttgcagaccgaatatggctgcgaggttgtcacctttaccgccgatctcggccagggagaggagctggaacccgcccgcaaaaaggccgagctgctgggcatcaagcccgagaacatccatatcgaggatgtccgcgaagagttcgtgcgcgactttgtctttccgatgttccgcgccaatgcggtgtacgaggggctgtatttgctgggcacttcgatcgcgcggccgctgatctcgaaacgtctggtcgagatcgccgccgaacacggcgctgacgcggtggcccatggcgccaccggcaagggcaacgaccaggtgcggttcgagctttccgcctatgcgctgaaccccgagatcagggtgatcgcgccctggcgcctgtgggatctgaccagccgcacccgtctgctggaattcgccgaagcgcatcagattccgatttcgaaggacaagcgcggcgaggcgccgttctcggtcgacgcgaacctgctgcacacctcgtccgagggcaaggtgctggaggatccgggcgtcgaggcgcccgattacgtcgcccaacgcatcgtcgcggtcgaagacgcccccgacacgcccgagttcatcgaagttacctttgaaaagggtgacgcggtggcgatcaacggcgaggcgatgtcgcccgcaaccatcctgacccgtctgaacgagttgggtggcaagcacggtatcggcctcttggatttcgtcgaaaaccgctttgtcgggatgaaatcgcgcggcgtctacgagacccccggcgggaccatcctgctcgaggcacatcgcggcatcgaacagatcacgctggacagcggcgcgggccacctgaaggattcgatcatgccccgctatgccgagctgatctataacggcttctggttcagccccgagcgcgagatgctgcaggccctgatcgacaagagccaggagcacgtcaccggcaccgtccggctgaaactctacaagggttcggcgcgcaccgtcgcccgctggtcggatcactcgctctattccgaggcccacgtgaccttcgaagaggacgccggcgcctatgaccagcaggatgccaagggcttcatccagctgaacgcgctgcggctgaaactgcttgcgacccgcaaccgtcgcgttgctggcaagtga

SEQ ID NO: 5662 - protein, 409 aa, Silicibacter pomeroyi
MSAPKKVVLAYSGGLDTSIILKWLQTEYGCEVVTFTADLGQGEELEPARKKAELLGIKPENIHIEDVREEFVRDFVFPMFRANAVYEGLYLLGTSIARPLISKRLVEIAAEHGADAVAHGATGKGNDQVRFELSAYALNPEIRVIAPWRLWDLTSRTRLLEFAEAHQIPISKDKRGEAPFSVDANLLHTSSEGKVLEDPGVEAPDYVAQRIVAVEDAPDTPEFIEVTFEKGDAVAINGEAMSPATILTRLNELGGKHGIGLLDFVENRFVGMKSRGVYETPGGTILLEAHRGIEQITLDSGAGHLKDSIMPRYAELIYNGFWFSPEREMLQALIDKSQEHVTGTVRLKLYKGSARTVARWSDHSLYSEAHVTFEEDAGAYDQQDAKGFIQLNALRLKLLATRNRRVAGK

SEQ ID NO: 5663 - DNA, 1224 bp, Silicibacter sp
  CDS (1)..(1224): transl_table=11
atgtccgcgcccaagaaagttgtgctggcctactccggtggccttgatacttcgatcatcctgaaatggttgcagaccgaatacggctgcgaggttgtcacctttactgccgatctcggccagggcgaggaactggagcctgcacgaaaaaaagcagagcttctcggcattaaacccgaaaacatctttatcgaggacatccgcgaggagttcgtccgcgatttcgtcttcccgatgttccgtgccaatgcggtctacgaaggtctctacctgctgggcacctcgattgcgcgcccgctgatctccaaacgtcttgtcgagatcgcagaggcaactggcgctgatgccgtgtcccatggtgcaaccggcaagggcaacgaccaggtccggttcgagctgtccgcctatgctctgaaccccgacattaaggtgattgcaccttggcgcgagtgggatctgacctcgcgcaccaaactgctggaatttgccgaggcaaaccagatcccgattgcaaaggacaagcgtggcgaggcgcctttctcggtcgacgcaaacctgctgcacacctcctctgagggtaaggttctggaagatccggcagaaatggcgcccgattacgtctatcagcgtaccgtaaacccggaagatgcgcccaacgagcccgagttcatcgaaatcacctttgaaaaaggcgatgcggttgcgatcaacggcgaggccatgtcgcctgcgacgatcctgaccaagctcaacgaatatggccgcaagcacggcattggccgtctggatttcgtcgagaaccgctttgtcggcatgaaatcccgcggcatctacgaggccccgggcggcgacatcctgctcgaagcacaccgtggcattgaacagatcaccctcgatagcggcgcgggccatctcaaggactcgatcatgccgcgttatgcagagctgatctataatggcttctggtactctccggagcgtgaaatgctgcaggccctgattgatgagagccagaagcacgtcaccggcaccgtacgcgtaaagctttacaaaggctccgcaaaaacggttggtcgctggtccgaacactcgctctattccgaggcacatgtgacctttgaagaagacgcgggcgcctacgatcaaaaagacgcgcagggcttcatccagctcaacgcattgcgtctgaagcttttggcagcgcgcaaccgtcgagtaaaataa

SEQ ID NO: 5664 - protein, 407 aa, Silicibacter sp
MSAPKKVVLAYSGGLDTSIILKWLQTEYGCEVVTFTADLGQGEELEPARKKAELLGIKPENIFIEDIREEFVRDFVFPMFRANAVYEGLYLLGTSIARPLISKRLVEIAEATGADAVSHGATGKGNDQVRFELSAYALNPDIKVIAPWREWDLTSRTKLLEFAEANQIPIAKDKRGEAPFSVDANLLHTSSEGKVLEDPAEMAPDYVYQRTVNPEDAPNEPEFIEITFEKGDAVAINGEAMSPATILTKLNEYGRKHGIGRLDFVENRFVGMKSRGIYEAPGGDILLEAHRGIEQITLDSGAGHLKDSIMPRYAELIYNGFWYSPEREMLQALIDESQKHVTGTVRVKLYKGSAKTVGRWSEHSLYSEAHVTFEEDAGAYDQKDAQGFIQLNALRLKLLAARNRRVK

SEQ ID NO: 5665 - DNA, 1218 bp, Sphingopyxis alaskensis
  CDS (1)..(1218): transl_table=11
atgtccgattccatcaagcgcgtcgtccttgcctattcgggtggtctcgacaccagcgtcatcctgaaatggctgcaggtgacctatggctgcgaggtcgtgacctttaccgccgatctggggcagggcgaggagctggaacccgcgcgcgccaaggccgagctgatggggatcaagcccgaacatatctatatcgacgatttgcgcgaggagttcgtgcgtgacttcgttttcccgatgatgcgcgccaatgcgcgctacgagggcgattacctgctcggcacgtcgatcgcgcggccgctgatttcgaagcggctggtcgagatcgccagggaaacgggcgccgatgcggtggcgcatggcgcgacgggcaagggcaatgaccaggtgcgcttcgagctgtcggcctatgcgctcaatcccgacatcaaggtgatcgcgccctggcgcgaatgggatctgaccagccgcaccgcgctgatcgcgtgggccgaacagcatcagattcctgtgcccaaggacaagcgcggcgaaagcccgttcagcaccgacgcgaacctcctccacacatcgtccgaaggcaaggtgctcgaggatccatgggaagaaacccccgactatgtctattcgcgcacggtgaacccggaggatgcgcccgatacgcccgaatatatcacgatcgatttcgagcgcggtgacggcgtcgcgctgaacgggcaggcgatgtcgcccgcgaccctgctcgcggcactcaacgacctgggccgcaagcatggcatcggccgcctcgacctcgtcgaaaaccgcttcgtcggcatgaagtcgcgcggcatgtacgaaacgccgggcggcgaaatctatgcgcgggcgcatcgcggcatcgaaagcatcacgctcgaccgcggcgcggcgcacctcaaagatgaactgatgcccaaatatgccgagctgatctataacggattctggttcgcccccgagcgcgagatgttgcaggcggcgatcgaccacagccaggcgaatgtcaccggcacggttcgattgaagctttacaagggcaatgccagcgtcgtcggccgcaagtcgccgttcagcctgtacagcgaacgccatgtgacgttcgaggatgatgccggcgcctatgaccagaaggacgcggccggcttcatcaggctcaacgcgctgcggctcaaactgcttgcccgacaggggcgctga

SEQ ID NO: 5666 - protein, 405 aa, Sphingopyxis alaskensis
MSDSIKRVVLAYSGGLDTSVILKWLQVTYGCEVVTFTADLGQGEELEPARAKAELMGIKPEHIYIDDLREEFVRDFVFPMMRANARYEGDYLLGTSIARPLISKRLVEIARETGADAVAHGATGKGNDQVRFELSAYALNPDIKVIAPWREWDLTSRTALIAWAEQHQIPVPKDKRGESPFSTDANLLHTSSEGKVLEDPWEETPDYVYSRTVNPEDAPDTPEYITIDFERGDGVALNGQAMSPATLLAALNDLGRKHGIGRLDLVENRFVGMKSRGMYETPGGEIYARAHRGIESITLDRGAAHLKDELMPKYAELIYNGFWFAPEREMLQAAIDHSQANVTGTVRLKLYKGNASVVGRKSPFSLYSERHVTFEDDAGAYDQKDAAGFIRLNALRLKLLARQGR

SEQ ID NO: 5667 - DNA, 1206 bp, Staphylococcus aureus
  CDS (1)..(1206): transl_table=11
atgaaagagaaaattgttttagcatattcaggaggactagatacaagtgtggccgttcaatggcttatcgacaaaggatacgacgttgtagcttgttgcctagatgttggtgaaggtaaagatttagacatcgtttataaaaaagctttagatatgcgagctgttgaatgtcatattattgatgcaacaaaagaatttagtgatgagtatgtaagttatgcaatcaaaggaaatttaatgtatgaaaatgcatatccattagtttctgctttatcaagaccattaatcgctaaaaaattagtagagattgctgagaaaacaaattcagtaggtattgcacatggttgtactggtaaagggaatgaccaagtacgtttcgaagttgccattaaagcattaaacccatcattgaaagcattcgcacctgtacgtgagtgggcatggagtcgtgaagaagaaattgattatgcaattaaacataatatccctgtatcaattaaccatgattcaccttattctatcgatcaaaacctatggggcagagcgaatgaatgtggtattttagaagatccttatgctgcaccaccagaggatgcgttcgatctaacaaatgctttagaagaaacaccagatactgctgatgaaatcattttaacgtttgataaaggcatcccagttcaaattgatggcaaaacatatgaattagacgatttaattttaacgttgaatgcattagctggtaagcatggtatcggaagaattgaccatgtagaaaatagacttgtaggtatcaaatcaagagaaatttatgaagcacctgctgcagaagttattttaaaagcacataaagcattagaaacgattacgttaacgaaagatgttgcacactttaaaccaatcattgagaagcaatttgctgaacaactatacaatggactttggttctcacctttaactgatagcttgaaattatttattgatagtactcagcaatacgtaagtggtgatgtcagaattaaattattcaaaggtaatgctatcgtgaatggtagaaaatcaccttacacattatatgatgaaaaattagcaacttatacaaaagaagatgcatttaatcaagacgctgctgttggctttatcgatatctatggtttacctactcaagtaaatgcgatgttacatggaggctatagcaatgagcaataa

SEQ ID NO: 5668 - protein, 401 aa, Staphylococcus aureus
MKEKIVLAYSGGLDTSVAVQWLIDKGYDVVACCLDVGEGKDLDIVYKKALDMRAVECHIIDATKEFSDEYVSYAIKGNLMYENAYPLVSALSRPLIAKKLVEIAEKTNSVGIAHGCTGKGNDQVRFEVAIKALNPSLKAFAPVREWAWSREEEIDYAIKHNIPVSINHDSPYSIDQNLWGRANECGILEDPYAAPPEDAFDLTNALEETPDTADEIILTFDKGIPVQIDGKTYELDDLILTLNALAGKHGIGRIDHVENRLVGIKSREIYEAPAAEVILKAHKALETITLTKDVAHFKPIIEKQFAEQLYNGLWFSPLTDSLKLFIDSTQQYVSGDVRIKLFKGNAIVNGRKSPYTLYDEKLATYTKEDAFNQDAAVGFIDIYGLPTQVNAMLHGGYSNEQ

SEQ ID NO: 5669 - DNA, 1206 bp, Staphylococcus aureus
  CDS (1)..(1206): transl_table=11
atgaaagagaaaattgttttagcatattcaggaggactagatacaagtgtggccgttcaatggcttatcgacaaaggatacgacgttgtagcttgttgcctagatgttggtgaaggtaaagatttagacatcgtttataaaaaagctttagatatgggagcagttgaatgtcatattattgatgcaacaaaagaatttagtgatgagtatgtaagttatgcaatcaaaggaaatttaatgtatgaaaatgcatatccattagtttcagctttatcaagaccattaatcgctaaaaaattagtagagattgctgagaaaacaaattcagtaggtattgcacatggttgtactggtaaagggaatgaccaagtacgtttcgaagttgccattaaagcattaaacccatcattgaaagcattcgcacctgtacgtgagtgggcatggagtcgtgaagaagaaatcgattatgcaattaaacataatatccctgtatcaatcaaccatgattcaccttattctatcgatcaaaatctatggggcagagcgaatgaatgtggtattttagaagatccttatgctgcgccaccagaggatgcgttcgatctaacaaatgctttagaagaaacaccagatgctgctgatgaaatcattttaacgtttgataaaggcatcccagttcaaattgatggcaaaacatatgaattagacgatttaattttaacgttgaatgcattagctggtaagcatggtatcggaagaattgaccatgtagaaaatagacttgtaggtatcaaatcaagagaaatttatgaggcacctgctgcagaagttattttaaaagcgcataaagcattagaaacgattacgttaacgaaagatgtcgcacactttaaaccaatcatcgagaagcaatttgctgaacaactatacaatggactttggttctcacctttaactgatagcttaaaattatttattgatagtactcagcaatacgtaagtggtgatgtcagaattaaattattcaaaggtaatgccatcgtaaatggtagaaaatcaccttacacattatatgatgaaaaattagcaacttatacaaaagaagatgcatttaatcaagacgctgctgtcggctttatcgatatctatggtttacctactcaagtaaattcgatgctacatggaggctatagcaatgagcaataa

SEQ ID NO: 5670 - protein, 401 aa, Staphylococcus aureus
MKEKIVLAYSGGLDTSVAVQWLIDKGYDVVACCLDVGEGKDLDIVYKKALDMGAVECHIIDATKEFSDEYVSYAIKGNLMYENAYPLVSALSRPLIAKKLVEIAEKTNSVGIAHGCTGKGNDQVRFEVAIKALNPSLKAFAPVREWAWSREEEIDYAIKHNIPVSINHDSPYSIDQNLWGRANECGILEDPYAAPPEDAFDLTNALEETPDAADEIILTFDKGIPVQIDGKTYELDDLILTLNALAGKHGIGRIDHVENRLVGIKSREIYEAPAAEVILKAHKALETITLTKDVAHFKPIIEKQFAEQLYNGLWFSPLTDSLKLFIDSTQQYVSGDVRIKLFKGNAIVNGRKSPYTLYDEKLATYTKEDAFNQDAAVGFIDIYGLPTQVNSMLHGGYSNEQ

SEQ ID NO: 5671 - DNA, 1206 bp, Staphylococcus epidermidis
  CDS (1)..(1206): transl_table=11
atgaaagataaaatcgttttagcatattcaggtggtttagatacaagcgttgcagttcaatggcttattgataaaggatatgatgtagttgcttgttgtcttgacgtaggcgaaggcaaagatttagacgttgtatatcaaaaagctttagatatgggtgcagtcgaatgtcatattattgatgcaactaaagaatttagtgatgattatgtaagttatgctattaaaggaaatttaatgtatgaaaatgcatatcctctagtttcagcattatcacgtccactcatcgcgaaaaaactggttgaaattgctgaaaaaacaaattctattggtattgcgcatggatgtactggtaaaggtaatgatcaagtacgtttcgaagtggcaatcaaagctttaaatcctaagttaaaagcatttgcacctgttcgtgaatgggcttggagcagagaagaagaaattgattacgcaatcaaacataatattcctgtttcaatcaattatgactcgccatactcaattgaccaaaacttatgggggagagctaatgaatgtggtattttagaagatccgtatgccgcacctccggaagatgcatttgatttaactacacctttagaagaaactccagacaatgcagacgaaattatccttacatttaaacaaggtattccagtacaagttgatggcaaagattatcaattagatgaccttattctttacttgaatcaacttgctggcaaacacggtattggtagaatcgatcatgttgaaaacagaatggtcgggataaaatcgagagagatttatgaaacacctggtgcggaagttattttaaaagcacacaaagcactagaaacaattacattaactaaagacgtagcgcactttaagcctgtcattgaaaaacaattttcagaacaaatatacaatggtttgtggttctcgccattaacagatagtttaaaactctttatcgatagtactcaacaatatgttgagggagatgtgagaattaaattatttaaagggaacgctattgtcaatggcagacaatctccttacactttatacgatgaaaaattagctacttatacaaaagaagatgccttcaatcaagaatcagcagtaggtttcattgatatttatggtttacctacacaagttaatgcattacttcacggggggtatagtaatgagcaataa

SEQ ID NO: 5672 - protein, 401 aa, Staphylococcus epidermidis
MKDKIVLAYSGGLDTSVAVQWLIDKGYDVVACCLDVGEGKDLDVVYQKALDMGAVECHIIDATKEFSDDYVSYAIKGNLMYENAYPLVSALSRPLIAKKLVEIAEKTNSIGIAHGCTGKGNDQVRFEVAIKALNPKLKAFAPVREWAWSREEEIDYAIKHNIPVSINYDSPYSIDQNLWGRANECGILEDPYAAPPEDAFDLTTPLEETPDNADEIILTFKQGIPVQVDGKDYQLDDLILYLNQLAGKHGIGRIDHVENRMVGIKSREIYETPGAEVILKAHKALETITLTKDVAHFKPVIEKQFSEQIYNGLWFSPLTDSLKLFIDSTQQYVEGDVRIKLFKGNAIVNGRQSPYTLYDEKLATYTKEDAFNQESAVGFIDIYGLPTQVNALLHGGYSNEQ

SEQ ID NO: 5673 - DNA, 1191 bp, Streptococcus agalactiae serotype III
  CDS (1)..(1191): transl_table=11
atgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgtgttaccagctttacaggcacatgcgatgtatgaacaaaaatacccgcttgtttcagcgcttagtcgtccaattattgctcaaaaattagttgaaatggcacatcaaacaggtgcgaccacaattgcccatggatgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacattagtccgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgccaaagtcgttgctcgccactcgtctaattcattatatgatgagaacttagcaacttatacagctgctgataactttgatcaagatgcagcagttggttttatcaaactctggggacttccaacccaagttaatgcacaagtaaacaaaggataa

SEQ ID NO: 5674 - protein, 396 aa, Streptococcus agalactiae serotype III
MGKEKLILAYSGGLDTSVAIAWLKKDYDVIAVCMDVGEGKDLDFIHDKALTIGAIESYILDVKDEFAEHFVLPALQAHAMYEQKYPLVSALSRPIIAQKLVEMAHQTGATTIAHGCTGKGNDQVRFEVAIAALDPELKVIAPVREWKWHREEEITFAKANGVPIPADLDNPYSIDQNLWGRANECGVLENPWNQAPEEAFGITKSPEEAPDCAEYIDITFQNGKPIAINNQEMTLADLILSLNEIAGKHGIGRIDHVENRLVGIKSREIYECPAAMVLLAAHKEIEDLTLVREVSHFKPILENELSNLIYNALWFSPATKAIIAYVKETQKVVNGTTKVKLYKGSAKVVARHSSNSLYDENLATYTAADNFDQDAAVGFIKLWGLPTQVNAQVNKG

SEQ ID NO: 5675 - DNA, 1191 bp, Streptococcus agalactiae serotype V
  CDS (1)..(1191): transl_table=11
atgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgttttaccagctttacaggcacatgcgatgtatgaacaaaaatacccgcttgtttcagcgcttagtcgtccaattattgcccaaaaattagttgaaatggcacatcaaacaggtgcgaccacaattgcacatggctgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacactagttcgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgcccaagtcgttgctcgccactcatctaattcattatatgatgagaatttagcaacctatacagctgctgatagctttgatcaagatgcagcagttggttttatcaaactctggggacttccaacccaagttaatgcccaagtaaacaaaggataa

SEQ ID NO: 5676 - protein, 396 aa, Streptococcus agalactiae serotype V
MGKEKLILAYSGGLDTSVAIAWLKKDYDVIAVCMDVGEGKDLDFIHDKALTIGAIESYILDVKDEFAEHFVLPALQAHAMYEQKYPLVSALSRPIIAQKLVEMAHQTGATTIAHGCTGKGNDQVRFEVAIAALDPELKVIAPVREWKWHREEEITFAKANGVPIPADLDNPYSIDQNLWGRANECGVLENPWNQAPEEAFGITKSPEEAPDCAEYIDITFQNGKPIAINNQEMTLADLILSLNEIAGKHGIGRIDHVENRLVGIKSREIYECPAAMVLLAAHKEIEDLTLVREVSHFKPILENELSNLIYNALWFSPATKAIIAYVKETQKVVNGTTKVKLYKGSAQVVARHSSNSLYDENLATYTAADSFDQDAAVGFIKLWGLPTQVNAQVNKG

SEQ ID NO: 5677 - DNA, 1215 bp, Streptomyces avermitilis
  CDS (1)..(1215): transl_table=11
ttgcagtgtgaggagaagcccgtgaccgagcgcgtcgtactcgcctactcgggtggtctggacacctccgtcgccatcggctggatcgccgaggagacgggcgccgaggtcatcgccgtcgcggtcgacgtcggccagggcggcgaggacctggacgtcatccgcaagcgcgcgctcgcctgcggtgccgtcgaggccgaggtcgcggacgccaaggacgagttcgccgacgagtactgcctcccggcggtcaaggccaacgccctctacatggaccgctacccgctggtctccgccctctcccggccgaccatcgtcaagcacctcgtcgccgccgcccagaagcacggcgccaccacggtcgcccacggctgcaccggcaagggcaacgaccaggtgcggttcgaggccggcatcgtcgccctcgcccccggcctcaagtgcatcgccccggtccgtgactacgcgatgacccgggacaaggcgatcgccttctgcgaggagaagcggctcccgatcgccaccaccaagaagtccccgtactccatcgaccagaacgtcttcgggcgcgcggtcgagacgggcttcctggaggacatctggaacgcgccgatcgaggacatctacgagtacacctcgaacccggccgagccccgcgaggccgacgaggtcgtcatctccttcaaggagggcgtcccggtcgccatcgacggccggcccgtcaccgtgctccaggcgatccagcagctcaacgagcgcgccggcgcccagggcgtcggccggatcgacatggtcgaggaccggctcgtgggcatcaagtcccgcgaggtgtacgaggctccgggcgcgatcgctctcatcacggcccaccaggagctggagaacgtcaccgtcgagcgtgaactcgcccgctacaagcggcaggtcgagcagcgctggggcgagctggtctacgacggccagtggttctccccgctcaagcgcgccctggagggcttcatcgacgaggccaaccagcacgtcaacggcgacatccggatgaccctgcacggcggccgcgccgtcgtcaccggccggcgctccgagacgtcgctctacgacttcaacctcgccacgtacgacacgggcgacagcttcgaccaggccgcggccaagggcttcatcgacatctacagcctgtcgtcgaagatcgccgccaagcgcgacctggcgtaa

SEQ ID NO: 5678 - protein, 404 aa, Streptomyces avermitilis
MQCEEKPVTERVVLAYSGGLDTSVAIGWIAEETGAEVIAVAVDVGQGGEDLDVIRKRALACGAVEAEVADAKDEFADEYCLPAVKANALYMDRYPLVSALSRPTIVKHLVAAAQKHGATTVAHGCTGKGNDQVRFEAGIVALAPGLKCIAPVRDYAMTRDKAIAFCEEKRLPIATTKKSPYSIDQNVFGRAVETGFLEDIWNAPIEDIYEYTSNPAEPREADEVVISFKEGVPVAIDGRPVTVLQAIQQLNERAGAQGVGRIDMVEDRLVGIKSREVYEAPGAIALITAHQELENVTVERELARYKRQVEQRWGELVYDGQWFSPLKRALEGFIDEANQHVNGDIRMTLHGGRAVVTGRRSETSLYDFNLATYDTGDSFDQAAAKGFIDIYSLSSKIAAKRDLA

SEQ ID NO: 5679 - DNA, 1194 bp, Streptomyces clavuligerus
  CDS (1)..(1194): transl_table=11
gtgaccgagcgcgtcgtactcgcctactcgggcggtctggacacctccgtcgccatcggctggatcgccgaggagacgggcgccgaggtcatcgccgtcgccgtggacgtcggccagggcggcgaggacctggacgtcatccgcaagcgcgcgctcgcctgcggtgccgtggaggccgaggtggccgacgccaaggacgagttcgccgaggagtactgcctccctgcgatcaaggccaacgcccgctacatggaccggtacccgctggtgtccgcgctctcccggcccgcgatcgtcaagcacctggtcgccgccgcgaagaagcacgacgcctcgatcgtggcgcacggctgcaccggcaaggggaatgaccaggtccgtttcgaggccggtatccaggccctcggcccggacctcaagtgcatcgcgccggtccgtgactacgccatgacccgggacaaggccatcgccttctgcgaggccaagcagctcccgatcgccaccaccaagaagtccccgtactccatcgaccagaacgtcttcggccgggccatcgagaccggcttcctggaggacatctggaacgcgccgatcgaggacatcttcgagtacacctccaacccggccgagccccgcgaggccgacgaggtggtcatctccttcgcctccggtgtcccggtcgccatcgacggccgccccgtcaccgtgctccaggccatccagcagctcaacgagcgcgcgggcgcccagggcatcggccggatcgacatggtcgaggaccggctggtcggcatcaagtcccgtgaggtgtacgaggcgccgggcgcgatcgcgctgatcaccgcccaccaggagctggagaacgtcaccgtcgagcgcgaactggcccgcttcaagcggcaggtcgagcagcgctggggcgagctggtctacgacggcctgtggttctccccgctcaagcgcgccctggacggcttcatcgaggaggccaaccagcaggtcaccggcgacatccggatgaccctgcacgcgggcaccgccgtggtcaccggccgccgctccgagcggtcgctgtacgacttcgacctcgcgacctacgacacgggcgacaccttcgaccagtccaaggcccagggcttcatcgacatcttcgccctctccgcgaagatcgccgccaagcgcgacctggtctga

SEQ ID NO: 5680 - protein, 397 aa, Streptomyces clavuligerus
MTERVVLAYSGGLDTSVAIGWIAEETGAEVIAVAVDVGQGGEDLDVIRKRALACGAVEAEVADAKDEFAEEYCLPAIKANARYMDRYPLVSALSRPAIVKHLVAAAKKHDASIVAHGCTGKGNDQVRFEAGIQALGPDLKCIAPVRDYAMTRDKAIAFCEAKQLPIATTKKSPYSIDQNVFGRAIETGFLEDIWNAPIEDIFEYTSNPAEPREADEVVISFASGVPVAIDGRPVTVLQAIQQLNERAGAQGIGRIDMVEDRLVGIKSREVYEAPGAIALITAHQELENVTVERELARFKRQVEQRWGELVYDGLWFSPLKRALDGFIEEANQQVTGDIRMTLHAGTAVVTGRRSERSLYDFDLATYDTGDTFDQSKAQGFIDIFALSAKIAAKRDLV

SEQ ID NO: 5681 - DNA, 1449 bp, Streptomyces lavendulae
  CDS (1)..(1449): transl_table=11
atgtctaaagtcctcacgtcccttcccgccggcgagcgcgtcggcatcgccttctccggcgggctcgacacctcggtcgccgtcgcctggatgcgcgacaagggcgccgtcccctgcacgtacaccgccgacatcggccagtacgacgagcccgacatcgcctccgtgcccagccgcgcctccgcgtacggcgccgagatcacccggctcgtcgactgccgtgccgccctcgtcgaggagggcctggcggcgctcgcgtgcggtgcgttccacatccggtcgggcgggcgcccgtacttcaacaccacgccgctgggacgtgccgtgaccggcacgctgctggtgcgcgcgatgcttgaggacggggtgcagatctggggcgacggctccaccttcaagggcaacgacatcgagcggttctaccggtacgggctgctcgccaacccgcacctgcggatctacaagccctggctggacgccgacttcgtcaccgagctcggcggccgcaaggagatgtccgagtggctgctcgcgcacgggctgccgtaccgggactcgacggagaaggcgtactccacggacgccaacatctggggcgccacgcacgaggccaagacgctggagcacctcgacaccggcatcgagaccgtcgacccgatcatgggcgtgcggttctgggacccgtcggtggagatcgccacggaggacgtgacggtcggcttcgagcagggccgcccggtctccatcaacggcaaggagttcgcctccgccgtcgacctcgtgatggaggccaacgcgatcggcggccggcacggtctgggcatgtccgaccagatcgagaaccggatcatcgaggccaagagccgcggcatctacgaggcgcccggcatggcgctgctgcacatcgtctacgagcgcctcgtcaacgcgatccacaacgaggacaccctggccgcgtaccacaacgagggccggcgcctcggccggctcatgtacgagggccgctggctggacccgcaggcgctgatgatccgcgagtcgctgcagcgctgggtcggcacggccgtcaccggcgaggtgacgctgcggctgcggcgcggcgaggactactcgatcctcgacaccacgggcccggcgttcagctaccacccggacaagctctccatggagcggaccgaggactcggcgttcggcccggtggaccggatcggccagctcaccatgcgcaacctggacatcgccgactcccgcgcccgcctggagcagtacgtggggctcggcctggtcggcactccccacccgacaccgatcggcgccgcacaggcggccgcgaccgggctgatcggcgccatggacgagggcggtgccgaggcgatcgcctcccgtggcgaggccaccgacgaggagacgatgctggaccgcgccgcgatggagtccggcacggactga

SEQ ID NO: 5682 - protein, 482 aa, Streptomyces lavendulae
MSKVLTSLPAGERVGIAFSGGLDTSVAVAWMRDKGAVPCTYTADIGQYDEPDIASVPSRASAYGAEITRLVDCRAALVEEGLAALACGAFHIRSGGRPYFNTTPLGRAVTGTLLVRAMLEDGVQIWGDGSTFKGNDIERFYRYGLLANPHLRIYKPWLDADFVTELGGRKEMSEWLLAHGLPYRDSTEKAYSTDANIWGATHEAKTLEHLDTGIETVDPIMGVRFWDPSVEIATEDVTVGFEQGRPVSINGKEFASAVDLVMEANAIGGRHGLGMSDQIENRIIEAKSRGIYEAPGMALLHIVYERLVNAIHNEDTLAAYHNEGRRLGRLMYEGRWLDPQALMIRESLQRWVGTAVTGEVTLRLRRGEDYSILDTTGPAFSYHPDKLSMERTEDSAFGPVDRIGQLTMRNLDIADSRARLEQYVGLGLVGTPHPTPIGAAQAAATGLIGAMDEGGAEAIASRGEATDEETMLDRAAMESGTD

SEQ ID NO: 5683 - DNA, 1191 bp, Streptococcus mutans
  CDS (1)..(1191): transl_table=11
atgtcaaaagagaaagttattttagcttattcaggcggacttgatacgtcagttgccattacgtggttaaaaaaagattatgatgttgttgctgtttgtatggatgttggtgaaggtaaagatcttgagtttattcatgataaagcgctgaaagttggagcaattgaatcttatgtcttggatattaaagatgaatttgctgaagaatatgtccttcctgctctgcaggctcatgcttattatgaacaaaaatatccattagtatcagcccttagtcgtccagtgatttctaagaaattggttgaaattgctcatcagacaggagcaactactattgctcatggctgtaccggtaagggaaatgatcaagttcggtttgaagtagctattgcagcacttgatccaaaattaaaagtcattgcacctgttcgggagtggaaatggtcacgggaagaagagattaattatgctaaagaaaatggcgtaccggttccggctgatcttgataatccttactctgttgatcaaaatctttggggccgtgcaaatgaatgcggtgtccttgaaaatccttggaaccaagctccagaagaggcgtttggtatcaccaattcggttgaagaagctccagataaagcagaatacgttgatattacatttaaagaaggcaagcctgttgctcttgatggacaggaaatgaagttggctgatcttattcaaaagcttaatgttcttgctggtaagcatggtgttggtcgaattgatcatgttgaaaatcgtttagttggtattaaatcacgtgaaatttacgaatgtcccggggcagttactcttttaacagctcataaggaaattgaggatataaccttagtgcgtgaggtgtcgcacttcaagccgattcttgaaaatgaattgtcaaatcttatctacaatgctctttggttcaatccagcaacgcaagctattcttgcttatattacggaaacacaaaaagaagttaatggaacagctaaagtgaaattgtacaagggatctgcaagggttgttgctagaaagtcacctcattcactttatgatgaaaatttagcaacctatacatcagctgatagttttgatcaagatgcagccgttggtttcattaaactttggggattaccaacgcaagttaactcacaggtaaacaacaaataa

SEQ ID NO: 5684 - protein, 396 aa, Streptococcus mutans
MSKEKVILAYSGGLDTSVAITWLKKDYDVVAVCMDVGEGKDLEFIHDKALKVGAIESYVLDIKDEFAEEYVLPALQAHAYYEQKYPLVSALSRPVISKKLVEIAHQTGATTIAHGCTGKGNDQVRFEVAIAALDPKLKVIAPVREWKWSREEEINYAKENGVPVPADLDNPYSVDQNLWGRANECGVLENPWNQAPEEAFGITNSVEEAPDKAEYVDITFKEGKPVALDGQEMKLADLIQKLNVLAGKHGVGRIDHVENRLVGIKSREIYECPGAVTLLTAHKEIEDITLVREVSHFKPILENELSNLIYNALWFNPATQAILAYITETQKEVNGTAKVKLYKGSARVVARKSPHSLYDENLATYTSADSFDQDAAVGFIKLWGLPTQVNSQVNNK

SEQ ID NO: 5685 - DNA, 1176 bp, Sulfolobus acidocaldarius
  CDS (1)..(1176): transl_table=11
atgaaaatcgtacttgcatactcaggaggattagatacgactgttgctattcgatggctaagagaaaccttcaacgctgatgttacaacagttacagtggatgtaggtcaaaaggatgatttttatcaaatagaaaaaagagcttatatagcaggagcaataaaacattatactatagatgcaaaaaaggattttgcagaaagatatatctcatacgcaataaagatgaatggtttatatgaagatatataccctctctcaacagccttagcaagaccattaatagttgaaaaggtagtcgaaatagccaagaaaataggtgcggaggcaatcgcccacggctcgacatcaaaaggtaatgatcaggttagatttgatttagcggttaaggcgttgtaccctgaggcaaagatcatagcccctgcaagaatatggaatatgacaagggataaggaaatcgaatatgctaaatcgaaaggaattccaataaagacagaaagtagtaagtatagtatagatgaaaatctttggggaagaagtatagaaggagatataatttccgatccatcaaaggaggttcctgaggacgcatttgagtggactaagaagacaaaagatgacaaacttaagatttccttaacctttgataagggtcttcctgtggaagtcaatggagaaaaaatggatttacttaaggttattcaagtacttaatgagctcgttggttcaagaggttttggaagagttgaacatcttgaaaacagagtagtgggctttaaatcgagggaagtctatgaggtacctgctgcactagttttaattaattctcataaggacttagagaaatcaacttacactccactagaatttagatttaagagatctcttgatggtcagtggagtgatctggtttatcagggtctatggtttgagcctttacgagagactatccagatagctggagataatctaaataaatggatctcgggggaggtatttattgaggttgaaaatggtaacatgaaaatcttaggcagaaaaggaaagttctctccattttctgaggagatagcaagttacaataagggctggtatccatctgacgagatggctagaggtttcatagagatctttggtatgcactcattggtggccagaaaatcgagagggatatga

SEQ ID NO: 5686 - protein, 391 aa, Sulfolobus acidocaldarius
MKIVLAYSGGLDTTVAIRWLRETFNADVTTVTVDVGQKDDFYQIEKRAYIAGAIKHYTIDAKKDFAERYISYAIKMNGLYEDIYPLSTALARPLIVEKVVEIAKKIGAEAIAHGSTSKGNDQVRFDLAVKALYPEAKIIAPARIWNMTRDKEIEYAKSKGIPIKTESSKYSIDENLWGRSIEGDIISDPSKEVPEDAFEWTKKTKDDKLKISLTFDKGLPVEVNGEKMDLLKVIQVLNELVGSRGFGRVEHLENRVVGFKSREVYEVPAALVLINSHKDLEKSTYTPLEFRFKRSLDGQWSDLVYQGLWFEPLRETIQIAGDNLNKWISGEVFIEVENGNMKILGRKGKFSPFSEEIASYNKGWYPSDEMARGFIEIFGMHSLVARKSRGI

SEQ ID NO: 5687 - DNA, 1173 bp, Sulfolobus tokodaii
  CDS (1)..(1173): transl_table=11
atgaaaatagttcttgcatactctggtgggttagatactacagtagcgataagatggctaaaggaaacctttaatgctgacgttatcacagtcacagtagatgtagggcaaaaagataactttgaagacatagaaaaaagagcatatatagcaggagcaacaaaacattatactatagatgcaaaaaaggaatttgctgataatttcatttcttacgcaatcaaaatgaacgcattatatgaggatgtttatccattatcaacagccttagcaagaccattaatagcacaaaaagttgttgaaatagcaaaaaaagaaaaagtagactatattgctcacggttcaacatctaaaggaaatgatcaagtaagattcgacttagcagttaaagcattatatccagaggctaaaatcatagctccagctagaatatggaatatgacaagagagaaagagatagagtttgcaaaagccagagggattcctatcaaaactgaaagcagtaaatatagtattgacgagaacttatggggtagaagtattgaaggtgatgatatttctgatccgtcaaaagaagtcccagaagatgcttttgaatggaccaaaaagaaaaataatggtaaaattactctctccattgaatttgaaaaaggtattccagttgctataaataatgaaaaaatggatttagttaaaattattcaagtgttaaatgaggtagtaggttcttatggttttggaagagtagaacatttagaaaatagagttgtaggttttaaatctagagaagtttatgaagttcctgcagcgttagttttgataaattcacataaagacttagaaaagactgtttattctccgttagagtttagatttaagaaatatatagactcacaatgggctgatttagtttatcaagggctttggtttgaacctttaagagagactatacaattggccggtgataatttaaataaatgggttactggtgaggtaaaaatagaaatagaaggtaatggaatgagaacattaggtagggcttcaaagtactctccattttctgaaaaagttgccagttataataaaggatggtacccaactgatgagatggcaagagggtttattgaaatatatggtatgcattcattactaaccagacaggtgagagaatag

SEQ ID NO: 5688 - protein, 390 aa, Sulfolobus tokodaii
MKIVLAYSGGLDTTVAIRWLKETFNADVITVTVDVGQKDNFEDIEKRAYIAGATKHYTIDAKKEFADNFISYAIKMNALYEDVYPLSTALARPLIAQKVVEIAKKEKVDYIAHGSTSKGNDQVRFDLAVKALYPEAKIIAPARIWNMTREKEIEFAKARGIPIKTESSKYSIDENLWGRSIEGDDISDPSKEVPEDAFEWTKKKNNGKITLSIEFEKGIPVAINNEKMDLVKIIQVLNEVVGSYGFGRVEHLENRVVGFKSREVYEVPAALVLINSHKDLEKTVYSPLEFRFKKYIDSQWADLVYQGLWFEPLRETIQLAGDNLNKWVTGEVKIEIEGNGMRTLGRASKYSPFSEKVASYNKGWYPTDEMARGFIEIYGMHSLLTRQVRE

SEQ ID NO: 5689 - DNA, 1206 bp, Symbiobacterium thermophilum
  CDS (1)..(1206): transl_table=11
atggcgaagaagaagtgcgtgctggcctactcaggcgggctggatacctcggtggcgatccactggatcaaggagaactacgacgccgatgtggtcgcgctggcggtggacgtgggcgccaacgacaaggacctggagttcatccggcagaaggcgctttccatcggcgccgtgaagagctacgtctacgatgccaggaaagagttcgcctacgacttcatcctgccgacgctccaggccaacgcctgttacgagtccaagtactacctctcggcggcgctttcccggccgctgatcgcgaagctgctggtccagatcgccgaggaggaaggggccgacttcgtcgcccacggctgcacgggcaagggcaatgaccaggtgcggttcgaggtctccgtggccgccctcaaccccaacctgcaggtgctcgccccggtgcgggagtggggatggagccgggaggaggagatcgactacgcccagaaacatggcatcccggtcccggtgggcaaggagaacccgttctccatcgacgtgaacctgtggggccgctcctgcgaggccggcgtcctggaggacccgtgggcggaggcgccggaggaggccttcgagtggaccgtgaatccgaaggatgcccccgacgagcccgagtacgtggagatcggcttcgagcagggcgtgccggtctcgttgaacggcgaggcgctggacctggtgaccctgatcgagcggctgcacgccatcgccggccgccacggggtgggccgcatcgaccacgtggagaaccgactggtcggcatcaagtcccgggaggtgtacgagatgccggcggcggcggtgctcaccctggcgcacaaggagctggagaccatcaccctgccccgggagctgcaccacttcaagctgggcctggagcagaagtacgccgaactggtctacaacggcctctggttccacccgctgaaggaggccctggacgctttcatcaagaagtcccaggagacggtgaccggcacggtgcgggtgagactcttcaagggctcggccttctgcgtgggccggacttcgccctacacgctctactcctacgacctggccacctacgacaaggcggacaagttcgaccacaaggcggccaaggggttcatcgacatcttcggcctgcccaccaaggtctacgccgccgtgcagaagagcaaggcctga

SEQ ID NO: 5690 - protein, 401 aa, Symbiobacterium thermophilum
MAKKKCVLAYSGGLDTSVAIHWIKENYDADVVALAVDVGANDKDLEFIRQKALSIGAVKSYVYDARKEFAYDFILPTLQANACYESKYYLSAALSRPLIAKLLVQIAEEEGADFVAHGCTGKGNDQVRFEVSVAALNPNLQVLAPVREWGWSREEEIDYAQKHGIPVPVGKENPFSIDVNLWGRSCEAGVLEDPWAEAPEEAFEWTVNPKDAPDEPEYVEIGFEQGVPVSLNGEALDLVTLIERLHAIAGRHGVGRIDHVENRLVGIKSREVYEMPAAAVLTLAHKELETITLPRELHHFKLGLEQKYAELVYNGLWFHPLKEALDAFIKKSQETVTGTVRVRLFKGSAFCVGRTSPYTLYSYDLATYDKADKFDHKAAKGFIDIFGLPTKVYAAVQKSKA

SEQ ID NO: 5691 - DNA, 1206 bp, Syntrophus aciditrophicus
  CDS (1)..(1206): transl_table=11
gtggataccggtgtaaaaaaagtagttcttgcttattctggcggactggatacgtcagtcatcgtccaatggttgatcgaaacatacggatgcgaagtcattgcctttgccgctgacgtcggtcagaaggaagaactggaaggattaagggaaaaagccataaaaaccggggccagtaaaatctatatcgaggatctccgcgaagaattcgcccgggattttgtttttccggcactgcgggcaaacgccatctacgaggggacctatctgctgggaacatcgctggcaagacctttgattgccaaacgccaggtggaaattgcccgggcggaaggggcggatgcggtttgtcatggggcaacgggtaaagggaatgatcaggtgcggttcgaattgacctacatggccttggagccgaacatccggatcatttcggcctggaaggatccaaactggcatttcaaatcccgggaagacatgtttgattacgcggaaaagcacaatatcccgcttcctctcacgcgggaaaagccttacagcagcgaccgcaatctgttgcatatctcacatgagggcgccatcctggaagatccctgggcggaaccgcctgaagacatttttacgatatccttatctcctgaagcagcaccggataagccgacttacgtggaaatcgatttcgaacagggaaatcccgttgctctcgacggtgcacgtctgagtccggcagccctgatggagaagatgaatgacatagcgggggccaacggcatcggccgtgtcgatatggtggaaaaccggttcgtcggaatgaaatcccgaggggtttatgagacgccgggagggaccgtgctctgggcggcacaccgcgccctggagtctctcaccatggacagggaggtgatgctgatgcgcgattctctcattcccaaatacgcccagctggcttacaatggattctggtatgccccggaaatggaagccctgcaggccttgatcgatgaaacccagaaaaaggcaacgggcacggtccggatgaaactctacaagggcaactctattgtcgtcggcagaaagtccccatattccctgtatagtgaagactttgcaacctttgaaaaagatcaggtttacaatcagatggatgcaacggggttcattcggctcaatgcattgagactgcgaatcgcggccatgaagaaataa

SEQ ID NO: 5692 - protein, 401 aa, Syntrophus aciditrophicus
MDTGVKKVVLAYSGGLDTSVIVQWLIETYGCEVIAFAADVGQKEELEGLREKAIKTGASKIYIEDLREEFARDFVFPALRANAIYEGTYLLGTSLARPLIAKRQVEIARAEGADAVCHGATGKGNDQVRFELTYMALEPNIRIISAWKDPNWHFKSREDMFDYAEKHNIPLPLTREKPYSSDRNLLHISHEGAILEDPWAEPPEDIFTISLSPEAAPDKPTYVEIDFEQGNPVALDGARLSPAALMEKMNDIAGANGIGRVDMVENRFVGMKSRGVYETPGGTVLWAAHRALESLTMDREVMLMRDSLIPKYAQLAYNGFWYAPEMEALQALIDETQKKATGTVRMKLYKGNSIVVGRKSPYSLYSEDFATFEKDQVYNQMDATGFIRLNALRLRIAAMKK

SEQ ID NO: 5693 - DNA, 1206 bp, Synechococcus elongatus
  CDS (1)..(1206): transl_table=11
atggggcgtgcagaaaaagtcattttggcctactcggggggggtggatacctccgtgtgtattccctatctccagcacgagtggggagtcaaggaagtgattaccctggcagtggatttaggacagggggatgaactggaacccattcgccaaaaggcccttgatgcaggtgccagcgcctcgttagtggctgatgccaaagctgagttcatccgcaactatgcctttccagccattcaagccaacgccctctacgaaaatcgctatcccctctcgacggcccttgctcgccccttgattgccaagctcttagtggaggcggctacccaatacggtgctgatgctgttgcccacggctgtactgggaaagggaatgatcaagtccgctttgatgtggcgattgctgccctcaatcccaatctcaaggtcttagcacccgcgcgtgaatggggcatgagccgtgaagaaaccattgcctacggcgaacgctttggcattcctgctcctgtgaagaaatcttccccctacagcattgaccgcaatcttttgggacgcagtattgaggccggcccccttgaggatccgtggatggaaccccttgaggaggtctattggatgacccaagccattgaacacacccccaactccccggagtatgtggatattggctttgaagcaggggttcccgtcagcctcgatggtcgccccctggatcccgtgacattggtcagtgaactcaacgagcgagtgggtcgccacggctttggccgcattgatatgattgaaaatcgcctagtcggcattaaatcccgtgaaatttacgaagcccctggtctgctggtgctcattgacgcccaccgcgatttggaaagtttgactctgacggctgatgtgatgcactataagcgaggtattgaggagacctacagccgcttggtttataacggcctctggtacagccccctcaaggaagcccttgatgcctttattcaacagacccagcagcgggtcacaggtaccgtgcgcgtcaagctctttaagggaactgcgcgggtggtgggacgacaatctccctactccctttatacgccggatttggccacctatggcgctgaggatcaattcgaccacagggcagccgagggctttatctatgtgtgggggctacccacccgtgtctgggcagaaaaactgcgccaaggctaa

SEQ ID NO: 5694 - protein, 401 aa, Synechococcus elongatus
MGRAEKVILAYSGGVDTSVCIPYLQHEWGVKEVITLAVDLGQGDELEPIRQKALDAGASASLVADAKAEFIRNYAFPAIQANALYENRYPLSTALARPLIAKLLVEAATQYGADAVAHGCTGKGNDQVRFDVAIAALNPNLKVLAPAREWGMSREETIAYGERFGIPAPVKKSSPYSIDRNLLGRSIEAGPLEDPWMEPLEEVYWMTQAIEHTPNSPEYVDIGFEAGVPVSLDGRPLDPVTLVSELNERVGRHGFGRIDMIENRLVGIKSREIYEAPGLLVLIDAHRDLESLTLTADVMHYKRGIEETYSRLVYNGLWYSPLKEALDAFIQQTQQRVTGTVRVKLFKGTARVVGRQSPYSLYTPDLATYGAEDQFDHRAAEGFIYVWGLPTRVWAEKLRQG

SEQ ID NO: 5695 - DNA, 1203 bp, Synechococcus sp
  CDS (1)..(1203): transl_table=11
atgggtcgcgccaagcgggtggttctggcctattcaggaggcgtcgatacctcggtctgtattccctacctcaagcaagagtggggcgttgaagaggtgattacgctggccgctgaccttggccaaggcgatgaactcgggccgatccgccaaaaagcactcgactcgggcgcagtggaatcgctggtcattgatgcgactgctgagtttgtccgtgactatgcttttccagccattcaagccaactccctctacgaaggccgctatccgctctcgacggctttggcgcgaccgctgatcgccaagctcttggttgaagcagcagccaaatatggcgctgacgccgttgcccacggttgcacaggcaaaggcaatgaccaagttcgctttgatgtctcgatcgctgcactcaatccagatctgaaagtgttggcaccagcacgggaatggggcatgagccgcgaggaaacgatcgcctacggtgagcgctttggtattccggctcctgtcaaaaaatcttcgccctacagcatcgatcgcaacctcttaggtcgcagcatcgaagcgggtccgctggaagatccgctgcatgagccgctagaagaggtctacgccctcacgaaagcgatcgccaacacccccgatgaaccggcctacatcgagctgggcttcgatcaggggctgccggtgacgctcaatggtcaggcattggcaccagttgcgctgatccaacaactgaatgcgatcgccggcgaacatggcatcggccgcatcgacatgatcgaaaaccgcttggttgggatcaagtcccgagaaatctatgaaactccggctctgctggtgctgattcaggcccaccaggatctggaaagtcttgtcctgactgcagacgtcagccagtacaaacgtggcattgaaaatagctggtctaacttggtctacaacggcctctggtacagcccgctcaaagcagcgttggatgccttcattcagcaaactcaacagcgggtgacgggtactgtccgtctgcgactattcaaaggcaacgccactgtcgtcggccgcagctctgagcagtcgctctacagccctgacatggctacctacggcgctgaggatcgattcgatcacaaagctgccgaaggctttatctacgtctggggtatgccaactcgtatttggtcgcaaactcaccgcgcctaa

SEQ ID NO: 5696 - protein, 400 aa, Synechococcus sp
MGRAKRVVLAYSGGVDTSVCIPYLKQEWGVEEVITLAADLGQGDELGPIRQKALDSGAVESLVIDATAEFVRDYAFPAIQANSLYEGRYPLSTALARPLIAKLLVEAAAKYGADAVAHGCTGKGNDQVRFDVSIAALNPDLKVLAPAREWGMSREETIAYGERFGIPAPVKKSSPYSIDRNLLGRSIEAGPLEDPLHEPLEEVYALTKAIANTPDEPAYIELGFDQGLPVTLNGQALAPVALIQQLNAIAGEHGIGRIDMIENRLVGIKSREIYETPALLVLIQAHQDLESLVLTADVSQYKRGIENSWSNLVYNGLWYSPLKAALDAFIQQTQQRVTGTVRLRLFKGNATVVGRSSEQSLYSPDMATYGAEDRFDHKAAEGFIYVWGMPTRIWSQTHRA

SEQ ID NO: 5697 - DNA, 1212 bp, Synechococcus sp
  CDS (1)..(1212): transl_table=11
atgggccgcgccaacaaggtggttctcgcctactccggcggggtggataccagcgtctgcattccctatttgaagcaggaatggggtgttgaagaggtcatcaccttcgccgctgatctcggccagggcgatgagctggaaccgattcgtcaaaaggccctggatgcgggcgcaagtcagtcgttggtgggggatctgattcagcccttcatcgaagagttcgccttccctgccatccgcgctaacgcgctgtacgaggggcgctaccccctctccacagcattggcgcggccgttgatcgctcgccgattggtggaggtggcccgtgaggtgggtgctgatgcagtggcccatggctgcactggcaagggcaacgaccaggtgcgcttcgatgtggcgattgctgctcttgctcccgatctgaaggtgctgacccccgcgagggagtgggggatgagccgtgaggagaccattgcctatggcgagcgctgcggaatcccggcgccggtgagcaagaagtcgccctactcgatcgatctcaaccttctgggtcgcagcatcgaggcgggaccgcttgaagatccgatggtggcgcctccggaggaggtgttcgccatgacctcaccgatgtcggatacgcctgatgcggcggaggagatcgagattgccttcgaagccggcaaccccgtcgccatcaatggccaggttctggatccggtggcgatgatccgcgaagccaaccgtctggcgggcagtcacggcatcggccgtctcgacatgatcgagaaccgggtggtggggattaaatccagggagatctacgaaacaccgggcttgctgctgttgattcaggcccatcaggaactggagagtttgacgttggccgcggatgttctgcgcagcaaacgtcagctggagatgcagtgggctgacctggtgtatcaggggctgtggttcgggccgctgaaggatgcattggacggtttcatggaccggacccagcagcatgtcaacggcgtcgtgcgcctgcgtctgtacaagggcaatgccacggtcatcggccgcggttcaacccagagcagcctgtatgtgcctgcgatggcgtcctacggcagtgaagacgccttcgaccatcgcgccgctgagggattcatctacgtctggggattgccaacccgtctctgggctgcttcccaacggacatcaggctga

SEQ ID NO: 5698 - protein, 403 aa, Synechococcus sp
MGRANKVVLAYSGGVDTSVCIPYLKQEWGVEEVITFAADLGQGDELEPIRQKALDAGASQSLVGDLIQPFIEEFAFPAIRANALYEGRYPLSTALARPLIARRLVEVAREVGADAVAHGCTGKGNDQVRFDVAIAALAPDLKVLTPAREWGMSREETIAYGERCGIPAPVSKKSPYSIDLNLLGRSIEAGPLEDPMVAPPEEVFAMTSPMSDTPDAAEEIEIAFEAGNPVAINGQVLDPVAMIREANRLAGSHGIGRLDMIENRVVGIKSREIYETPGLLLLIQAHQELESLTLAADVLRSKRQLEMQWADLVYQGLWFGPLKDALDGFMDRTQQHVNGVVRLRLYKGNATVIGRGSTQSSLYVPAMASYGSEDAFDHRAAEGFIYVWGLPTRLWAASQRTSG

SEQ ID NO: 5699 - DNA, 1206 bp, Synechococcus sp
  CDS (1)..(1206): transl_table=11
atgggacgcgcaaccaaggtcgttctcgcctattccggtggggtggacaccagcgtctgcatcccttacctcaagcaggaatggggtgtggaggaggtgatcaccttcgccgctgatctcggtcagggcgatgaacttgagccgatacgactcaaagcgctcgaggcgggagcgactcaatctttggttggtgacctgattaagccattcatcgaggaattcgcctttcctgcgattcgcgcgaatgctctttatgagggtcgctatcccctctcaacggccttggcgcgccctttgatcgctcgtcgtctcgttgaggtggcacgagaggtaggagctgatgctgtggcccatggctgcaccggcaagggaaacgatcaggtgcgttttgatgtggcgattgcatcgcttgcgcccgacttaaaggttttaacgccagcgcgtgaatggggcatgagccgggaggaaacgattgcctatggcgagcggtttggcatgccatcacccgtgagcaaaaaatccccttattcaatcgatctcaatctgctcgggcgcagcattgaagctggtcccctggaagacccgatggtggcgccaccggaagaggtctttgcgatgacccgttccgtggaccaaaccccgaacgatgccgaggagatcgagatccagtttgaaggtggtaatcctgtagcaatcaatggcaaaaggctcgagcccgtgtcgctgatccgggaagccaacctcttggcaggcacccatggcattggtcgtctcgacatgatcgagaaccgtgtggtgggaattaaaagcagggaaatttacgaaacgcctggattactactgttgattcaggcgcatcaggagttggagagtctcactctcgccgccgatgtattgcggaccaagcgccagctcgagatgcaatgggcagatctcgtctatcaaggcctctggtttggtcctctcaaagaggctcttgatggcttcatggatcgcactcagattcatgtgaatggggttgtgcgcctgaaacttcacaagggcaatgccacggtgactgggagagcttctacagacaacagcttgtacattcccgagatggcctcatacggcagcgaagacaagttcgatcatcgtgctgcggaaggctttatctacgtctggggcctgcccacacgcttgtgggccgccaagcatcggcgttga

SEQ ID NO: 5700 - protein, 401 aa, Synechococcus sp
MGRATKVVLAYSGGVDTSVCIPYLKQEWGVEEVITFAADLGQGDELEPIRLKALEAGATQSLVGDLIKPFIEEFAFPAIRANALYEGRYPLSTALARPLIARRLVEVAREVGADAVAHGCTGKGNDQVRFDVAIASLAPDLKVLTPAREWGMSREETIAYGERFGMPSPVSKKSPYSIDLNLLGRSIEAGPLEDPMVAPPEEVFAMTRSVDQTPNDAEEIEIQFEGGNPVAINGKRLEPVSLIREANLLAGTHGIGRLDMIENRVVGIKSREIYETPGLLLLIQAHQELESLTLAADVLRTKRQLEMQWADLVYQGLWFGPLKEALDGFMDRTQIHVNGVVRLKLHKGNATVTGRASTDNSLYIPEMASYGSEDKFDHRAAEGFIYVWGLPTRLWAAKHRR

SEQ ID NO: 5701 - DNA, 1212 bp, Synechococcus sp
  CDS (1)..(1212): transl_table=11
atgggccgcgccaagaaggtggtactcgcctattccgggggagtggataccagcgtctgcattccgtacctgaagcaggaatggggtgtggaggatgtgatcacatttgccgctgacctcggccagggcgatgagctggagccgattcgtcagaaagcgctggatgccggtgccagtcagtcgctggtgggagatctgattgagcccttcatcaaggatttcgcctttccagcgattcgtgccaacgccctctacgaaggccgttatcccctttccacggccctcgcgaggcctctgattgccaagcgccttgttgaggtggcccgggaggtgggtgccgatgctgtcgcccatggatgcacaggcaagggcaacgaccaggtgcgttttgatgtggccatcgctgcattggctccggatctcaaggtgctcactcctgcccgtgagtggggcatgagccgcgaggagaccatcgcctacggcgaacgctttggtctgcccgcaccggtgagcaagaagtcgccttattcgatcgatctcaatttgctgggccgaagcattgaggccggaccccttgaagacccgatggtggctccgccggaggaggtgtttgccatgacgcgatcggtggaggctgctccggatgcctccgaagagatcgagattgcttttgaagcaggcaatcctgtggggatcaacggccagaagctggaccctgtggccctgatccgtgaagccaaccgtctggcgggcatccatggcattggccgtctcgacatgatcgagaaccgggtggtgggcatcaaatccagggagatctacgaaacgcctggccttttgctgtttatccaggcccaccaggaactggaaagcctgaccctggccgccgatgtgctgcgcagcaagcggcaattggagatgcagtgggccgatctcgtctaccagggcctttggtttggtcctctcaaggatgctcttgatggcttcatggaccgcacccaggccaccgtcaatggtgtcgttcgtctccggctgcacaaaggaactgccacggtcaccggccgcggctcagcagacagcagcctgtacgtccccgaaatggcgtcctacggcagtgaggatcagttcgatcaccgcgctgcagagggcttcatttatgtctggggtctgccaacccgactctggtcagcatcccagcgccgctcaagctga

SEQ ID NO: 5702 - protein, 403 aa, Synechococcus sp
MGRAKKVVLAYSGGVDTSVCIPYLKQEWGVEDVITFAADLGQGDELEPIRQKALDAGASQSLVGDLIEPFIKDFAFPAIRANALYEGRYPLSTALARPLIAKRLVEVAREVGADAVAHGCTGKGNDQVRFDVAIAALAPDLKVLTPAREWGMSREETIAYGERFGLPAPVSKKSPYSIDLNLLGRSIEAGPLEDPMVAPPEEVFAMTRSVEAAPDASEEIEIAFEAGNPVGINGQKLDPVALIREANRLAGIHGIGRLDMIENRVVGIKSREIYETPGLLLFIQAHQELESLTLAADVLRSKRQLEMQWADLVYQGLWFGPLKDALDGFMDRTQATVNGVVRLRLHKGTATVTGRGSADSSLYVPEMASYGSEDQFDHRAAEGFIYVWGLPTRLWSASQRRSS

SEQ ID NO: 5703 - DNA, 1203 bp, Synechocystis sp
  CDS (1)..(1203): transl_table=11
atgggtcgcgccaagaaagtcgttctcgcctattccggtggggtagatacatcggtttgtattccctatttgatgcacgaatggggcgttgaggaagttattaccctcgcggcggatttgggccagggggatgaactggggccgatccaggaaaaagccctgcggtgtggtgcggtagaatccttggttattgacggcaaggaagaattcgttaaggagtatgcttttcgttctatccaggccaatgctctctacgaaaaccgttatcccctctccacagccctagcccggcccttaattgccaaaatgctggtggaagcggcggaaaaatacggtgccgatgcggtggcccatggttgtactggtaagggcaatgaccaagtgcggttcgatatcagcattatggccctaaaccccaatttgaaggtgttggccccagcccgggaatggaaaatgagccgggaagaaaccatcgcctatggggaacggtatggcgtagaatcccccgtgaaaaagtcttccccctacagcattgaccgcaacattctcggccgtagcattgaagcggggcctctggaagaccccatgaccgagcccacggaagaaatttatctgatgaccaaggcgatcgccgacaccccagatgaaccggaatatgtggacatcggctttgaaaaaggtattcccgttagtttgaatggggtgatgctagaccccgttaccctggtggaacgcctgaacgaaattgcggggaaccacggggtaggccgtttggatatggtggagaaccgggtggtggggattaaatcccgcgagatttacgaagctccggctttgctagttttaattgatgcccaccgggatctggaaagtttgacccaaaccgccgatgttacccactataaaaacaccgtcgaagaaatttatagtcagttaatttaccggggattatggtacagccccctcaaagaagccctggatgcttttattgtcaaaacccaggaacgggttacgggcatggtgcgggtgaaattcttcaagggcaatgccaacgttgccggtcgtaaatccgattactccatctatgatgcggaattggccacctacggcatggaagaccaattcgaccataaggcggcggaaggctttatctatatttggggcttacccaccaaagtttgggcccagaaaatgcgcggttaa

SEQ ID NO: 5704 - protein, 400 aa, Synechocystis sp
MGRAKKVVLAYSGGVDTSVCIPYLMHEWGVEEVITLAADLGQGDELGPIQEKALRCGAVESLVIDGKEEFVKEYAFRSIQANALYENRYPLSTALARPLIAKMLVEAAEKYGADAVAHGCTGKGNDQVRFDISIMALNPNLKVLAPAREWKMSREETIAYGERYGVESPVKKSSPYSIDRNILGRSIEAGPLEDPMTEPTEEIYLMTKAIADTPDEPEYVDIGFEKGIPVSLNGVMLDPVTLVERLNEIAGNHGVGRLDMVENRVVGIKSREIYEAPALLVLIDAHRDLESLTQTADVTHYKNTVEEIYSQLIYRGLWYSPLKEALDAFIVKTQERVTGMVRVKFFKGNANVAGRKSDYSIYDAELATYGMEDQFDHKAAEGFIYIWGLPTKVWAQKMRG

SEQ ID NO: 5705 - DNA, 1218 bp, Thermoplasma acidophilum; identical to SEQ ID NO: 5175
  CDS (10)..(1218): transl_table=11

SEQ ID NO: 5706 - protein, 402 aa, Thermoplasma acidophilum
MDKALLLYSGGLDTSVMIKWIQENLSMDVATLTLNVGNSDLVAIEEKARMLGADPVFVHDAKDEFAEKFIAKSIMANGSYEGYPLSTALARPLMAEKAVKYAQKIGAKYIVHGSTGRGNDQVRFEVSIRALDPSMQVLVPVREWNMMRKDEVEYAKTHGIPVKLDGKYSIDENIWGRSVEGPDLEDIGKGVPEDVYEWVVPPWKANAEHTLKIAFDGGIPSEIDGEKMKLADLIVFLNTLAGSSGIGLIDHMENRVVGLKSHEVYECPAATVITHAHRYLESLILNRNEAEVKMNMDWQFAKFVYGGLWHDPVMNAVNAAEAEFNRDISGEIKIRMSHGIMYIEGAWGNSFLYSKDLINYSSMAFDQRASKGFIDIYGNATVHSHNRNPKMVKEVQGSSVEF

SEQ ID NO: 5707 - DNA, 1200 bp, Thermobifida fusca
  CDS (1)..(1200): transl_table=11
atgaccgagcgggtcgtactcgcatactcaggaggactcgacacctccgtggctatcggctggatcgccgaagagaccggggctgaagtcatcgcggtcgccatcgactgcggccaaggcggagaggacatggaagtcatccgccagcgggccctggcttgcggcgcggtggaggcggtcatcgccgacgccaaggaggagttcgccaacgactactgtgtgccggccatccaagccaacgcgctctacatggaccgctacccgctggtctccgcgctgtcgcggccgctgatcgtcaagcacctggccgaggctgcgcgctaccacggggccaccatggtcgcgcacggctgcaccggtaaaggcaacgaccaggtgcgtttcgaagcgggcctggcagcgctcttccccgagctgaaggtcctcgccccggtccgggactcgggcatgacccgcgacaaggcgatcgcgttcgctgaagagaagggtctgccgatcgacgtcaccaagaagtcgccgtactccatcgaccagaacctgttcggccgcgccgtggagaccggcttcctggaggacatctggaacggccccatcgaggacatctacgactacacccagaacccggccgagccgcgggagcccgacgaggtcgtcatcaccttcaccgccggggtgcccaccgccctcgacggcaaggagctcagcccgctggagatcatccaggagctgaaccggcgcgccggcgcccagggcgtgggccgtatcgacatggtcgaagaccgcctggtgggcatcaagagccgcgaagtctacgaggcgcccggcgcgatcaccctcatcaccgcgcaccaggagctggagaacgtcaccgtcgaacgcgagctggcccgcttcaagcgctgggtggaccagcggtggggcgagctggtctacgacggcctgtggttctccccgctgaagaacgcgctggacaagttcatcctcgaagccaacaagcacgtcaccggcgacatccggatggtgctgcacggcggccgggccgtggtcaccggtcggcgcagcgaggcctccctctacgactaccacctggccacctacgacagcggcgacacctacgaccagagcctggcccgcggattcatcgacatctggagcatgcccgccaagatcgccaacatgcgcgaccgccggctctcctga

SEQ ID NO: 5708 - protein, 399 aa, Thermobifida fusca
MTERVVLAYSGGLDTSVAIGWIAEETGAEVIAVAIDCGQGGEDMEVIRQRALACGAVEAVIADAKEEFANDYCVPAIQANALYMDRYPLVSALSRPLIVKHLAEAARYHGATMVAHGCTGKGNDQVRFEAGLAALFPELKVLAPVRDSGMTRDKAIAFAEEKGLPIDVTKKSPYSIDQNLFGRAVETGFLEDIWNGPIEDIYDYTQNPAEPREPDEVVITFTAGVPTALDGKELSPLEIIQELNRRAGAQGVGRIDMVEDRLVGIKSREVYEAPGAITLITAHQELENVTVERELARFKRWVDQRWGELVYDGLWFSPLKNALDKFILEANKHVTGDIRMVLHGGRAVVTGRRSEASLYDYHLATYDSGDTYDQSLARGFIDIWSMPAKIANMRDRRLS

SEQ ID NO: 5709 - DNA, 1230 bp, Thermotoga maritima
  CDS (1)..(1230): transl_table=11
atgaaagagaaagtcgttcttgcatacagtggtggtctcgatacttccgtcattttgaagtggctctgcgaaaagggcttcgacgtgatagcttacgttgcaaacgttggacagaaggacgatttcgttgcaataaaagaaaaggccttgaaaacaggcgcttcaaaagtctacgtggaagacctcagaagggaattcgtcacagattacatattcaccgcactccttggaaacgccatgtacgaaggaaggtaccttcttggaaccgctatcgcaagacctctcatagccaaaagacaggtggagatagccgagaaagaaggagcacagtacgttgcgcacggtgcgaccgggaaaggaaacgaccaggtgaggttcgagctcacctacgccgctttgaatccaaatctcaaagttatctcaccctggaaagaccctgaatttctcgccaaattcaagggcagaacagatctcataaactacgccatggagaaagggattccaatcaaagtctccaaaaaaagaccctacagcgaagacgaaaacctcatgcacatttcccacgaagcgggcaaactggaggatcccgcacacatacctgacgaagacgtgttcacatggacagtctccccaaaggacgctccggatgaagaaaccttgctcgagatccatttcgaaaacggcattccggtgaaagttgtgaacctcaaagatggaacagaaaagacagatcccctcgaactcttcgaatatctgaacgaagtaggtgcgaaaaatggagtgggaagactcgacatggtcgaaaacagattcataggtataaaatcaagaggggtgtacgaaactccgggcgcgacgatcctgtggatcgcacacagagatctcgaaggaatcaccatggacaaagaagtcatgcacctgagagacatgctcgctccgaagttcgcggagctcatatacaacggtttctggttttctccagaaatggagttcctcctcgcagcgttcagaaaagcacaggagaacgtgaccggaaaggtgacggtatccatatacaaaggaaacgtcatgcccgttgcgaggtattcaccgtattcactgtacaatccggaactttcgagcatggacgtcgaaggaggattcgatgccactgactcgaagggcttcatcaacattcacgccctgaggttgaaggtccaccagctcgtgaaaaaggggtatcagagatga

SEQ ID NO: 5710 - protein, 409 aa, Thermotoga maritima
MKEKVVLAYSGGLDTSVILKWLCEKGFDVIAYVANVGQKDDFVAIKEKALKTGASKVYVEDLRREFVTDYIFTALLGNAMYEGRYLLGTAIARPLIAKRQVEIAEKEGAQYVAHGATGKGNDQVRFELTYAALNPNLKVISPWKDPEFLAKFKGRTDLINYAMEKGIPIKVSKKRPYSEDENLMHISHEAGKLEDPAHIPDEDVFTWTVSPKDAPDEETLLEIHFENGIPVKVVNLKDGTEKTDPLELFEYLNEVGAKNGVGRLDMVENRFIGIKSRGVYETPGATILWIAHRDLEGITMDKEVMHLRDMLAPKFAELIYNGFWFSPEMEFLLAAFRKAQENVTGKVTVSIYKGNVMPVARYSPYSLYNPELSSMDVEGGFDATDSKGFINIHALRLKVHQLVKKGYQR

SEQ ID NO: 5711 - DNA, 1203 bp, Thermus thermophilus
  CDS (1)..(1203): transl_table=11
atgaagatcgtcttggcctactccggcggactggacaccagcatcatcctgaagtggctcaaggagacctatggggccgaggtcatcgcctttaccgcggacatcggccagggggaggaggtggaggaggcccgggagaaggcgctgaggacgggggcttccaaggccatcgccctggacctcaaggaggagtttgtccgcgacttcgtcttccccatgatgcgggctggcgcggtgtacgagggctactacctcctcggcacctccatcgcgaggcctttgatcgccaagcacctggtgcggatcgccgaggaggagggggcggaggccatcgcccacggggccacggggaaggggaacgaccaggtgcgctttgagctcaccgcctacgccctgaagcccgacatcaaggtcatcgccccctggcgggagtggagcttccagggccgcaaggagatgatcgcctacgccgaggcccacggcatccccgtccccgtgacccaggagaagccttactccatggacgccaacctcttgcatatttcctacgagggcggggtcctcgaggacccctgggccgagccccccaaggggatgttccgcatgacccaagaccccgaggaggcccccgacgccccggagtacgtggaggtggagttttttgagggcgaccccgtggcggtgaacggggagaggctttccccggcggccctcctgcagaggctcaacgagctcggggggcggcacggggtgggccgggtggacatcgtggagaaccgcttcgtgggcatgaagtcccggggggtctacgagaccccgggggggacgatcctctaccacgccaggcgggcggtggaaagcctcaccctggaccgcgaggtcctccaccaaagggacatgctctcccccaagtacgccgagctcgtctactacggcttctggtacgccccggagcgggaggcccttcaggcctactttgaccacgtggcgaagaacgtcaccggcgtggcccggctcaagctctacaaggggaacgtctacgtggtgggaaggaaggccccgaagagcctctaccgccaggacctggtctcctttgacgaggcagggggctacgaccagaaggacgccgagggcttcatcaagatccaggccctgcgcctccgggtgcgggcccttgtggagagggagggccatggcgcatag

SEQ ID NO: 5712 - protein, 400 aa, Thermus thermophilus
MKIVLAYSGGLDTSIILKWLKETYGAEVIAFTADIGQGEEVEEAREKALRTGASKAIALDLKEEFVRDFVFPMMRAGAVYEGYYLLGTSIARPLIAKHLVRIAEEEGAEAIAHGATGKGNDQVRFELTAYALKPDIKVIAPWREWSFQGRKEMIAYAEAHGIPVPVTQEKPYSMDANLLHISYEGGVLEDPWAEPPKGMFRMTQDPEEAPDAPEYVEVEFFEGDPVAVNGERLSPAALLQRLNELGGRHGVGRVDIVENRFVGMKSRGVYETPGGTILYHARRAVESLTLDREVLHQRDMLSPKYAELVYYGFWYAPEREALQAYFDHVAKNVTGVARLKLYKGNVYVVGRKAPKSLYRQDLVSFDEAGGYDQKDAEGFIKIQALRLRVRALVEREGHGA

SEQ ID NO: 5713 - DNA, 1233 bp, Thermoanaerobacter tengcongensis
  CDS (1)..(1233): transl_table=11
atgttaaaaggtgaaaaagtggtactggcatattcgggaggacttgacacctcagtgattataccatggttaaaagaaaattatgaatgtgaaataatagcggtatgcgtggatgtagggcaaagggaagacctaaggtatataaaagataaagctttagcaagtggtgccagcaaagtatatattgaagatgtcaaagaggagtttgtaaaagactatatatttcctacattaaaagcgggggctatatatgaaggaaaataccttctgggaacttcaatggcaaggcctttaattgccaaaaaacttgtagaaattgctcacaaggaaggtgccaaggcgatagcccatggtgcgacaggcaaaggcaatgaccaggtgaggtttgaagtttcaatacgtgctcttgatccttcaataaaaataatagcaccatggagaatatgggaattaaaatcgagggaagatgaaatagaatatgctaaaaagaaaggaatacctattcctgtaactaaagaaaaaatatacagtgtagacagcaatctgtggcatgtgagtcatgagggaggagaccttgaagacccgtggaatgagcctaaaagtgatatttacgatatagttactcctccagagaaagtctcagataagccggaatatgtctatatagagtttgaaaagggcattcctgtaaaggtaaatggaaaaacgctaagccctgtcaaattaatagaagaattaaatgaaattggaggaagaaatggggtagggatagttgaccttgttgaaaatagacttgtaggaatgaaatctcgtggtgtttacgagactcctgcaggaacgttactttatattgctcacagagaacttgagtaccttgtacttgataaagaaacgatgaggtttaaagagttggtagcacagaaatatgcggatctggtctataacggcctctggttttcacctctcaaaacagctttggatgcttttattgatgagacgcagaaaaatgtaacgggtgttgtaaggctaaagctttataaaggaaatgtcataaatgcgggtgcaaaatctccctattctctttacaacgaagaattcgcaacttttggtaaagatgaagtttacaaccaaaaagacgcagaaggatttataaacctctttgggctttctttaaaaattagggctttgatggaaatgggaaggaaggatatggatgaagctgtggggaggtag

SEQ ID NO: 5714 - protein, 410 aa, Thermoanaerobacter tengcongensis
MLKGEKVVLAYSGGLDTSVIIPWLKENYECEIIAVCVDVGQREDLRYIKDKALASGASKVYIEDVKEEFVKDYIFPTLKAGAIYEGKYLLGTSMARPLIAKKLVEIAHKEGAKAIAHGATGKGNDQVRFEVSIRALDPSIKIIAPWRIWELKSREDEIEYAKKKGIPIPVTKEKIYSVDSNLWHVSHEGGDLEDPWNEPKSDIYDIVTPPEKVSDKPEYVYIEFEKGIPVKVNGKTLSPVKLIEELNEIGGRNGVGIVDLVENRLVGMKSRGVYETPAGTLLYIAHRELEYLVLDKETMRFKELVAQKYADLVYNGLWFSPLKTALDAFIDETQKNVTGVVRLKLYKGNVINAGAKSPYSLYNEEFATFGKDEVYNQKDAEGFINLFGLSLKIRALMEMGRKDMDEAVGR

SEQ ID NO: 5715 - DNA, 1203 bp, Trichodesmium erythraeum
  CDS (1)..(1203): transl_table=11
atgagtcgtgctactaaagttgtgctagcttattctggaggagtagatacttctgtttgtatcccttatctgaaaaatgaatggggagtaaaagaagtaattaccctagcagcagatttaggtcaaggagatgaattagaaggagttcggaaaaaagcattagattctggggcagtagaatctctagtcatagatgttattgaacctctaattaaagaatatgcttttcctgctattcaagcaaatgctctatatgaaaatcgctaccctctagcaacagcattagctcgacctctaattgccaaaatattagtagaggcagcagaaaaatatggtgctgatgctattgcccacggttgtacaggaaaaggtaatgaccaggtaaggtttgatgttgctattgccgcactaaatcctcaaattaagattcttgcacctgcgcgggagtggggaatgagtcgggaggagactattgcttatggtgaagagtatggcattccggctcctgtgaaaaaatcttccccttatagtatagataagaatttattggggatggcgatcgaagctggtgagttggaagatccttgggtggagcccccagaagaagtttatgggatgactaaggcgatcgctgacactcccaacgaaccagaatatatagagattggttttgagcggggtattcctgttagtcttaatggtcaagaaatgggtggtattgagttgataactaaacttaatcagatagcaggaaaccatggcattggtcgaattgacatgattgaaaaccgtctggtggggattaagtcgagagaaatttatgagtctccggcaatgtgggtgttaattcaaggacaccgagatttagagagtttgactttaactgctgatgtaactcgttataagcggggtattgaggagacttatagtcagttggtttataacggtttgtggtttagtccgttgaagggtgcattggatgcttttattcagcagacccaggaaagggtgactggtgttgtgcgggtcaagttgtttaagggtaatgcaatggttgttggtcgtaagtctgataattctttgtatagttttgacttagcgacttatggtgcggaggatgagtttgaccataaagcggcggaaggatttatttatgtttggggtttgccgactcgtgtttggtcagagaaactccggggttaa

SEQ ID NO: 5716 - protein, 400 aa, Trichodesmium erythraeum
MSRATKVVLAYSGGVDTSVCIPYLKNEWGVKEVITLAADLGQGDELEGVRKKALDSGAVESLVIDVIEPLIKEYAFPAIQANALYENRYPLATALARPLIAKILVEAAEKYGADAIAHGCTGKGNDQVRFDVAIAALNPQIKILAPAREWGMSREETIAYGEEYGIPAPVKKSSPYSIDKNLLGMAIEAGELEDPWVEPPEEVYGMTKAIADTPNEPEYIEIGFERGIPVSLNGQEMGGIELITKLNQIAGNHGIGRIDMIENRLVGIKSREIYESPAMWVLIQGHRDLESLTLTADVTRYKRGIEETYSQLVYNGLWFSPLKGALDAFIQQTQERVTGVVRVKLFKGNAMVVGRKSDNSLYSFDLATYGAEDEFDHKAAEGFIYVWGLPTRVWSEKLRG

SEQ ID NO: 5717 - DNA, 1215 bp, Vibrio cholerae
  CDS (1)..(1215): transl_table=11
atgagtaaagtacaagttaaaaaagtagttgtggcatattctggcggtctggacacgtcggtgatcattccatggttaaaagaaaattatgactgtgaagtggtggcgtttgtggctgacgttggtcaaggtgatgaagagctgaaaggcgtagaagccaaagcactctcatcgggtgcctctgaatgttacatcgttgacctgaaagaagaattcgtaaaagagtacatctacccaacgctgaaaactggcgcttactatgaaggtaaatacttactcggtacttccatggcgcgtccggtgattgctaaagcacaagttgaaatcgcgcgtaaagtgggtgcggatgcactggcgcacggttgtactggcaaaggtaacgaccaagtgcgttttgaaggtgcttttgcggcactggctccagatctgcatgtgattgcgccttggcgtgagtgggatctgcgtagccgtgaagcgtgtttggattaccttgccgagcgcaacattccctgtgccgcgtcattaaccaagatctactcgcgtgatgccaacgcatggcacgtttctaccgaaggtggcgttctggaaagcacatggaatgcgccaaacgaagattgctgggtgtggaccgtcgatcctgagcaagcgcctaacgaagcggaatatgtcacgctgcaagtggctcatggcgaagtggtcgctgttgatggtgaagccatgaccccttacaacgctttgctgtacctcaaccaaaaaggtgcaaagcatggtgtaggtcgtatcgacatcgtggaaaaccgtttggtgggtatgaaatctcgcggctgctacgaaaccccgggaggcaccatcatcatggaagcgctgcgcgcggttgagcaactggtgctggataaaacctcattcgaattccgtgaagagctgggtattaaagcgtcacaccttgtttatgatggtcgttggttcacgccactacgtcaggcggtatttgcggcagccgatgagctagcgaaagatgtcaacggtgaagtggtgattaaactgtataaaggccaagccgttgcaacgcaaaaacgttcggctaacagcctctactcagaagatttcgcgacctttggtgccgatgaagtgtatgaccacagccacgcaggcggcttcatccgtctctattcgctgtcaagccgcatccgcgctctgagccaaaacaagcagtaa

SEQ ID NO: 5718 - protein, 404 aa, Vibrio cholerae
MSKVQVKKVVVAYSGGLDTSVIIPWLKENYDCEVVAFVADVGQGDEELKGVEAKALSSGASECYIVDLKEEFVKEYIYPTLKTGAYYEGKYLLGTSMARPVIAKAQVEIARKVGADALAHGCTGKGNDQVRFEGAFAALAPDLHVIAPWREWDLRSREACLDYLAERNIPCAASLTKIYSRDANAWHVSTEGGVLESTWNAPNEDCWVWTVDPEQAPNEAEYVTLQVAHGEVVAVDGEAMTPYNALLYLNQKGAKHGVGRIDIVENRLVGMKSRGCYETPGGTIIMEALRAVEQLVLDKTSFEFREELGIKASHLVYDGRWFTPLRQAVFAAADELAKDVNGEVVIKLYKGQAVATQKRSANSLYSEDFATFGADEVYDHSHAGGFIRLYSLSSRIRALSQNKQ

SEQ ID NO: 5719 - DNA, 1215 bp, Vibrio parahaemolyticus
  CDS (1)..(1215): transl_table=11
atgagcaaagtgaacgtaaataaagtggtagtcgcatactcaggcggtctagatacttcagtaatcatcccgtggctaaaagagaattatgactgtgaagtcgtcgctttcgtggccgatgtaggtcaaggtgctgaagagcttgaaggcatcgaagcgaaagcaaaagcatctggcgcatcagagtgctacatcgctgacctaaaagaagaaatggtagcagactacatctacccaacactaaaaaccggtgcttactacgaaggcaaatacctgttgggtacatcaatggcgcgtccaatcattgccaaagcgcaagttgaagtggcacgtaaagtgggcgcggacgcattgtgtcacggctgtactggtaaaggtaacgaccaagtgcgtttcgagggtgcatttgctgcgttagcaccagatctacacgttatcgctccatggcgtgagtgggatttagtgagccgcgaacaatgtctggattaccttgcagagcgtaacattccttgctcagcgtctctaacgaagatttactcacgtgatgcgaacgcatggcacatttctaccgaaggtggtgtgcttgaaaatacatggaatgcaccaaacgaagattgctgggtctggaccgttgatcctgaacaagcgccaaatgaagctgaatacgttacgttgaaagtcgaaaaaggtgaagttgtggcagtggatggtgaagcgatgacaccatacaacgcactagtttacttaaacgaaaaaggcgcaaaacacggtgtgggtcgtattgatatcgtagagaaccgtttggtgggaatgaagtctcgtggctgttacgaaactccgggaggtaccatcatgatggaagctctgcgcgcagttgaacaattggtgctagacaaatcgtcattcgagttccgtgaagaacttggtctaaaagcctctcaccttgtgtacgacggtcgttggtttacaccgctatgtaagtcgattcttgctgcctcagaagagctagcacaagacgtcaatggcgaagtggttgttaagctatacaaaggtcaagcaacggtaacgcaaaaacgttctgacaacagcttgtactcagaagagttcgctacttttggtgaagatgaggtttacgatcaaagtcatgctggtggcttcatccgcctttactcgctatcaagccgtattcgtgcattgaacagccagaagaaataa

SEQ ID NO: 5720 - protein, 404 aa, Vibrio parahaemolyticus
MSKVNVNKVVVAYSGGLDTSVIIPWLKENYDCEVVAFVADVGQGAEELEGIEAKAKASGASECYIADLKEEMVADYIYPTLKTGAYYEGKYLLGTSMARPIIAKAQVEVARKVGADALCHGCTGKGNDQVRFEGAFAALAPDLHVIAPWREWDLVSREQCLDYLAERNIPCSASLTKIYSRDANAWHISTEGGVLENTWNAPNEDCWVWTVDPEQAPNEAEYVTLKVEKGEVVAVDGEAMTPYNALVYLNEKGAKHGVGRIDIVENRLVGMKSRGCYETPGGTIMMEALRAVEQLVLDKSSFEFREELGLKASHLVYDGRWFTPLCKSILAASEELAQDVNGEVVVKLYKGQATVTQKRSDNSLYSEEFATFGEDEVYDQSHAGGFIRLYSLSSRIRALNSQKK

SEQ ID NO: 5721 - DNA, 1215 bp, Wolinella succinogenes
  CDS (1)..(1215): transl_table=11
atgtccaaaaaaatcaacaaaatcgtccttgcctattcgggaggtcttgacaccagcgtcatcttgaaatggcttcaagagcagtatcagtgtgaagtggtcaccttcacggcggatatcggtcaaggcgaagaggtcgagcctgcacgcgccaaagcgaaacttcttggaatcaaagaggagaacattttcatcaaagatctcaaagaggaatttgtccgcgactatgtttttcccatgtttcgagccaataccctttatgaaggcgaataccttctaggtacctctatcgctagaccccttatcgccaagcacctcgtggagatcgccaaagaggtcggagcggatgccatctctcatggcgccacaggcaaaggaaacgaccaagtgcgatttgagcttggaggctatgcgctcatgcccgatgtcaaagtggtcgccccctggagagagtgggatctaaactctcgtgaaaaactcctcgcctacgccgaaaaacatgggattcccatcgagaaaaagggcaaaaaatctccctactctatggacgccaacctcctgcatatctcctatgaagggggaatcctcgaagatcccgccagcgaacctgaggaggatatgtggagatggagcgtctctcctttggacgcacccgatgctccagagaggatcaccattgagtttgaaaggggcgatgccgtagggattaatggcgtgaaaatgtctcccgccaccctcctagccgagctcaatcgcctaggaggcaaacatggaatcgggcggcttgatcttgtggagaatcgctatgtcggaatgaaatctcgcggatgctatgaaactcccggaggcacgattcttctcaaagctcaccgcgccatcgaatcgctaaccctagatcgagaagagactcacctcaaagatgagatgatgccacgctacgctagcctcatctacaatggctactggttctctcctgagcgccgcgccctccaagccctcatcgatgagacacaaaaaaatgtcacgggcagcgttgggctcaaactctataagggcaatgtcatccttgcgggccgcacctccgagcgatcgctcttcaacaccgcctactccacctttgaagaggatagcgtctataaccaaaaagatgccgaaggcttcatcaagctcaacgctctacgcttcatcatcgcaggcaaggcgaatccatcatga

SEQ ID NO: 5722 - protein, 404 aa, Wolinella succinogenes
MSKKINKIVLAYSGGLDTSVILKWLQEQYQCEVVTFTADIGQGEEVEPARAKAKLLGIKEENIFIKDLKEEFVRDYVFPMFRANTLYEGEYLLGTSIARPLIAKHLVEIAKEVGADAISHGATGKGNDQVRFELGGYALMPDVKVVAPWREWDLNSREKLLAYAEKHGIPIEKKGKKSPYSMDANLLHISYEGGILEDPASEPEEDMWRWSVSPLDAPDAPERITIEFERGDAVGINGVKMSPATLLAELNRLGGKHGIGRLDLVENRYVGMKSRGCYETPGGTILLKAHRAIESLTLDREETHLKDEMMPRYASLIYNGYWFSPERRALQALIDETQKNVTGSVGLKLYKGNVILAGRTSERSLFNTAYSTFEEDSVYNQKDAEGFIKLNALRFIIAGKANPS

SEQ ID NO: 5723 - DNA, 1194 bp, Xanthomonas campestris pv
  CDS (1)..(1194): transl_table=11
atgagcagcaaagatatcgtcctcgctttctccggtggcctcgacaccagcttctgcattccgtacctgcaggagcgcggctatgccgtgcacaccgtgttcgccgataccggcggtgtggatgccgaagaacgcgatttcatcgagaagcgcgccgccgagctgggcgcagccagccatgtcaccgtcgatggcggcccggcgatctgggaaggcttcgtcaagccgttcgtgtgggccggcgagggctaccagggccagtacccgttgctggtgtccgaccgttacctgatcgtcgatgctgcgctcaagcgcgccgaagaactgggcacgcggatcatcgcgcacggctgcaccggcatgggcaacgatcaggtgcgtttcgacctggcggtaaaggcgctgggcgactaccagattgtggcgccgattcgcgagatccagaaagaacacacccagacccgcgcctacgagcaaaagtacctggaagagcgcggcttcggcgtgcgtgccaagcagaaggcctacaccatcaacgagaacctgttgggcgtgaccatgtccggcggcgagatcgatcgctgggaagcaccgggcgaaggcgcacgcggctggtgtgcaccgcgtagcgcgtggccgaccgaagcgttgacggtgacgctgaagtttgtcgaaggcgaggccgtggcgctggacggcaaggccctgccaggtgcgcagatcctggccaagctcaacaccttgttcgcgcagtacggcgtgggccgtggcgtgtacaccggcgacaccgtgatcggcctgaagggccgcatcgtgttcgaagcgccgggcctgatctcgctgctcaccgcgcaccgtgcgctggaagacgcggtgctgaccaagcagcagaaccgcttcaagccggacgtggcgcgcaagtgggtggagctggtgtacgagggcttctaccacgacccgctcaagaccgatatcgaggcgttcctgaagtcgtcgcagtccaaggtcaatggcgaagtcacgctggaaactcgcggtggccgcgtcgatgcggtggcggtgcgttcgccgcacctgctcaacgccaagggcgcgacctacgcccagtcggccgactggggcgtggaagaggccgaggggttcatcaagctgttcggcatgagctccacgctgtatgcgcaggtcaaccgctga

SEQ ID NO: 5724 - protein, 397 aa, Xanthomonas campestris pv
MSSKDIVLAFSGGLDTSFCIPYLQERGYAVHTVFADTGGVDAEERDFIEKRAAELGAASHVTVDGGPAIWEGFVKPFVWAGEGYQGQYPLLVSDRYLIVDAALKRAEELGTRIIAHGCTGMGNDQVRFDLAVKALGDYQIVAPIREIQKEHTQTRAYEQKYLEERGFGVRAKQKAYTINENLLGVTMSGGEIDRWEAPGEGARGWCAPRSAWPTEALTVTLKFVEGEAVALDGKALPGAQILAKLNTLFAQYGVGRGVYTGDTVIGLKGRIVFEAPGLISLLTAHRALEDAVLTKQQNRFKPDVARKWVELVYEGFYHDPLKTDIEAFLKSSQSKVNGEVTLETRGGRVDAVAVRSPHLLNAKGATYAQSADWGVEEAEGFIKLFGMSSTLYAQVNR

SEQ ID NO: 5725 - DNA, 1206 bp, Xylella fastidiosa
  CDS (1)..(1206): transl_table=11
atgagtaagaaaaacattgtcttggccttctccggtggactcgacaccagcttttgcatcccctacctgaaagaacagggctatgccgtacacaccgtatttgccgacaccggcggtgttaacgaagaggagcgcgacttcattgaaaaacgtgctgccgaattaggcgtggccagccacctcaccgtggatggcggccctgccatctgggatggtttcgtaaaacagcttgtctggactggcgaaacctaccaaggccagtaccccttacttgtttctgatcgctatttaattgtggatgccgtactacagcgtgccgatgcactgggcacctgcgccgttgcccatgggtgtactggcatggggaacgaccaagtccgcttcgacctggcgatcaaagcacagggcaactacaccatcattgccccgattcgggaaatccagaaagagcacacccagacccgtctctacgaacaaaaatacctagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccgccgatcccctcacggtggctatcaaattcgttgaaggcgaagccgtcgccgtagatggaaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgcgccctggaagacgccgtgttgaccaaacaacagaaccgcttcaaaccgcacatagcccgtaaatgggttgaactggtgtacgaaggatttttccatgaccccttgaagaccgacctagagaccttcttaaaatcctcccaagctaacgtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgcccaggtaaatcgttccctgcgctcatga

SEQ ID NO: 5726 - protein, 401 aa, Xylella fastidiosa
MSKKNIVLAFSGGLDTSFCIPYLKEQGYAVHTVFADTGGVNEEERDFIEKRAAELGVASHLTVDGGPAIWDGFVKQLVWTGETYQGQYPLLVSDRYLIVDAVLQRADALGTCAVAHGCTGMGNDQVRFDLAIKAQGNYTIIAPIREIQKEHTQTRLYEQKYLEERGFGVRAKQKNYTINENLLGITLSGGEIDKWEAPGEGARGWCAPRSAWPADPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAQVNRSLRS

SEQ ID NO: 5727 - DNA, 1206 bp, Xylella fastidiosa
  CDS (1)..(1206): transl_table=11
atgagtaataaaaacattgtcttggccttctccggtggactcgacaccagcttttgcatcccctacctgaaagaacagggctatgccgtacacaccgtatttgccgacaccggcggtgttgacgaagatgagcgcgacttcattgaaaaacgtgctgccgaattaggcgtagctagccacctcaccgtggatggcggccctgccatctgggatggtttcgtaaaacagcttgtctgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctgtacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaatttgttgaaggcgaagccgtcgccgtagatggaaaacccctttccggccctcagattctgatgaaactcaacaaactcttcgcctcctatggcgtggggcgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccccacatagcccgtaaatgggttgaactggtgtacgaaggatttttccatgaccccttgaagaccgacctagagaccttcttaaaatcctcccaagccaacgtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatacgctcatgtaaatcgttccctgcgctcatga

SEQ ID NO: 5728 - protein, 401 aa, Xylella fastidiosa
MSNKNIVLAFSGGLDTSFCIPYLKEQGYAVHTVFADTGGVDEDERDFIEKRAAELGVASHLTVDGGPAIWDGFVKQLVWAGEAYQGQYPLLVSDRYLIVDAVLQRADALGTCAVAHGCTGMGNDQVRFDLAIKAQGDYTIIAPIREIQKEHTQTRLYEQKYLEERGFGVRAKQKNYTINENLLGITLSGGEIDKWEAPGEGARGWCAPRSAWPTDPLTVAIKFVEGEAVAVDGKPLSGPQILMKLNKLFASYGVGRGIYTGDTVIGLKGRIVYEAPGLTALLTAHRALEDAVLTKQQNRFKPHIARKWVELVYEGFFHDPLKTDLETFLKSSQANVNGEIVLETRGGRVDAVAVRSPHILTSKGVTYAQTADWGIEEAEGFIKLFGMSSTLYAHVNRSLRS

SEQ ID NO: 5729 - DNA, 1368 bp, Yersinia pestis
  CDS (1)..(1368): transl_table=11
atgacaactattcttaaacaccttcctattaatcagcgtgttggtattgctttttccggtggcctggacaccagtgcggcactgctgtggatgcaaaaaaaaggcgccattccttacgcttataccgctaatctgggtcagcctgatgaagaagattacgaggccatcccgcgtaaagcgatggaatacggcgcggaaaaagcccgtctgatcgattgccgtaagcagttggtggcagaaggtatcgccgctattcaatgtggcgcattccataacaccacggcgggtgtcacttatttcaacaccaccccactgggccgtgcggtaaccggcaccatgctggtggcagccatgaaagaagatgatgtaaatatctggggtgacggtagcacttataaaggtaacgatatcgagcgcttctatcgttacggtctgctgaccaacgctgagctgaaaatttacaaaccgtggctggatactgatttcatcgatgaattgggcggccgccatgagatgtcagaatttatgatccaatccggtttcgactacaaaatgtcaaccgagaaagcctactcgaccgactccaatatgttgggtgccacccacgaggccaaggatctggagttcctcaattccagcgttaaaatcgttaacccgattatgggcgtgaaattctgggacgaaaatgtggtggtgaaggccgaagaagtcactgtccgttttgaacgtggttacccggtcgcgctaaatggtgttgtctttgacgatagcgttgagctgatgatggaggctaaccgcatcggtggccgtcacggtctgggtatgagtgatcagattgaaaaccgtatcatcgaagccaaaagccgtggcatctatgaagcccctgggatggcgctgttgcatatcgcctatgagcgcttgctaacaggtattcacaatgaagataccattgagcaatatcatgctaatgggcgggtactgggtcgtctgctatatcaaggccgttggtttgatccacaagcgctgatgctgcgtgactccattcagcgttgggttgccagcgagataaccggtgaagtgacgctggagctgcgtcgtggcaatgattactccatcctgaataccgtgtctgacaatctgacttacaaaccagaacgtttgaccatggagaaaggtgattccgtgttctcaccagatgatcgtatcggccaactgacgatgcgtaatctggacatcaccgatacccgcgagaagttattcaactatgttgagacggggctgttaacctcttctgcggcgacggggttaccacaagtggataacaataatctgtcgtcagggcgtgggttgcaggataagcgtcagtaa

SEQ ID NO: 5730 - protein, 455 aa, Yersinia pestis
MTTILKHLPINQRVGIAFSGGLDTSAALLWMQKKGAIPYAYTANLGQPDEEDYEAIPRKAMEYGAEKARLIDCRKQLVAEGIAAIQCGAFHNTTAGVTYFNTTPLGRAVTGTMLVAAMKEDDVNIWGDGSTYKGNDIERFYRYGLLTNAELKIYKPWLDTDFIDELGGRHEMSEFMIQSGFDYKMSTEKAYSTDSNMLGATHEAKDLEFLNSSVKIVNPIMGVKFWDENVVVKAEEVTVRFERGYPVALNGVVFDDSVELMMEANRIGGRHGLGMSDQIENRIIEAKSRGIYEAPGMALLHIAYERLLTGIHNEDTIEQYHANGRVLGRLLYQGRWFDPQALMLRDSIQRWVASEITGEVTLELRRGNDYSILNTVSDNLTYKPERLTMEKGDSVFSPDDRIGQLTMRNLDITDTREKLFNYVETGLLTSSAATGLPQVDNNNLSSGRGLQDKRQ

SEQ ID NO: 5731 - DNA, 1227 bp, Zymomonas mobilis
  CDS (1)..(1227): transl_table=11
atgaccgaaaaagtaaaacgcgtcgtgctcgcctattcaggtggacttgataccagcgttattttgaaatggttacaagaacattatggctgtgaagtcgtcacttttacggctgacctcggtcaaggcgaagagcttgaacccgcccgtaaaaaagccgaaatgatgggcattaagcctgaacatatttttatggacgatctccgcgaagaatttgttcgcgattttgttttcccaatgatgcgtgccaatgccctttatgaaggtcagtatttgctcggcacctcgattgcgagaccgttaatcgccaaacgccagattgaaatcgcgcgtcaggtcggtgccgatgccgtggcgcatggggcaaccggaaaaggaaatgaccagattcgttttgaactcggttattatgccttggcaccggatattaaggttatcgctccttggcgcgaatgggatctgaacagccgtagcaaattgattgcttatgctgaatcccgtcagattgcggttccgaaagataaacgcggcgaatcgcctttctcggtcgattccaatttgctccacacctcttcagaaggtaaaattctcgaagatccgtggcaggaagtgccggattatgtctattcccgcacggttaaccccgaagatgctccaaatacgccggaaatcatcaccattgatttcgaacgcggtgatgccatcgccattaacggtgaagccttgtcaccggcagaattgctgaccaagctcaacgaactgggtcgcaagcatggtatcggtcgtcttgatctggtcgaaaaccgttatatcggcatgaaatcacgcggtatgtatgaaaccccgggcggcacgattctgattcaggctcatcgcggtatcgaacagctgaccttggatggtggcgctatgcatctgaaagatgaattgatgccgcgctatgccgagctgatctataacggtttctggtattctccagaacgtgaaatgttgcaggccgctattgaccatagtcaggccagagtcagcggcacggttcgtctgaagctctataagggcagtgtgaatgttatcggccgtaaatcgccgaattcgctctattccgaaaaggtcgtgacctttgaagatgatgccggtgcttataaccagcaggatgcagctggctttatcaagctcaatgctttgcgtttgcgtttactcggtgaacgtaacgctaaaggcctttaa

SEQ ID NO: 5732 - protein, 408 aa, Zymomonas mobilis
MTEKVKRVVLAYSGGLDTSVILKWLQEHYGCEVVTFTADLGQGEELEPARKKAEMMGIKPEHIFMDDLREEFVRDFVFPMMRANALYEGQYLLGTSIARPLIAKRQIEIARQVGADAVAHGATGKGNDQIRFELGYYALAPDIKVIAPWREWDLNSRSKLIAYAESRQIAVPKDKRGESPFSVDSNLLHTSSEGKILEDPWQEVPDYVYSRTVNPEDAPNTPEIITIDFERGDAIAINGEALSPAELLTKLNELGRKHGIGRLDLVENRYIGMKSRGMYETPGGTILIQAHRGIEQLTLDGGAMHLKDELMPRYAELIYNGFWYSPEREMLQAAIDHSQARVSGTVRLKLYKGSVNVIGRKSPNSLYSEKVVTFEDDAGAYNQQDAAGFIKLNALRLRLLGERNAKGL

SEQ ID NO: 5733 - DNA, 1446 bp, Oryza sativa
  CDS (1)..(1446)
atggcgcacgccctcggctgcggcgccgccaccgcccccgccggggtgggtctcctccaccaccacgagaaggctggggcgttgttcagtgccgcaggctccatcgttcgggttcagcagctcagcgggaaggggagcaaaagccaagctataagatgtgcaatgccaagtgcaagtgagcatggtggaatttcaaccgcaacagctagtagtagtgatcaaaagaaaggtggactgcgtggcaaactgaataaagttgttctagcttacagtggtggtttggatacatcagttattgttccatggctccgggagaactatggttgtgaagttgtctgtttcactgctgatgttggccagggtgacattgaattggaagggctagagaagaaggcaaaagctagtggtgcaagccagcttgttgtgaaggacttgaaagaagagttcgttagtgaatacatttacccctgcttgcgtgctggtgcagtttatgaaagaaagtatctgctggggacttcaatggctaggcctgttattgccaaggcaatggttgatgttgcaaaggaagttggtgcagatgcagttgctcatggatgcactggaaaaggcaatgatcaggttcgttttgagcttacattctatgctttaaaccctgagcttaaagtggtggcaccttggagggagtgggatatcacaggacgtgaagatgctattgagtatgcaaagaaacacaatgtgccaattcctgttacaaagaaatcaatatacagccgtgatcgaaatttgtggcaccttagccatgagggtgacattttggaagatccagcaaatgagccaaaggaagatatgtatatgatgtcagttgcaccagaaaatgcaccttcaaaacctgagtatttggagattggtattattgcaggtgttcctgtttccatcaatggaaaagatctctcaccagcatctctccttgccaagctcaatgaaatcggtggaaagcatggtattgggcgcattgatatggtggaaaaccgcctcgtaggcatgaagtcccgtggtgtatacgagacccccggtggcaccatcatggcagctgctgtccgtgagctcgagtccttgactttggacagggagacaatgcagtggaaggacatgcttgccctcaagtacgccgagctggtctacgctggccgttggttcgacccgctccgacaatccattgatgcgttcatggagaacattaccgcgacaacaaccggctccgtgactctcaagctgtacaagggctccgtaaacgtcgcgtcccggaagagcccatacagcctgtacagggaagacatctcctcatttgagaatggggagatctacaaccaggctgatgctgaagggttcatcaggctatatggtctccctaccagagtccgggcaatgctggagaagggcatctaa

SEQ ID NO: 5734 - protein, 481 aa, Oryza sativa
MAHALGCGAATAPAGVGLLHHHEKAGALFSAAGSIVRVQQLSGKGSKSQAIRCAMPSASEHGGISTATASSSDQKKGGLRGKLNKVVLAYSGGLDTSVIVPWLRENYGCEVVCFTADVGQGDIELEGLEKKAKASGASQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVTKKSIYSRDRNLWHLSHEGDILEDPANEPKEDMYMMSVAPENAPSKPEYLEIGIIAGVPVSINGKDLSPASLLAKLNEIGGKHGIGRIDMVENRLVGMKSRGVYETPGGTIMAAAVRELESLTLDRETMQWKDMLALKYAELVYAGRWFDPLRQSIDAFMENITATTTGSVTLKLYKGSVNVASRKSPYSLYREDISSFENGEIYNQADAEGFIRLYGLPTRVRAMLEKGI

SEQ ID NO: 5735 - DNA, 1434 bp, Glycine max
  CDS (1)..(1434)
atggctcaattgaaagcttctcctttgtgttcaacccctgccactgctccttcccttcatacaacagggcaccttctgtaccatcagttctggaaggcaaagccttcgtcattcaaagagttggggctaagaacaagcattggtgccactaaacttaaagttattaaagcagctgcacgcagtgatacagaggtagtttctgaatccacaaaaggtggtggcctacgtggaaaattgaataaggtggtgttggcttacagtggtggcttagacacatcagtcattgttccatggctcagagaaaattatggttgtgaagttgtttgcttcactgctgatgttgaccaaagtataaaggaattggaaggtttagaacagaaagccaaagccagtggggcctgtcaattagtggtaaaagatttgaaggaggaatttgttaaagattatatatttccttgcctgcgtgctggtgcaatttatgagaggaagtatttgcttgggacctcaatggcccgccctgtaattgcgaaggccatggttgatgttgccaaagaagttggagctgatgctgtttcccatgggtgtacagggaaaggaaatgatcaggttcgatttgagctcactttctttgctctaaaccccaagctcaatgttgtggctccatggagggagtgggatattacagggagagaagatgctattgagtatgctaaaaagcataatatacctgttcctgtgacaaagaaatccatatatagcagggataggaatctttggcaccttagccatgagggagatattttagaagaccctgctaatgaacctaaaaaggacatgtacatgatgtctgtagacccagaggatgctcctgatcaagcagaatatgtggaaattggattagagtcggggcttcctgtttcagtcaatgggaagaggctttcaccagcatctttacttgctgagctcaatgagattggtggaaagcatggaattggcaggattgacatggttgagaatcggcttgtaggtatgaagagccgaggagtgtacgaaactcctggtggaaccatactgtttgctgcagcacgagagttggagtctttgacacttgatcgtgaaacaatacaagtcaaagattcattagcccttaaatatgcagagttagtgtatgctggcagatggtttgatcctcttcgggagtccatggattcctttatgcagaagatcacagagaccacaacaggttctgtgactttgaaattgtacaaaggttctgttattgtaactagtcgaatgagtccctttagcctgtatagggaagacatttcatcatttgagagtgggcagatatatgatcaagctgatgctgctgggttcattcggctttatggtcttccaatgaaggttcgagcaatgcttgagcagggcatctaa

SEQ ID NO: 5736 - protein, 477 aa, Glycine max
MAQLKASPLCSTPATAPSLHTTGHLLYHQFWKAKPSSFKELGLRTSIGATKLKVIKAAARSDTEVVSESTKGGGLRGKLNKVVLAYSGGLDTSVIVPWLRENYGCEVVCFTADVDQSIKELEGLEQKAKASGACQLVVKDLKEEFVKDYIFPCLRAGAIYERKYLLGTSMARPVIAKAMVDVAKEVGADAVSHGCTGKGNDQVRFELTFFALNPKLNVVAPWREWDITGREDAIEYAKKHNIPVPVTKKSIYSRDRNLWHLSHEGDILEDPANEPKKDMYMMSVDPEDAPDQAEYVEIGLESGLPVSVNGKRLSPASLLAELNEIGGKHGIGRIDMVENRLVGMKSRGVYETPGGTILFAAARELESLTLDRETIQVKDSLALKYAELVYAGRWFDPLRESMDSFMQKITETTTGSVTLKLYKGSVIVTSRMSPFSLYREDISSFESGQIYDQADAAGFIRLYGLPMKVRAMLEQGI

SEQ ID NO: 5737 - DNA, 1434 bp, Glycine max
  CDS (1)..(1434)
atggctcaattgaaagcttctcctttgtgttcaacccctgccactgctccttcccttcatacaacagggcaccttctgtaccatcagttctggaaggcaaagccttcgtcattcaaagagttggggctaagaacaagcattggtgccactaaacttaaagttattaaagcagctgcacgcagtgatacagaggtagtttctgaatccacaaaaggtggtggcctacgtggaaaattgaataaggtggtgttggcttacagtggtggcttagacacatcagtcattgttccatggctcagagaaaattatggttgtgaagttgtttgcttcactgctgatgttgaccaaagtataaaggaattggaaggtttagaacagaaagccaaagccagtggggcctgtcaattagtggtaaaagatttgaaggaggaatttgttaaagattatatatttccttgcctgcgtgctggtgcaatttatgagaggaagtatttgcttgggacctcaatggcccgccctgtaattgcgaaggccatggttgatgttgccaaagaagttggagctgatgccgtttcccatgggtgtacagggaaaggaaatgatcaggttcgatttgagctcactttctttgctctaaaccccaagctcaatgttgtggctccatggagggagtgggatattacagggagagaagatgctattgagtatgctaaaaagcataatatacctgttcctgtgacaaagaaatccatatatagcagggataggaatctttggcaccttagccatgagggagatattttagaagaccctgctaatgaacctaaaaaggacatgtacatgatgtctgtagacccagaggatgctcctgatcaagcagaatatgtggaaattggattagagtcggggcttcctgtttcagtcaatgggaagaggctttcaccagcatctttacttgctgagctcaatgagattggtggaaagcatggaattggcaggattgacatggttgagaatcggcttgtaggtatgaagagccgaggagtgtacgaaactcctggtggaaccatactgtttgctgcagcacgagagttggagtctttgacacttgatcgtgaaacaatacaagtcaaagattcattagcccttaaatatgcagagttagtgtatgctggcagatggtttgatcctcttcgggagtccatggatgcctttatgcagaagatcacggagaccacaacaggttctgtgactttgaaattgtacaaaggttctgttactgtaaccagtcgaacgagtccctttagcctgtatagggaagacatttcatcatttgaaagtgggcagatatatgatcaagctgatgctgctgggttcattcggctttatggtcttccaatgagggttcgagcaatgcttgagcagggcatctaa

SEQ ID NO: 5738 - protein, 477 aa, Glycine max
MAQLKASPLCSTPATAPSLHTTGHLLYHQFWKAKPSSFKELGLRTSIGATKLKVIKAAARSDTEVVSESTKGGGLRGKLNKVVLAYSGGLDTSVIVPWLRENYGCEVVCFTADVDQSIKELEGLEQKAKASGACQLVVKDLKEEFVKDYIFPCLRAGAIYERKYLLGTSMARPVIAKAMVDVAKEVGADAVSHGCTGKGNDQVRFELTFFALNPKLNVVAPWREWDITGREDAIEYAKKHNIPVPVTKKSIYSRDRNLWHLSHEGDILEDPANEPKKDMYMMSVDPEDAPDQAEYVEIGLESGLPVSVNGKRLSPASLLAELNEIGGKHGIGRIDMVENRLVGMKSRGVYETPGGTILFAAARELESLTLDRETIQVKDSLALKYAELVYAGRWFDPLRESMDAFMQKITETTTGSVTLKLYKGSVTVTSRTSPFSLYREDISSFESGQIYDQADAAGFIRLYGLPMRVRAMLEQGI

SEQ ID NO: 5739 - DNA, 1446 bp, Zea mays
  CDS (1)..(1446)
atggcgtcggcgcgaggaccttgcggaattagtgtccgttctgacttcagttcagcctgccttattcacaaggctggagccccatcgaattctgtttctggcgtgatggctgttcaggttcaccgccaccgtaacaaggtccgcaatggccaagctatcaggtgtgcaatggcaactggaaaagagcagggtgcaatttccactgccagtagcggtgatcaaaccaagggcggtttgcgtggaaaattaaacaaagttgttttagcttatagtggtggtttggatacatccgttattgttccatggctcagggagaactatggttgtgaagtcgtttgtttcactgctgatgttggccagggtgccattgaattggaagggttggagaagaaggcaaaagccagtggtgcatgtcagcttgttgtgaaggacctcaaagaagaatttgttagtgaatatatatacccctgcctgcgtgcaggtgcagtttatgaaagaaagtatctgcttgggacttcgatggctaggcctgttattgctaaggcaatggttgatgttgccaaggaagttggtgcggatgcagttgcccatggttgcactggaaaaggcaatgatcaggttcgctttgagcttacattctatgctttaaatcctgaacttaaagtggtggcaccttggagggagtgggatatcacaggacgtgaagatgctattgaatatgcaaagaaacataatgtacctgttccagtttcaaagaaatcaatatacagccgagaccgaaacttgtggcaccttagccatgagggtgacatcctggaggacccagcaaatgagccaaaggaagatatgtatatgatgtcgattgctccagaaaatgcgccctcgaaacctgagtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcatcaggctgtacggcctaccgacacgggtccgggcgatgctggagaagggtatctga

SEQ ID NO: 5740 - protein, 481 aa, Zea mays
MASARGPCGISVRSDFSSACLIHKAGAPSNSVSGVMAVQVHRHRNKVRNGQAIRCAMATGKEQGAISTASSGDQTKGGLRGKLNKVVLAYSGGLDTSVIVPWLRENYGCEVVCFTADVGQGAIELEGLEKKAKASGACQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSIAPENAPSKPEYLEIGIIAGVPVSINGRDLSPASLLAELNEIGGKHGIGRIDMVENRLVGMKSRGVYETPGGTIMAAAVRELESLTLDRETMQWKDIIALKYAELVYAGRWFDPLRQSFDAFMEKVTATTTGSVTLKLYKGSVNVASRKSPYSLYREDISSFENGEIYNQADAEGFIRLYGLPTRVRAMLEKGI

SEQ ID NO: 5741 - DNA, 25 bp, Artificial sequence
  primer
atgtctaagggaaaagtttgtttgg

SEQ ID NO: 5742 - DNA, 25 bp, Artificial sequence
  primer
ttacaaagtcaactcttcacctttg

SEQ ID NO: 5743 - protein, 425 aa, Artificial sequence
  consensus sequence
  Variant (11)..(13): Xaa in position 11 to 13 is any amino acid
  Variant (14)..(24): Xaa in position 14 to 24 is any or no amino acid
  Variant (26)..(32): Xaa in position 26 to 32 is any amino acid
  Variant (33)..(33): Xaa in position 33 is any or no amino acid
  Variant (36)..(45): Xaa in position 36 to 45 is any amino acid
  Variant (46)..(47): Xaa in position 46 to 47 is any or no amino acid
  Variant (49)..(51): Xaa in position 49 to 51 is any amino acid
  Variant (53)..(58): Xaa in position 53 to 58 is any amino acid
  Variant (59)..(61): Xaa in position 59 to 61 is any or no amino acid
  Variant (63)..(80): Xaa in position 63 to 80 is any amino acid
  Variant (81)..(81): Xaa in position 81 is any or no amino acid
  Variant (83)..(84): Xaa in position 83 to 84 is any amino acid
  Variant (85)..(88): Xaa in position 85 to 88 is any or no amino acid
  Variant (90)..(90): Xaa in position 90 is any amino acid
  Variant (92)..(95): Xaa in position 92 to 95 is any amino acid
  Variant (96)..(96): Xaa in position 96 is any or no amino acid
  Variant (99)..(99): Xaa in position 99 is any amino acid
  Variant (101)..(107): Xaa in position 101 to 107 is any amino acid
  Variant (109)..(116): Xaa in position 109 to 116 is any amino acid
  Variant (117)..(117): Xaa in position 117 is any or no amino acid
  Variant (120)..(120): Xaa in position 120 is any amino acid
  Variant (128)..(128): Xaa in position 128 is any amino acid
  Variant (131)..(135): Xaa in position 131 to 135 is any amino acid
  Variant (136)..(138): Xaa in position 136 to 138 is any or no amino acid
  Variant (140)..(143): Xaa in position 140 to 143 is any amino acid
  Variant (144)..(146): Xaa in position 144 to 146 is any or no amino acid
  Variant (148)..(148): Xaa in position 148 is any amino acid
  Variant (150)..(151): Xaa in position 150 to 151 is any amino acid
  Variant (152)..(159): Xaa in position 152 to 159 is any or no amino acid
  Variant (161)..(178): Xaa in position 161 to 178 is any amino acid
  Variant (179)..(185): Xaa in position 179 to 185 is any or no amino acid
  Variant (187)..(187): Xaa in position 187 is any amino acid
  Variant (189)..(189): Xaa in position 189 is any amino acid
  Variant (191)..(196): Xaa in position 191 to 196 is any amino acid
  Variant (198)..(200): Xaa in position 198 to 200 is any amino acid
  Variant (203)..(228): Xaa in position 203 to 228 is any amino acid
  Variant (229)..(234): Xaa in position 229 to 234 is any or no amino acid
  Variant (236)..(237): Xaa in position 236 to 237 is any amino acid
  Variant (239)..(244): Xaa in position 239 to 244 is any amino acid
  Variant (246)..(256): Xaa in position 246 to 256 is any amino acid
  Variant (257)..(266): Xaa in position 257 to 266 is any or no amino acid
  Variant (268)..(273): Xaa in position 268 to 273 is any amino acid
  Variant (275)..(275): Xaa in position 275 is any amino acid
  Variant (277)..(278): Xaa in position 277 to 278 is any amino acid
  Variant (280)..(281): Xaa in position 280 to 281 is any amino acid
  Variant (283)..(283): Xaa in position 283 is any amino acid
  Variant (285)..(286): Xaa in position 285 to 286 is any amino acid
  Variant (288)..(288): Xaa in position 288 is any amino acid
  Variant (292)..(293): Xaa in position 292 to 293 is any amino acid
  Variant (296)..(296): Xaa in position 296 is any amino acid
  Variant (298)..(304): Xaa in position 298 to 304 is any amino acid
  Variant (306)..(309): Xaa in position 306 to 309 is any amino acid
  Variant (310)..(310): Xaa in position 310 is any or no amino acid
  Variant (312)..(333): Xaa in position 312 to 333 is any amino acid
  Variant (334)..(335): Xaa in position 334 to 335 is any or no amino acid
  Variant (337)..(337): Xaa in position 337 is any amino acid
  Variant (339)..(339): Xaa in position 339 is any amino acid
  Variant (341)..(342): Xaa in position 341 to 342 is any amino acid
  Variant (344)..(347): Xaa in position 344 to 347 is any amino acid
  Variant (349)..(358): Xaa in position 349 to 358 is any amino acid
  Variant (359)..(359): Xaa in position 359 is any or no amino acid
  Variant (361)..(361): Xaa in position 361 is any amino acid
  Variant (363)..(363): Xaa in position 363 is any amino acid
  Variant (365)..(367): Xaa in position 365 to 367 is any amino acid
  Variant (369)..(370): Xaa in position 369 to 370 is any amino acid
  Variant (372)..(379): Xaa in position 372 to 379 is any amino acid
  Variant (381)..(382): Xaa in position 381 to 382 is any amino acid
  Variant (383)..(384): Xaa in position 383 to 384 is any or no amino acid
  Variant (387)..(402): Xaa in position 387 to 402 is any amino acid
  Variant (403)..(408): Xaa in position 403 to 408 is any or no amino acid
  Variant (411)..(415): Xaa in position 411 to 415 is any amino acid
  Variant (416)..(424): Xaa in position 416 to 424 is any or no amino acid
LAYSGGLDTSXXXXXXXXXXXXXXVXXXXXXXXGQXXXXXXXXXXXXAXXXGXXXXXXXXXDXXXXXXXXXXXXXXXXXXXYXXXXXXYXLXXXXXRPXIXXXXXXXAXXXXXXXXXHGXTGKGNDQXRFXXXXXXXXPXXXXXXXPXRXXXXXXXXXXRXXXXXXXXXXXXXXXXXXXXXXXXXSXDXNXXXXXXEXXXLEXXXXXXXXXXXXXXXXXXXXXXXXXXXXXXXXFXXGXXXXXXGXXXXXXXXXXXXXXXXXXXXXNXXXXXXGXGXXDXXEXRXXGXKSRXXYEXPXXXXXXXAXXXXXEXXXXXXXXXXXXXXXXXXXXXXXXYXGXWXXPXXXXLXXXXXXXXXXXVXGXVXXXLXXGXXXXXXXXSXXXXLYXXXXXXXXXXXXXXXXXXXXXXGFXXXXXXXXXXXXXXL

SEQ ID NO: 5744 - protein, 14 aa, Artificial sequence
  protein pattern
  Variant (3)..(3): Xaa in position 3 is Ala, Cys or Ser
  Variant (6)..(6): Xaa in position 6 is any amino acid
  Variant (11)..(11): Xaa in position 11 is Phe, Ile, Leu or Val
  Variant (14)..(14): Xaa in position 14 is Asp or Glu
HGXTGXGNDQXRFX

SEQ ID NO: 5745 - protein, 12 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Phe or Tyr
VXXAXSGGLDTS

SEQ ID NO: 5746 - DNA, 2400 bp, Saccharomyces cerevisiae
  CDS (1)..(2400)
atggttcatcgaggaaggactttgaagtcagacactgatgtaacatctcttaatgcgtcaacagtatcacaccagtcaaagccatttagacagttttcgactaggtcgagagcaaagagtaacgcaagcttcaaaggtttgcgtagagttttaacacatgatggcaccctggataatgattattttaataagcacaacgtttctcagaaatgcaagagttctgatgcacttttcagaaagcgaacgattagtgggttgaatatgacagctttaacaagagtaaagtccaatcaaggaaaaagatcagcatcctttcatagtccggtgcataatacgctgctcagtccaaagaacagcagtcattctaatactggaactgctggtttcggcctgaaaccacgaagaagtaaaagtacccaatctgttctgagtcttcgagatgcgcaagaatctaaaaagagtgaatctactactgacgaggaggtggaatgtttttcggaagacaacattgaagatggaaaggtgaataatgataaagtaatagccgagcatgttatgcctgaagaaaaaaagaatgtgcagcaattaaatcagaatgaattacaatccccggattcaatagatgaacaagaagaagataaatcaggtactgatggaaaggaaaatcatagagctgtatccttaccattacctcatttatcttccaataactatttcggagaatcaagccattctatagaacatcagaaagatggagaaacatctccaagctcaattgaaacaaaactgaatgcaacaagtgtaatcaatgaagaggggcaatcaaaggtgacgaaggaagctgatattgatgacttgtccagccattctcaaaatttgagggcctcattggttaaagcgggcgataatatatcagaagcaccatatgataaagaaaaaaaaattcttgatgttggtaataccttagctgcacataaaagtaatcaaaaaccaagtcattcagatgaacagtttgatcaggaagatcacattgatgcccctaggagtaattcatcaagaaaaagcgactcgagctttatgtctcttaggagacaaagttctaaacaacacaaattattaaacgaagaagaagatctaatcaagcctgatgatatttcttccgctggtaccaaggatattgaagggcatagcttactggaaaattatgcgcctaatatgattctctcccagtcgactggagttgaacgtagatttgaaaattcatcatccatccaaaattcgcttgggaatgaaattcatgactcgggtgagcatatggcttcaggtgatacttttaatgaactggatgatggcaaattgcgcaagagcaagaaaaatggtggaagatctcaacttggccaaaatataccgaactctcagtctactttccccaccattgctaacatcggtagtaaagataataatgtaccacagcacaacttttcgacctccatatcgagtttaaccaataatttgaggagagctgctcctgaaagcttccatggttcaagaatgaataatatttttcacaagaaaggtaatcagaatctacttctgagatccaacgatctcaacaaaaattctgcagccccggcctctccattgtccaacgaacatattacatctagtacgaactccggtagcgatgcaaacagacaatccaactcaggtgccaaatttaatagcttcgcccagttccttaaatcagatgggattgatgcagaatcaagaacacaaagaaaattatggttgcagagggagaattctattatggacttaagttcacaaaatgacggtagtgactctatctttatggcaggaaacattgatgcgaaaagggagtttgagagaatatcccatgaatactctaatgtaaaaagattttacaacccattagatgaagcattgttgagagtacaacctataataacgggaaatgcaaataatatcaggaaaaaaagccataacgatgctcagtcaatcgcacattctagcagtgatacagatcataaggatgaggacgatttgctctttactaactatgacaaaaaatttgatgatctttatccacatcttgcaagtgcaaagattcaggcagtgttgtccggtatatggaaaagcgaaagttacttatttaacaaggatgttaatccaatcaacaagaataggacaacgagtacaaaccacagcgttggccacactgcttcacagaatgcacgtaacttgctgaggggcccgatgggttccagcacgactttgcaccaccaacgcgtcattaactctctgcagccgactacgagggcagtgaatcgcaggatggaaaatgtgggctacatgcatacacagccacaacaaaggtga

SEQ ID NO: 5747 - protein, 799 aa, Saccharomyces cerevisiae [sequence omitted]

SEQ ID NO: 5748 - DNA, 2118 bp, Candida glabrata CBS 138
  CDS (1)..(2118)
atgggaagcaaaaataagccatgcaaaggtgaatatgatatgcctaatttaacatcccctacacaagttcatgggaagtctcatatgagacaatttagtactaaatcaaaggctaaaggatccgccagttttaagggcctacgaagagtcttaacacatgatggtacatttgaaggtgatggtctactcaataggcatggttcattcaagaagagtaaaagctctgacgctttatatcgaagacgtgcgataagtggacttaatatgactgcacttgttggtgagaagccaacaaaccgggtatcccgaagccaaggaaattcgagactaagcagtccaatacaaagcctctcaaaaagtcacagtagcagtaatgttgcccattctttggcaagtgccattggtggtagcggactcagaccacgtagaacaagaagcacacactcagttttaacattacgacaaggacaggagttctatgataatgaatcaactacggatgaagaagtggagcattttactgacgaggaagcacaaaactcggacagcagtgataatattcatcatacaaggccgaaaagctccaggatgttcagtgatgatagagttagagatcagcaactttccgtaattcagtcaagtcctgaagatataattactcttaatgggaatcctaatcagggtaaaggggattcatattcaactttacgtgcacataactcaattgaccattcaaaaaacacaaataaagattttgatggaaatagctcagatgataagattgaagctatgcttgatgatgtacatttatcgaaagcttcgaataaaagtattgatcacttaaatgtaaaggacgatcacgaagatcatataggagaggtggatccaaattcattatcatttgattcacactcattagtacgacaggaacgtaaacctagaactttagctaaagtaactgaaggcgaagaatcaatagccgacgacatgaataaaaatagatccccgattgaagagtttacgaaaaaagatagagaatatcaatcgaaaagtgatgaaccttatattccagatatgattttatcacaatctacaggtgttgagcgtaaattcgagaatccttcttctatccaaaattcgctggcgaaagagatacagaatactaaatatcttgaagactctgataataccactgatgcaccctctaaacccataaaaaatatctcaggctttgataaggatgaaatagaaaatgcgaggctgaatgatactaaacatagtatgctaaatcaacaagtcaatgctaaatctgaactgacaaacaatcttcagaaagtcaatccagataataatcctcccaggagctctttgacaaatacaatttttcaaaagagtagaaatcaatatgcatcaaggacagatactacagaaaaaggacctacatcattattaaaaacagacagagacagcaactccacaaccaaaattaataacttttcacaatttttaaagtccgaaaacatagatggtaattcccgtactcaacggaaaatgctccttcaaagagagagttccatattagatcttaattctcaaacagatagtgctgaggctatttttatgactggtcatatcgaacagaagcgggaatacgaaaaaattactcacgaatataccactttgaggagatataccaatccattagataaatcgcttctaagactaaaaaatagcaaaaattctggaaagacaaattcaacttacggaaatagtggtctggaaggctcttctattagtacatatagtaaccaggtgaaagaattagacgatttcctgcccaaggctcagcaatcaaaactaaactcaattttggcatcaatatggagatctgaaagccaatcattcaataaggacgtcaatccactaaacagaaacaagtcgtctatggaggaacaaagcaaccattattcgtccttaaaaaactcattgaagagcaacataccaggttctggaacagggttgcaccaacagagagtaccaaaaatgcagcctacaacaagagccgtacacagaaggatggagaatagcaataccaacttggcagctcactttagataa

SEQ ID NO: 5749 - protein, 705 aa, Candida glabrata CBS 138
MGSKNKPCKGEYDMPNLTSPTQVHGKSHMRQFSTKSKAKGSASFKGLRRVLTHDGTFEGDGLLNRHGSFKKSKSSDALYRRRAISGLNMTALVGEKPTNRVSRSQGNSRLSSPIQSLSKSHSSSNVAHSLASAIGGSGLRPRRTRSTHSVLTLRQGQEFYDNESTTDEEVEHFTDEEAQNSDSSDNIHHTRPKSSRMFSDDRVRDQQLSVIQSSPEDIITLNGNPNQGKGDSYSTLRAHNSIDHSKNTNKDFDGNSSDDKIEAMLDDVHLSKASNKSIDHLNVKDDHEDHIGEVDPNSLSFDSHSLVRQERKPRTLAKVTEGEESIADDMNKNRSPIEEFTKKDREYQSKSDEPYIPDMILSQSTGVERKFENPSSIQNSLAKEIQNTKYLEDSDNTTDAPSKPIKNISGFDKDEIENARLNDTKHSMLNQQVNAKSELTNNLQKVNPDNNPPRSSLTNTIFQKSRNQYASRTDTTEKGPTSLLKTDRDSNSTTKINNFSQFLKSENIDGNSRTQRKMLLQRESSILDLNSQTDSAEAIFMTGHIEQKREYEKITHEYTTLRRYTNPLDKSLLRLKNSKNSGKTNSTYGNSGLEGSSISTYSNQVKELDDFLPKAQQSKLNSILASIWRSESQSFNKDVNPLNRNKSSMEEQSNHYSSLKNSLKSNIPGSGTGLHQQRVPKMQPTTRAVHRRMENSNTNLAAHFR

SEQ ID NO: 5750 - DNA, 24 bp, Artificial sequence
  primer
atggttcatcgaggaaggactttg

SEQ ID NO: 5751 - DNA, 24 bp, Artificial sequence
  primer
tcacctttgttgtggctgtgtatg

SEQ ID NO: 5752 - protein, 803 aa, Artificial sequence
  consensus sequence
  Variant (2)..(8): Xaa in position 2 to 8 is any amino acid
  Variant (10)..(12): Xaa in position 10 to 12 is any amino acid
  Variant (14)..(16): Xaa in position 14 to 16 is any amino acid
  Variant (18)..(20): Xaa in position 18 to 20 is any amino acid
  Variant (22)..(23): Xaa in position 22 to 23 is any amino acid
  Variant (25)..(29): Xaa in position 25 to 29 is any amino acid
  Variant (35)..(35): Xaa in position 35 is any amino acid
  Variant (37)..(37): Xaa in position 37 is any amino acid
  Variant (40)..(41): Xaa in position 40 to 41 is any amino acid
  Variant (57)..(59): Xaa in position 57 to 59 is any amino acid
  Variant (61)..(62): Xaa in position 61 to 62 is any amino acid
  Variant (63)..(63): Xaa in position 63 is any or no amino acid
  Variant (65)..(65): Xaa in position 65 is any amino acid
  Variant (67)..(70): Xaa in position 67 to 70 is any amino acid
  Variant (72)..(72): Xaa in position 72 is any amino acid
  Variant (79)..(79): Xaa in position 79 is any amino acid
  Variant (81)..(81): Xaa in position 81 is any amino acid
  Variant (83)..(83): Xaa in position 83 is any amino acid
  Variant (93)..(95): Xaa in position 93 to 95 is any amino acid
  Variant (97)..(107): Xaa in position 97 to 107 is any amino acid
  Variant (109)..(115): Xaa in position 109 to 115 is any amino acid
  Variant (117)..(119): Xaa in position 117 to 119 is any amino acid
  Variant (121)..(122): Xaa in position 121 to 122 is any amino acid
  Variant (124)..(128): Xaa in position 124 to 128 is any amino acid
  Variant (129)..(135): Xaa in position 129 to 135 is any or no amino acid
  Variant (137)..(137): Xaa in position 137 is any amino acid
  Variant (140)..(140): Xaa in position 140 is any amino acid
  Variant (144)..(145): Xaa in position 144 to 145 is any amino acid
  Variant (148)..(148): Xaa in position 148 is any amino acid
  Variant (152)..(152): Xaa in position 152 is any amino acid
  Variant (155)..(156): Xaa in position 155 to 156 is any amino acid
  Variant (159)..(162): Xaa in position 159 to 162 is any amino acid
  Variant (172)..(172): Xaa in position 172 is any amino acid
  Variant (174)..(188): Xaa in position 174 to 188 is any amino acid
  Variant (189)..(191): Xaa in position 189 to 191 is any or no amino acid
  Variant (193)..(194): Xaa in position 193 to 194 is any amino acid
  Variant (196)..(196): Xaa in position 196 is any amino acid
  Variant (197)..(242): Xaa in position 197 to 242 is any or no amino acid
  Variant (244)..(246): Xaa in position 244 to 246 is any amino acid
  Variant (248)..(262): Xaa in position 248 to 262 is any amino acid
  Variant (265)..(266): Xaa in position 265 to 266 is any amino acid
  Variant (268)..(268): Xaa in position 268 is any amino acid
  Variant (270)..(282): Xaa in position 270 to 282 is any amino acid
  Variant (284)..(290): Xaa in position 284 to 290 is any amino acid
  Variant (293)..(306): Xaa in position 293 to 306 is any amino acid
  Variant (307)..(309): Xaa in position 307 to 309 is any or no amino acid
  Variant (311)..(313): Xaa in position 311 to 313 is any amino acid
  Variant (316)..(317): Xaa in position 316 to 317 is any amino acid
  Variant (319)..(325): Xaa in position 319 to 325 is any amino acid
  Variant (326)..(334): Xaa in position 326 to 334 is any or no amino acid
  Variant (337)..(340): Xaa in position 337 to 340 is any amino acid
  Variant (342)..(346): Xaa in position 342 to 346 is any amino acid
  Variant (348)..(348): Xaa in position 348 is any amino acid
  Variant (353)..(357): Xaa in position 353 to 357 is any amino acid
  Variant (360)..(365): Xaa in position 360 to 365 is any amino acid
  Variant (367)..(371): Xaa in position 367 to 371 is any amino acid
  Variant (373)..(378): Xaa in position 373 to 378 is any amino acid
  Variant (380)..(383): Xaa in position 380 to 383 is any amino acid
  Variant (386)..(392): Xaa in position 386 to 392 is any amino acid
  Variant (393)..(397): Xaa in position 393 to 397 is any or no amino acid
  Variant (399)..(403): Xaa in position 399 to 403 is any amino acid
  Variant (406)..(406): Xaa in position 406 is any amino acid
  Variant (408)..(409): Xaa in position 408 to 409 is any amino acid
  Variant (411)..(414): Xaa in position 411 to 414 is any amino acid
  Variant (415)..(415): Xaa in position 415 is any or no amino acid
  Variant (417)..(417): Xaa in position 417 is any amino acid
  Variant (419)..(419): Xaa in position 419 is any amino acid
  Variant (431)..(431): Xaa in position 431 is any amino acid
  Variant (435)..(435): Xaa in position 435 is any amino acid
  Variant (443)..(444): Xaa in position 443 to 444 is any amino acid
  Variant (447)..(454): Xaa in position 447 to 454 is any amino acid
  Variant (456)..(457): Xaa in position 456 to 457 is any amino acid
  Variant (459)..(462): Xaa in position 459 to 462 is any amino acid
  Variant (463)..(476): Xaa in position 463 to 476 is any or no amino acid
  Variant (478)..(481): Xaa in position 478 to 481 is any amino acid
  Variant (484)..(493): Xaa in position 484 to 493 is any amino acid
  Variant (495)..(511): Xaa in position 495 to 511 is any amino acid
  Variant (512)..(512): Xaa in position 512 is any or no amino acid
  Variant (514)..(514): Xaa in position 514 is any amino acid
  Variant (520)..(523): Xaa in position 520 to 523 is any amino acid
  Variant (525)..(529): Xaa in position 525 to 529 is any amino acid
  Variant (530)..(530): Xaa in position 530 is any or no amino acid
  Variant (532)..(534): Xaa in position 532 to 534 is any amino acid
  Variant (536)..(539): Xaa in position 536 to 539 is any amino acid
  Variant (541)..(547): Xaa in position 541 to 547 is any amino acid
  Variant (549)..(553): Xaa in position 549 to 553 is any amino acid
  Variant (555)..(557): Xaa in position 555 to 557 is any amino acid
  Variant (558)..(573): Xaa in position 558 to 573 is any or no amino acid
  Variant (575)..(579): Xaa in position 575 to 579 is any amino acid
  Variant (581)..(581): Xaa in position 581 is any amino acid
  Variant (585)..(586): Xaa in position 585 to 586 is any amino acid
  Variant (588)..(588): Xaa in position 588 is any amino acid
  Variant (590)..(590): Xaa in position 590 is any amino acid
  Variant (592)..(592): Xaa in position 592 is any amino acid
  Variant (598)..(599): Xaa in position 598 to 599 is any amino acid
  Variant (602)..(603): Xaa in position 602 to 603 is any amino acid
  Variant (610)..(611): Xaa in position 610 to 611 is any amino acid
  Variant (616)..(616): Xaa in position 616 is any amino acid
  Variant (619)..(619): Xaa in position 619 is any amino acid
  Variant (622)..(622): Xaa in position 622 is any amino acid
  Variant (625)..(625): Xaa in position 625 is any amino acid
  Variant (627)..(630): Xaa in position 627 to 630 is any amino acid
  Variant (634)..(634): Xaa in position 634 is any amino acid
  Variant (636)..(636): Xaa in position 636 is any amino acid
  Variant (638)..(639): Xaa in position 638 to 639 is any amino acid
  Variant (643)..(643): Xaa in position 643 is any amino acid
  Variant (645)..(645): Xaa in position 645 is any amino acid
  Variant (647)..(647): Xaa in position 647 is any amino acid
  Variant (651)..(654): Xaa in position 651 to 654 is any amino acid
  Variant (656)..(657): Xaa in position 656 to 657 is any amino acid
  Variant (662)..(663): Xaa in position 662 to 663 is any amino acid
  Variant (667)..(668): Xaa in position 667 to 668 is any amino acid
  Variant (669)..(673): Xaa in position 669 to 673 is any or no amino acid
  Variant (675)..(676): Xaa in position 675 to 676 is any amino acid
  Variant (678)..(679): Xaa in position 678 to 679 is any amino acid
  Variant (681)..(687): Xaa in position 681 to 687 is any amino acid
  Variant (689)..(692): Xaa in position 689 to 692 is any amino acid
  Variant (695)..(699): Xaa in position 695 to 699 is any amino acid
  Variant (700)..(707): Xaa in position 700 to 707 is any or no amino acid
  Variant (709)..(710): Xaa in position 709 to 710 is any amino acid
  Variant (712)..(713): Xaa in position 712 to 713 is any amino acid
  Variant (716)..(717): Xaa in position 716 to 717 is any amino acid
  Variant (719)..(723): Xaa in position 719 to 723 is any amino acid
  Variant (725)..(728): Xaa in position 725 to 728 is any amino acid
  Variant (730)..(731): Xaa in position 730 to 731 is any amino acid
  Variant (734)..(734): Xaa in position 734 is any amino acid
  Variant (738)..(739): Xaa in position 738 to 739 is any amino acid
  Variant (747)..(747): Xaa in position 747 is any amino acid
  Variant (749)..(749): Xaa in position 749 is any amino acid
  Variant (751)..(757): Xaa in position 751 to 757 is any amino acid
  Variant (759)..(765): Xaa in position 759 to 765 is any amino acid
  Variant (767)..(767): Xaa in position 767 is any amino acid
  Variant (768)..(770): Xaa in position 768 to 770 is any or no amino acid
  Variant (772)..(777): Xaa in position 772 to 777 is any amino acid
  Variant (779)..(779): Xaa in position 779 is any amino acid
  Variant (781)..(782): Xaa in position 781 to 782 is any amino acid
  Variant (785)..(790): Xaa in position 785 to 790 is any amino acid
  Variant (798)..(798): Xaa in position 798 is any amino acid
MXXXXXXXKXXXDXXXLXXXTXXHXXXXXRQFSTXSXAKXXASFKGLRRVLTHDGTXXXDXXXNXHXXXXKXKSSDALXRXRXISGLNMTALXXXKXXXXXXXXXXXSXXXXXXXSXXXSXXSXXXXXXXXXXXXGXGLXPRRXXSTXSVLXLRXXQEXXXXESTTDEEVEXFXXXXXXXXXXXXXXXXXXHXXPXXXXXXXXXXXXXXXXXXXXXXXXXXXXXXXXXXXXXXXXXXXXXXXSXXXFXXXXXXXXXXXXXXXSPXXIXTXXXXXXXXXXXXXSXXXXXXXIDXXXXXXXXXXXXXXXXXDXXXEAXXDXXXXXXXXXXXXXXXXSNXXXXHXXXXXDXEDHIXXXXXNSXXXXXXSXXXXXRXXXXXXKXXXXEEXXXXXXXXXXXXIXXXXXKDXEXXSXXXXXYXPXMILSQSTGVERXFENXSSIQNSLXXEIXXXXXXXXSXXTXXXXXXXXXXXXXXXXXXSXXXXNIXXXXXXXXXXAXXXXXXXXXXXXXXXXXXSXLTNNLXXXXPXXXXXXSXXXNXXXXKXXXXXXXRXXXXXKXXXXXXXXXXXXXXXXXXXSXXXXXRXSNSXXKXNXFXQFLKSXXIDXXSRTQRKXXLQREXSIXDLXSQXDXXXXIFMXGXIXXKREXEXIXHEYXXXXRXXNPLDXXLLRXXXXXXXNXXNXXKXXXXXXXSXXXXSSXXXXXXXXXXXXXNXXKXXDDXXPXXXXXKXXXXLXXIWXSESXXFNKDVNPXNXNXXXXXXXSXXXXXXXNXXXXLXXXXXXSXTXXHQXXXXXXQPTTRAVXRRMEN

SEQ ID NO: 5753 - protein, 61 aa, Artificial sequence
  protein pattern
  Variant (2)..(2): Xaa in position 2 is Ala or Ser
  Variant (8)..(8): Xaa in position 8 is Asp or Glu
  Variant (9)..(9): Xaa in position 9 is Gly or Asn
  Variant (12)..(12): Xaa in position 12 is Ala or Gly
  Variant (13)..(13): Xaa in position 13 is Glu or Asn
  Variant (20)..(20): Xaa in position 20 is any or no amino acid
  Variant (22)..(22): Xaa in position 22 is any or no amino acid
  Variant (27)..(27): Xaa in position 27 is Asn or Ser
  Variant (30)..(30): Xaa in position 30 is Leu or Met
  Variant (33)..(33): Xaa in position 33 is any or no amino acid
  Variant (36)..(36): Xaa in position 36 is Asn or Thr
  Variant (38)..(38): Xaa in position 38 is Gly or Ser
  Variant (39)..(39): Xaa in position 39 is Ala or Ser
  Variant (40)..(40): Xaa in position 40 is Asp or Glu
  Variant (41)..(41): Xaa in position 41 is Ala or Ser
  Variant (45)..(45): Xaa in position 45 is Ala or Thr
  Variant (47)..(47): Xaa in position 47 is any amino acid
  Variant (49)..(49): Xaa in position 49 is Asp or Glu
  Variant (50)..(50): Xaa in position 50 is Ala or Gln
  Variant (54)..(54): Xaa in position 54 is Phe or Tyr
  Variant (56)..(56): Xaa in position 56 is Lys or Arg
  Variant (58)..(58): Xaa in position 58 is Ser or Thr
FXQFLKSXXIDXXSRTQRKXLXLQREXSIXDLXSQXDXXXXIFMXGXIXXKREXEXIXHEY

SEQ ID NO: 5754 - protein, 33 aa, Artificial sequence
  protein pattern
  Variant (2)..(2): Xaa in position 2 is Asn or Pro
  Variant (4)..(4): Xaa in position 4 is Ala or Ile
  Variant (6)..(6): Xaa in position 6 is Asp or Asn
  Variant (18)..(18): Xaa in position 18 is Lys or Arg
  Variant (22)..(22): Xaa in position 22 is Pro or Ser
  Variant (30)..(30): Xaa in position 30 is Ala or Gly
  Variant (31)..(31): Xaa in position 31 is any amino acid
EXYXPXMILSQSTGVERXFENXSSIQNSLXXEI

SEQ ID NO: 5755 - protein, 55 aa, Artificial sequence
  protein pattern
  Variant (2)..(4): Xaa in position 2 to 4 is any amino acid
  Variant (6)..(8): Xaa in position 6 to 8 is any amino acid
  Variant (9)..(11): Xaa in position 9 to 11 is any or no amino acid
  Variant (13)..(13): Xaa in position 13 is Met or Val
  Variant (14)..(14): Xaa in position 14 is Pro or Thr
  Variant (15)..(15): Xaa in position 15 is Asn or Ser
  Variant (17)..(17): Xaa in position 17 is Asn or Thr
  Variant (18)..(18): Xaa in position 18 is Ala or Ser
  Variant (19)..(19): Xaa in position 19 is Pro or Ser
  Variant (21)..(21): Xaa in position 21 is any amino acid
  Variant (22)..(22): Xaa in position 22 is Ser or Val
  Variant (24)..(24): Xaa in position 24 is Gly or Gln
  Variant (25)..(27): Xaa in position 25 to 27 is any amino acid
  Variant (28)..(28): Xaa in position 28 is Phe or Met
  Variant (34)..(34): Xaa in position 34 is Lys or Arg
  Variant (36)..(36): Xaa in position 36 is Lys or Arg
  Variant (39)..(39): Xaa in position 39 is Gly or Ser
  Variant (40)..(40): Xaa in position 40 is Asn or Ser
GXXXKXXXXXXDXXXLXXXTXXHXXXXXRQFSTXSXAKXXASFKGLRRVLTHDGT

SEQ ID NO: 5756 - DNA, 786 bp, Saccharomyces cerevisiae
  CDS (1)..(786)
atgaagacctatcatttgaataatgatataattgtcacacaagaacagttggatcattggaatgaacaactaatcaagctggaaacgccacaggagattattgcatggtctatcgtaacgtttcctcaccttttccaaaccactgcatttggtttgactggcttggttactatcgatatgttgtcaaagctatctgaaaaatactacatgccagaactattatttatagacactttgcaccatttcccacaaactttaacactaaaaaacgagattgagaaaaaatactaccagcctaaaaatcaaaccattcacgtatataagccggatggatgtgaatcggaggcagattttgcctcgaaatacggggatttcttatgggagaaagatgatgacaagtacgattatctggccaaagtggaacctgcacatcgtgcctacaaagagctacatataagtgctgtgtttactggtagaagaaaatcacaaggttctgcccgctcccaactgtcgattattgaaatagacgaacttaatggaatcttaaaaataaatccattgatcaattggacgttcgagcaggttaaacagtatatagatgcaaacaatgtaccatacaacgaacttttggaccttggatatagatccattggtgattaccattccacacaacccgtcaaggaaggtgaagatgagagagcaggaagatggaagggcaaggccaagaccgagtgtggaattcatgaagccagccgattcgcgcaatttttaaagcaagatgcctag

SEQ ID NO: 5757 - protein, 261 aa, Saccharomyces cerevisiae
MKTYHLNNDIIVTQEQLDHWNEQLIKLETPQEIIAWSIVTFPHLFQTTAFGLTGLVTIDMLSKLSEKYYMPELLFIDTLHHFPQTLTLKNEIEKKYYQPKNQTIHVYKPDGCESEADFASKYGDFLWEKDDDKYDYLAKVEPAHRAYKELHISAVFTGRRKSQGSARSQLSIIEIDELNGILKINPLINWTFEQVKQYIDANNVPYNELLDLGYRSIGDYHSTQPVKEGEDERAGRWKGKAKTECGIHEASRFAQFLKQDA

SEQ ID NO: 5758 - DNA, 819 bp, Cryptococcus neoformans var. neoformans JEC21
  CDS (1)..(819)
atgtccagtgaagacatcctcactccccagtacacccctgaagaaatcgagcgatttaacgccgaactcgacggcaaaactcctcaggagatcttgacctgggctgtcgacaacgtcgatggcttgtaccagactactgctttcgggctgactggtaccgccgctgtagatatgatttccaagatttctttggaccgcgaagaaactcaccttgttccacttatcttccttgacacccttcaccacttccctgaaactcttgctctcgctcaaaccatggccgacacctacctcgctccgttacacatttacactccccccggcgtttctactgctgaagaattcgccgtcaagtatggcgagaagctctgggagactgacgaaggcgcctacgattatctggtgaaggttgaacctgcagccagggcttacaaggagctgggcgtccgggcggtcatcactggtaggcgaagaagccaaggcgccgatcgagcagacttgaaggtgctcgaaatcgatgagaggggattgctcaagatcaaccctttgatcggatggagctttaaagaggtcaaggaatacattgacaaggaaggagttccttacaacccacttctcgacaagggctaccgatctatcggtgacgtccactccactgccccccctgaccccaacgccgccagtgatgctgctgagcgaagtggtcgatggcaaggtaaggccaagaccgaatgtggtttacacagcaactattttgagatgaagaagaagtttgaagagaaagcggccgctgcgggcgaagcttccaagcagtcataa

SEQ ID NO: 5759 - protein, 272 aa, Cryptococcus neoformans var. neoformans JEC21
MSSEDILTPQYTPEEIERFNAELDGKTPQEILTWAVDNVDGLYQTTAFGLTGTAAVDMISKISLDREETHLVPLIFLDTLHHFPETLALAQTMADTYLAPLHIYTPPGVSTAEEFAVKYGEKLWETDEGAYDYLVKVEPAARAYKELGVRAVITGRRRSQGADRADLKVLEIDERGLLKINPLIGWSFKEVKEYIDKEGVPYNPLLDKGYRSIGDVHSTAPPDPNAASDAAERSGRWQGKAKTECGLHSNYFEMKKKFEEKAAAAGEASKQS

SEQ ID NO: 5760 - DNA, 726 bp, Xanthomonas oryzae pv. oryzae KACC10331
  CDS (1)..(726): transl_table=11
atgaccgcgctacctgccgcatcaatcacctcttccgcgttggacgatctggacgcgctcaatgcgcagctggaaggcctgcgtgccgacgaacgcgtggcctgggcgctgcagcacggcccgcaggacgcggcgctgtcgtccagcttcggcgcgcaatcggcagtgacgctgcatctgctcagccagcaacgcccggacatcccggtgatcctgatcgacaccggctacctgttcccggaaacctaccgcttcgccgatgccttgaccgaacggctcaagctcaatctcaaggtatatcgcccgctggtcagccgcgcctggatggaagcgcgccacggccgcctgtgggaacaaggcatggtcggcatcgatcagtacaacaacctgcgcaaggtcgaaccgatgcgccgcgccttggacgaactcaacgtgggcacctggttcaccggcctgcgccgcagccaatccggcggccgcgcgcagacgccaatcgtgcagaagcgcggtgagcgctacaaaatcagccccatcgccgactggaccgatcgcgacgtgtggcagtacctgcaggcgcacgagctgccgtaccacccactgtgggaacaaggctacgtgtccatcggcgatttccacaccacgcgtcgctgggaacccggcatgcgcgaggaagacacgcgcttctttggcctgaagcgggagtgcggcatccacgaggatatctag

SEQ ID NO: 5761 - protein, 241 aa, Xanthomonas oryzae pv. oryzae KACC10331
MTALPAASITSSALDDLDALNAQLEGLRADERVAWALQHGPQDAALSSSFGAQSAVTLHLLSQQRPDIPVILIDTGYLFPETYRFADALTERLKLNLKVYRPLVSRAWMEARHGRLWEQGMVGIDQYNNLRKVEPMRRALDELNVGTWFTGLRRSQSGGRAQTPIVQKRGERYKISPIADWTDRDVWQYLQAHELPYHPLWEQGYVSIGDFHTTRRWEPGMREEDTRFFGLKRECGIHEDI

SEQ ID NO: 5762 - DNA, 798 bp, Eremothecium gossypii
  CDS (1)..(798)
atgctgcgtaataacaagtatgaactcaacgatggtctagttgtgacagactcacagctagactgctggaacatgactgccgcaaaattgacctctcccgctgaagtcttacattgggctgttacaacgtttccgcatctctatcaaatgaccgcatttggtttaaccgggctggcaacaatcgacatgttgtcaaaactaccagctctagaggagcaaatggttccgttaatatttatcgatacactccatctatttccgcaaacgttgtccttgttgcaccaagttgaggacaggtactataagcccctttcgcagtcaatccatatcttccgccccgcaggtgtcagcaccgaaaaggagttcgctgaaaagtacggcagctgcctgtgggaaactgacgaggacaagtacgacttcatagccaaggtggagcccgctcaccgggcttttcgttcgttgggcgtaggtgccgtgctcaccggacgcaggcgctcgcagggtggaagccgcgaacagctcaacttcgttgaagtcgatgaggtcaacgctgtacttaaaatcaatccctttgttacatggagttttgatcaagtctggtcttatatcttggataaccggattccttataacgagctgttaaactatggctacaagtcaattggtgactatcactccacgctgcccgtggtcgatggcgccggagaaagatccggacgatggaaaggcaaggcaaaaacagaatgtggtttacacacggccagcaaatatgcccggtatcttctggaacagaagtaa

SEQ ID NO: 5763 - protein, 265 aa, Eremothecium gossypii
MLRNNKYELNDGLVVTDSQLDCWNMTAAKLTSPAEVLHWAVTTFPHLYQMTAFGLTGLATIDMLSKLPALEEQMVPLIFIDTLHLFPQTLSLLHQVEDRYYKPLSQSIHIFRPAGVSTEKEFAEKYGSCLWETDEDKYDFIAKVEPAHRAFRSLGVGAVLTGRRRSQGGSREQLNFVEVDEVNAVLKINPFVTWSFDQVWSYILDNRIPYNELLNYGYKSIGDYHSTLPVVDGAGERSGRWKGKAKTECGLHTASKYARYLLEQK

SEQ ID NO: 5764 - DNA, 936 bp, Neurospora crassa
  CDS (1)..(936)
atggcctccgagcaaaactcccagacctccaccagggcctcgtcccccaagcttgacggcaagtttgacgacaacgcctccgtcgactccggcttcgcttccgccaactcctccaccgccaaccttcccttgatttctctcaccaagcctcatctcgaccacctaaacaaacagctcgagaacatggaggccctggacatcctccgcttctgcaagattctcttccccaacctcttccagaccacggccttcggcctgaccggcctcgtcacgctcgacatgctctccaagctggccaaggagtcacccgacgcggcccccgtcgacctgatcttcctcgacacgctctaccacttcaaggaaacttatgctcttgtcgaccgcgtgcaggagcgctaccccaacatccggctgcacgtcttcaagccggccgacgtgtccaacgtcgacgagtttgaggccctctacggcgagaagttgtacgaaacctccgaagaactatacgattggatcgccaaggtggagccgcagaaccgcgcctaccaggaactcaaggtggctgccgtgttcacaggccgccgccgctcccagggaggtgcacgcggctccattcccgtcattgagctggatgaggagcgtggcatcgtcaagatcaacccgctcgtcaactggagcttccagcaggtcaaggcctacattgatgagcaccaagtgccttacaacgagctgctcgataaggggtacaagtccattggtgattggcactcgactagccccgtcgccgcgggcgaggacgagcgtgctgggcgctggaagggcaagaacaagacggagtgcggaatccacaacaagcagagcaggtatgcccagtttctggcggagaacgcgaggaagcaggcaaagggtgctgctccggtcgagacggttcaggcttga

SEQ ID NO: 5765 - protein, 311 aa, Neurospora crassa
MASEQNSQTSTRASSPKLDGKFDDNASVDSGFASANSSTANLPLISLTKPHLDHLNKQLENMEALDILRFCKILFPNLFQTTAFGLTGLVTLDMLSKLAKESPDAAPVDLIFLDTLYHFKETYALVDRVQERYPNIRLHVFKPADVSNVDEFEALYGEKLYETSEELYDWIAKVEPQNRAYQELKVAAVFTGRRRSQGGARGSIPVIELDEERGIVKINPLVNWSFQQVKAYIDEHQVPYNELLDKGYKSIGDWHSTSPVAAGEDERAGRWKGKNKTECGIHNKQSRYAQFLAENARKQAKGAAPVETVQA

SEQ ID NO: 5766 - DNA, 1065 bp, Magnaporthe grisea 70-15
  CDS (1)..(1065)
atgacgcaaccatcatccagggagtcttctccacgtatgaagcccctccacgtcaagttcgaggacgccgcagagatggactcgggctactgctcggccagctcgtcgacggcatctctccctcaggtttccttcacaccctctcacctgcgccatatcaacgaccagctcgagaagatgcaagccatggacatcctccgcttctgccgcgtcctcttcccaaacctataccagacgacggcctttggcctgacggggctcgtgacgcttgacatgctatccaagatggagaaggagtcttccttcctgccttcggtcgaactcatattcctcgacaccctgtaccactttgacgagacgtaccagctcgtcgagagggtcaaggagcggtacagcaacgtcaagatgcacgtgtacaagccggcagactgcgggacggtggccgacttcgagacgaagtacggcgagaagctgtatgagactagcgccgagttctacgactgggtggccaaggtcgagccccagcagcgcgcctactcggacctcaacgtcggtgccgtcctcaccggccgccgcaggtctcagggcggccagcgcaacaagatccccatcgtcgaggtcgacaacgagacaggcatcgtcaagatcaaccccctcgtcaactggtcgttccaggacgtgcaaaagtacatcaaggagaacgacgtcccgtacaacgtcctgctcgacagggggtacaagtcggtcggcgactggcactcgaccagccccgtggctgagggagaggacgagagggccggaaggtggaagggtcagaacaagaccgagtgcggaatccataacaagaagtcgcgttacgcccagtttcttgaggaggccgacaggaaggctgcggaggctgccaaggctgccaaggctgctacggcggcggccatgcaagactcgccggtcggcagcgagattgcagatgatgctcgctggcacgctgcgaggaggccaggtgctcgccggcgccaacatcatcaccaggaccatgtcccttctgccgtcacctcatccgcttga

SEQ ID NO: 5767 - protein, 354 aa, Magnaporthe grisea 70-15
MTQPSSRESSPRMKPLHVKFEDAAEMDSGYCSASSSTASLPQVSFTPSHLRHINDQLEKMQAMDILRFCRVLFPNLYQTTAFGLTGLVTLDMLSKMEKESSFLPSVELIFLDTLYHFDETYQLVERVKERYSNVKMHVYKPADCGTVADFETKYGEKLYETSAEFYDWVAKVEPQQRAYSDLNVGAVLTGRRRSQGGQRNKIPIVEVDNETGIVKINPLVNWSFQDVQKYIKENDVPYNVLLDRGYKSVGDWHSTSPVAEGEDERAGRWKGQNKTECGIHNKKSRYAQFLEEADRKAAEAAKAAKAATAAAMQDSPVGSEIADDARWHAARRPGARRRQHHHQDHVPSAVTSSA

SEQ ID NO: 5768 - DNA, 927 bp, Aspergillus fumigatus
  CDS (1)..(927)
atgcctgccaagttgccttcaaactacacctctgatgcagaggccgctgtcgactccagagatcttcagactgaatccggctatgtcagtggggattcgagtgatgtctacactccagagattgtcttcaccaaaccacacctgcaatttcttaacaggcaactccagttccttgagcctcaagaaatcttgagatggtgtatcacatcccttcctcacctcttccagaccactgcgtttggtttgactggacttgtcaccctggacatgctttccaagcttcaagtgccccgcccacagatggttgatttgatcttccttgacactctccatcacttcccagaaaccctggctctggttgaccgtgtccgcaagaggtaccctctgaacaacatccacatctacaagcccgctggtattgaaactgcggaagagttttccaagaagtacggtgccaagctctgggagacagacgatcagttctacgactgggttgccaaggtcgaaccggcccagcgtgcctatcgtgaactcaacgttcatgctgtcctcactggacgccgccgcagtcagggtggcaagcgtggcgatctcgatgtgatcgaggtcgacgaggccggcctcatcaaggtcaaccctctggccaactggactttcgaacaagtgaaacaatacatcaaggagaacgatgtgccctacaacgaactgctggaccgcggctacaagagcatcggtgactggcactccacacagcctgtcaaggagaatgaggacgagcgatctggtcgctggaagggccaggagaagaccgagtgtggcatccacaacccccgttccaagtacgcccagtacctgatggagctggagcgtaagagacaggaggaagctctatcacaggcacttcaaaaccagctcaccactgcgtag

SEQ ID NO: 5769 - protein, 308 aa, Aspergillus fumigatus
MPAKLPSNYTSDAEAAVDSRDLQTESGYVSGDSSDVYTPEIVFTKPHLQFLNRQLQFLEPQEILRWCITSLPHLFQTTAFGLTGLVTLDMLSKLQVPRPQMVDLIFLDTLHHFPETLALVDRVRKRYPLNNIHIYKPAGIETAEEFSKKYGAKLWETDDQFYDWVAKVEPAQRAYRELNVHAVLTGRRRSQGGKRGDLDVIEVDEAGLIKVNPLANWTFEQVKQYIKENDVPYNELLDRGYKSIGDWHSTQPVKENEDERSGRWKGQEKTECGIHNPRSKYAQYLMELERKRQEEALSQALQNQLTTA

SEQ ID NO: 5770 - DNA, 786 bp, Saccharomyces pastorianus; strain Weihenstephan 34/70
  CDS (1)..(786)
atgaaaagttaccatttgaacaatgacattattgtcacacaggaacagttagatcattggaacgaacaattagccaagttggaaacggcacaagagattatcgaatggtcgctagtggctttcccacaccttttccaaaccactgcgtttggactgacaggtttggtcaccatcgacatgctgtcgaaactatccgggaaatactatatgccggaattattatttatagacactttgcaccatttcccacagactttaacactgaaggatacaatcgagcaaaagtattatcagccccagaagcaaactatccatgtttataagccagatggatgcgtctcagaggcggaatttgcctcgaagtacggtgatttcctatgggagaaagacgacgataagtacgactatttggctaaagtagaacctgcgcaccgtgcttacaaagaactgcgcgtaagtgccgtcttcacaggcagaagaaagtcgcagggttctgctcgctctcagttgtcgcttattgaaattgacgagcttaacgggatcttgaagataaatccattgattaattggacattcgagcaagttaaacaatatatagatgcaaacaatgtaccatacaatgagcttttggatctcgggtatagatccgttggtgattaccattccacacaacctgtaaaggaaggtgaagatgaaagagcaggaaggtggaagggcaagacaaagactgagtgtggaattcacgaagccagtagattcgcccaatttctaaaacaagacgcctag

SEQ ID NO: 5771 - protein, 261 aa, Saccharomyces pastorianus; strain Weihenstephan 34/70
MKSYHLNNDIIVTQEQLDHWNEQLAKLETAQEIIEWSLVAFPHLFQTTAFGLTGLVTIDMLSKLSGKYYMPELLFIDTLHHFPQTLTLKDTIEQKYYQPQKQTIHVYKPDGCVSEAEFASKYGDFLWEKDDDKYDYLAKVEPAHRAYKELRVSAVFTGRRKSQGSARSQLSLIEIDELNGILKINPLINWTFEQVKQYIDANNVPYNELLDLGYRSVGDYHSTQPVKEGEDERAGRWKGKTKTECGIHEASRFAQFLKQDA

SEQ ID NO: 5772 - DNA, 735 bp, Klebsiella pneumoniae subsp. pneumoniae MGH 78578
  CDS (1)..(735): transl_table=11
atgtccgtactcgatctaaacgcgcttaatgcattgccgaaagtggaacgcattctggcactcgcggaaaccaacgcccaactggaaaagcttgacgccgaagggcgtgtggcgtgggcgctggaaaatctgccgggaaactatgtgctgtcgtcgagctttggcattcaggcggcggtaagtttgcatctggtgaatcagatccgcccggacattccggtgatcctcaccgataccggctacctgttcccggaaacctatcagtttattgacgagctgacggacaagctcaagctgaacctgaaggtctaccgcgcggctgaaagcgcggcctggcaggaggcgcgctacggcaagctgtgggagcagggcgttgagggcattgagaaatacaatgagatcaacaaggttgagccgatgaaccgggcgctgaaagagctcaacgcgcagacgtggtttgccggtctgcgccgcgagcagtcgggcagccgggctacgcttccggtgctggcggtccagcgcggggtgttcaaggtgctaccgattatcgactgggataaccgcacggtgtatcagtacctgcaaaagcacgggctgaagtaccacccgctgtgggatcagggctatctctcggtaggcgatacccacaccacccgcaagtgggagccgggcatggcagaagaagagacccggttcttcgggcttaaacgcgagtgcggattgcacgagggttaa

SEQ ID NO: 5773 - protein, 244 aa, Klebsiella pneumoniae subsp. pneumoniae MGH 78578
MSVLDLNALNALPKVERILALAETNAQLEKLDAEGRVAWALENLPGNYVLSSSFGIQAAVSLHLVNQIRPDIPVILTDTGYLFPETYQFIDELTDKLKLNLKVYRAAESAAWQEARYGKLWEQGVEGIEKYNEINKVEPMNRALKELNAQTWFAGLRREQSGSRATLPVLAVQRGVFKVLPIIDWDNRTVYQYLQKHGLKYHPLWDQGYLSVGDTHTTRKWEPGMAEEETRFFGLKRECGLHEG

SEQ ID NO: 5774 - DNA, 720 bp, Sulfolobus solfataricus P2
  CDS (1)..(720): transl_table=11
atgcttagcaaagatgagttagactccctaaataaattgttcgaagataaggaacccctagaagtgctgaaatggggaatagagaaattttaccctaaaatcgccttagcttgtagtcttcaggctgaagatttggtaatactagatatgttaagtaaggttactgaaaaaccaagagtctttataatagatactggtagactccaccaagaaagttatgacttaatagaggaaatagtgaaaaagtataacatagacttaaggatatattttccagactataaagaggtagaagatctagttaataagtatggaatcaacttattttacaaaagtgttgaacttagaaaggcgtgctgtgaagtgaggaaagttagacccctaaagagagcgttggatggaatggaagcttggataactgggctaaggagagaacaaaatttcactagagggaggataaggaaaatagaaatagacgaagtcaatggagggattattaagttaaatccgttggctgactggacatgggaacaggtatgggaatatataaataaaaataatgttccttataataagctctacgataaagggtataagagtataggatgtgtaccatgtactagaccagttaaaccttgggagcatccaagagctggtagatggtggtgggagcagaatagtgacaaggaatgtgggcttcattatagagaggtgaagtga

SEQ ID NO: 5775 - protein, 239 aa, Sulfolobus solfataricus P2
MLSKDELDSLNKLFEDKEPLEVLKWGIEKFYPKIALACSLQAEDLVILDMLSKVTEKPRVFIIDTGRLHQESYDLIEEIVKKYNIDLRIYFPDYKEVEDLVNKYGINLFYKSVELRKACCEVRKVRPLKRALDGMEAWITGLRREQNFTRGRIRKIEIDEVNGGIIKLNPLADWTWEQVWEYINKNNVPYNKLYDKGYKSIGCVPCTRPVKPWEHPRAGRWWWEQNSDKECGLHYREVK

SEQ ID NO: 5776 - DNA, 720 bp, Sulfolobus tokodaii str. 7
  CDS (1)..(720): transl_table=11
atgataagcagagaagaacttgaaaaactcaacagttacttcgaagagaaagagccaatagaaatcttaaaatggggtatagaaaagttccaccctaaaataacattagcgtgcagtcttcaagcagaagatttagtaatattagacatgcttagtaaaatagtgaaaagaccaaaggttttcataatagatactgggagattacatcaagaaacttacgatttgatagaacagattacaagtaaatacgacgtagatttatcgatatacttcccagattataaagaggtagaggaaatggtcaaaaaatatggaataaatctattttataaaagtatcgagcttagaaaattatgctgtgaaattaggaaagtaaggcctttaaagagagctttagaggggatggatgcatggataacagggcttagaagggaacaaaatttcactagaagcaaaataaggaaaattgaaattgatgagattaatggaggaatagtaaaactaaatcctttagcagattgggtttatgaacaagtatgggattatataaagaagaataacgttccttacaataagctttacgataagggctataagagcattggctgtgtaccatgtacgagacctgtaaagccttgggaacaccctagggcaggtagatggtggtgggaacaaagtggagataaagaatgtggattacattatagggaggtgaagtga

SEQ ID NO: 5777 - protein, 239 aa, Sulfolobus tokodaii str. 7
MISREELEKLNSYFEEKEPIEILKWGIEKFHPKITLACSLQAEDLVILDMLSKIVKRPKVFIIDTGRLHQETYDLIEQITSKYDVDLSIYFPDYKEVEEMVKKYGINLFYKSIELRKLCCEIRKVRPLKRALEGMDAWITGLRREQNFTRSKIRKIEIDEINGGIVKLNPLADWVYEQVWDYIKKNNVPYNKLYDKGYKSIGCVPCTRPVKPWEHPRAGRWWWEQSGDKECGLHYREVK

SEQ ID NO: 5778 - DNA, 735 bp, Caulobacter crescentus CB15
  CDS (1)..(735): transl_table=11
gtggcctacgaccagacgagcgcgacggctccaggccttgccgcccggctggacgccgagctgcgcgacgcccatcccagcgagatcctccgcacggcccatgagcacttcggcgacaagctggcgctggtgtcgtcgttcggcgccgagtcggcggtgctgctgcatctggcctcgcgcgtctcgccgggcctgccggttctgttcctcgacaccgggatgctgtttggccagacgctggactatcgaaagaatatcgcggcccagttcggcctgaccgatgtccgcgatctgcggccggctttcgcggacctggcgacccaggaccctaactccgacctctggcgcaccagcgtcgacggctgctgccacattcgcaaggttctgccgctggatcgcgcgttgggcggcttcgacgcctggatcaccggtcgcaagcgcttccacggcggtgatcgcctgagcctgccagtggtcgaagaggccgacggcaagatcaagttcaacccgttggccaactggtccaaggccgagctcgacgcctatgtcgccgaacatgacctgccggcccacccgctggtggcccagggctatgcctcggtcggctgttggccgtgcacgcagccttccgacgacggaaggtccgggcgctgggcgggtcaggaaaagaccgagtgcggcatccacgtcgcgcgggcgcccggtgtcgcgccgaacgtgggcggggatatctga

SEQ ID NO: 5779 - protein, 244 aa, Caulobacter crescentus CB15
MAYDQTSATAPGLAARLDAELRDAHPSEILRTAHEHFGDKLALVSSFGAESAVLLHLASRVSPGLPVLFLDTGMLFGQTLDYRKNIAAQFGLTDVRDLRPAFADLATQDPNSDLWRTSVDGCCHIRKVLPLDRALGGFDAWITGRKRFHGGDRLSLPVVEEADGKIKFNPLANWSKAELDAYVAEHDLPAHPLVAQGYASVGCWPCTQPSDDGRSGRWAGQEKTECGIHVARAPGVAPNVGGDI

SEQ ID NO: 5780 - DNA, 726 bp, Nostoc sp. PCC 7120
  CDS (1)..(726): transl_table=11
atgacagcttctacggcatttaaaacccaaacaaacgaatttaatttagatgaattaaatcaacagtttgaaactgccactcctaaagaaattctggcatggtctatagagcatatccccacagggttggtacaaactagcgcctttaatgtggatgacttagtaattacccatatcctttatagtgaactcaagcaaccagtacctgtaatctttctcgatactctgttccactttcaacaaactttagaactcgttgctaaagcgaaagaaatatataatctagatttacaaacctacaaaactccagatgtagatacccgtgaagcctttactgctaaatacggcgaagcgctttgggataaagatattacgcaattccaccacgttaccaaaattgaacctctacaacgtggtttagatgaacttaataccgttgcttggattactggccgtcgtcgcgatcaagccgttacccgcgcgaatatgcctgtatttgaattagatggcaaaggtcgtttgaaagtaaatcccttagcagcttggacacgtcaagatagctgggattacgtagctgaacataaagtaatttataatcctctacacgatcaaggttatcccagtattggcgatgaacccatcaccaccaaggtaggcgaaggcgaagacgaacgcgccggacgctggagaggaagcaataaaactgaatgtgggattcacatttag

SEQ ID NO: 5781 - protein, 241 aa, Nostoc sp. PCC 7120
MTASTAFKTQTNEFNLDELNQQFETATPKEILAWSIEHIPTGLVQTSAFNVDDLVITHILYSELKQPVPVIFLDTLFHFQQTLELVAKAKEIYNLDLQTYKTPDVDTREAFTAKYGEALWDKDITQFHHVTKIEPLQRGLDELNTVAWITGRRRDQAVTRANMPVFELDGKGRLKVNPLAAWTRQDSWDYVAEHKVIYNPLHDQGYPSIGDEPITTKVGEGEDERAGRWRGSNKTECGIHI

SEQ ID NO: 5782 - DNA, 759 bp, Brucella melitensis 16M
  CDS (1)..(759): transl_table=11
gtgctgcctgacgccgacattgccgatgcggatgagcgcggtgccgcgcaagcccggcttctcgaagcaagccacggcgcatccgcgccgcacgaaataatcgcgcttgtcacgcatgagcttttcgaggggcgggttgcggttgtttcgtccttcggggcggaatcggcggtgctcctgcatatgatctcgcagatcgaccgggcaacgccggtgctgtttctcgatacgggcaagcattttcgcgccacactcgattatcgccatcaactggtgggtcgcctgggccttgccgatgtgcgggatatcctgcctgttgcggacagcctggcaaaggaagacccgttcggcgccttgtcgatgaccgacaaggaccgttgctgctttatccgcaaggtggagccgatggcgcgcgccgttgcgccttaccgggcatggatgacgggacgtaagcagtttcaggcatccacccgcaatgggctgccggtgtttgaatcggttggcccgcgtatccgtatcaacccgctggcgcgctggcgggccgaagacctcagggcctatgccgaaaagtacagcctgccgccgcacccgctgaccgcgcagggctatcgctccatcggctgcatgccttgcacacgccccgtctcggagggcgaggatcagcgtgccggacgctgggcggggtcggaaaagaccgaatgcggcattcatctttccggccttgccgatagcctgaagggcatcccgaaagctgtgtaa

SEQ ID NO: 5783 - protein, 252 aa, Brucella melitensis 16M
MLPDADIADADERGAAQARLLEASHGASAPHEIIALVTHELFEGRVAVVSSFGAESAVLLHMISQIDRATPVLFLDTGKHFRATLDYRHQLVGRLGLADVRDILPVADSLAKEDPFGALSMTDKDRCCFIRKVEPMARAVAPYRAWMTGRKQFQASTRNGLPVFESVGPRIRINPLARWRAEDLRAYAEKYSLPPHPLTAQGYRSIGCMPCTRPVSEGEDQRAGRWAGSEKTECGIHLSGLADSLKGIPKAV

SEQ ID NO: 5784 - DNA, 804 bp, Pyrobaculum aerophilum str. IM2
  CDS (1)..(804): transl_table=11
atgaggcgcgagtggactgatttagaagtggaagagctgtccctaaggtttgagaattctacggctgaggaattattaagctgggctcttaatgaattctatcccaatatagcattggcctttagtggtcaagctgaggatgtagtagtgctagacattatgcacaaagtagctcccgataagattagagtttttatgctggataccggccgtttgcccgaagaaatatatgagttagtggacaaagtacgcgaacactacggcgttgagatagaaatttactatccagatactaaagaaattgaggaatttgtaaagagatatggcattaatccattctatcgtgacgtagagcttaggcatttatgttgtaaaatacgaaaagtgaatcccttactgagggctctgtcaggactagacgcgtggatcacaggcttacgtagagatcaattccccacaagagctacaacaaggaaaatccaaatcgatcacgatcattacggaatattaaaaatatcgcctatatgtgattggacgtgggacgaagtgtggcagtatataaagaaatataatttgccatactgcaaattatacgatcgcggctatactagcatagggtgcgagccctgtacaaggcctacctttgtaagcctcggggatgtgacaggagaggagctaagaaaagggcgttggtggtgggagaaaaacgctccgaaagagtgcggaatacattgctcgctggaggcaggctcatttgaaaggcacatggaaacggtgtttaagctgaagatcaaaattaaatga

SEQ ID NO: 5785 - protein, 267 aa, Pyrobaculum aerophilum str. IM2
MRREWTDLEVEELSLRFENSTAEELLSWALNEFYPNIALAFSGQAEDVVVLDIMHKVAPDKIRVFMLDTGRLPEEIYELVDKVREHYGVEIEIYYPDTKEIEEFVKRYGINPFYRDVELRHLCCKIRKVNPLLRALSGLDAWITGLRRDQFPTRATTRKIQIDHDHYGILKISPICDWTWDEVWQYIKKYNLPYCKLYDRGYTSIGCEPCTRPTFVSLGDVTGEELRKGRWWWEKNAPKECGIHCSLEAGSFERHMETVFKLKIKIK

SEQ ID NO: 5786 - DNA, 696 bp, Corynebacterium glutamicum ATCC 13032
  CDS (1)..(696): transl_table=11
ttgtcaccagaggtagcaaaacataacgaggaactcgtcgaaaagcatgctgctgcgttgtatgacgccagcgcgcaagagatcctggaatggacagccgagcacgcgccgggcgctattgcagtgaccttgagcatggaaaacaccgtgctggcggagctggctgcgcggcacctgccggaagctgatttcctctttttggacaccggttaccacttcaaggagacccttgaagttgcccgtcaggtagatgagcgctattcccagaagcttgtcaccgcgctgccgatcctcaagcgcacggagcaggattccatttatggtctcaacctgtaccgcagcaacccagcggcgtgctgccgaatgcgcaaagttgaaccgctggcggcgtcgttaagcccatacgctggctggatcaccggcctgcgccgcgctgatggcccaacccgtgctcaagcccctgcgctgagcttggatgccaccggcaggctcaagatttctccaattatcacctggtcattggaggaaaccaacgagttcattgcggacaacaacctcatcgatcacccacttacccatcagggttatccatcaattggatgcgaaacctgcacccttcctgttgctgaaggacaagaccctagggccggccgttgggctggaaacgccaagacagaatgcggacttcactcatga

SEQ ID NO: 5787 - protein, 231 aa, Corynebacterium glutamicum ATCC 13032
MSPEVAKHNEELVEKHAAALYDASAQEILEWTAEHAPGAIAVTLSMENTVLAELAARHLPEADFLFLDTGYHFKETLEVARQVDERYSQKLVTALPILKRTEQDSIYGLNLYRSNPAACCRMRKVEPLAASLSPYAGWITGLRRADGPTRAQAPALSLDATGRLKISPIITWSLEETNEFIADNNLIDHPLTHQGYPSIGCETCTLPVAEGQDPRAGRWAGNAKTECGLHS

SEQ ID NO: 5788 - DNA, 711 bp, Streptomyces coelicolor A3(2)
  CDS (1)..(711): transl_table=11
atgacggcggttcaggaagagcgtacgaccgaggaactcaaggcgctggccgagcgggcgggccgcgagctggaggacgccacggcgctggaaatcctccggtgggcggccgagaccttcggcgaccggttctgcgtgacctcctccatggaggacgcggtcgtcgcccatctcgcctcccgcgccctgcccggcgtggacgtggtgttcctcgacaccggctaccacttcccggagaccatcggcacccgcgacgcggtcgaggccgtgatggacgtgaacgtcatcacgctcaccccgcgccagacggtcgccgagcaggacgccgagtacggcccgaagctgcacgaccgcgaccccgacctgtgctgcgcgctgcgcaaggtgaagccgctggaggaggggctggccggctaccgggcctgggcgaccgggctgcgccgcgacgagtccgagacccgggcgaacacgccggtcgtgggctgggacgagaagcggggcaaggtgaagatctcgcccatcgccaagtggtcacaggaagatgtgcaaacgtacgtcaccgagcacggcgtcctcacgaacccgctgctgacggacggctatgcctccgtgggctgcgcgccctgcacccgtcgtgtgctggagggcgaggacgcccgcgccggacgctgggcgggccgctcgaagaccgagtgcggactgcacggctga

SEQ ID NO: 5789 - protein, 236 aa, Streptomyces coelicolor A3(2)
MTAVQEERTTEELKALAERAGRELEDATALEILRWAAETFGDRFCVTSSMEDAVVAHLASRALPGVDVVFLDTGYHFPETIGTRDAVEAVMDVNVITLTPRQTVAEQDAEYGPKLHDRDPDLCCALRKVKPLEEGLAGYRAWATGLRRDESETRANTPVVGWDEKRGKVKISPIAKWSQEDVQTYVTEHGVLTNPLLTDGYASVGCAPCTRRVLEGEDARAGRWAGRSKTECGLHG

SEQ ID NO: 5790 - DNA, 741 bp, Thermosynechococcus elongatus BP-1
  CDS (1)..(741): transl_table=11
atgttttctaaaaccatgctaacaccgcctatggctgcctccgtaagctttgacctcgatgccctcaaccaacgctttgaaggggcacatccccgtgacattttggcatgggccgtcacagaaattccccaggggctggtgcagaccagtgcctttaacgtagatgacatggtgattacagatctgctgtaccgtgatctgcgccccaatccaccggtgcccgttctctttttggacacgctccatcactttgccgagaccctagcatttgtgcagcaggccaaggaaaaatacagtctggatttgcgcacctacaaaatccctgatgttgacagccgcgaagcctttgctgcccgctatggcgacaaactttgggaaaccaatgttgagcagtttcaccatctcactaaaattgaaccgctgcaacggggcttggcagaactgcatactgtggcttggattaccggccggcgtcgcgatcaagcgctcacccgtgccaatatgccctatgtggaactggacaaagagggtcgtctgaaaattaatccccttgctgcttggacacggaaacaaacttgggcctatgtgatggagcacggggtgatttacaatcccctccacgatcgcggctatgccagcattggcgatgagcccctcaccacccctatcgccgagggggaagatgaacgggccggtcgctggcgcggcatgggcaaaaccgagtgcgggattcacatctaa

SEQ ID NO: 5791 - protein, 246 aa, Thermosynechococcus elongatus BP-1
MFSKTMLTPPMAASVSFDLDALNQRFEGAHPRDILAWAVTEIPQGLVQTSAFNVDDMVITDLLYRDLRPNPPVPVLFLDTLHHFAETLAFVQQAKEKYSLDLRTYKIPDVDSREAFAARYGDKLWETNVEQFHHLTKIEPLQRGLAELHTVAWITGRRRDQALTRANMPYVELDKEGRLKINPLAAWTRKQTWAYVMEHGVIYNPLHDRGYASIGDEPLTTPIAEGEDERAGRWRGMGKTECGIHI

SEQ ID NO: 5792 - DNA, 723 bp, Oceanobacillus iheyensis HTE831
  CDS (1)..(723): transl_table=11
atgggtggctattcagttacctatagtaattttgttaaggatccatataaagactggtttcctgacgatgagacgaatggtgcttcaaaaatattgcaatgggcttatgaagtatatggaacggatatcgtatatgcttgcagctttggagcggaaggaatggtgctgatcgatctcatttcgaagacacaaaagaatgctgatattgtctttcttgatactgatcttcattttcaggaaacatatgacctgatagaagatataaaagtgaaatacccaacactcaacattcatatcaagaagcctgatttaacgttggaagagcaggcagccgaacatggttcagctttatggaagcgtcagccagaccaatgctgttatattcgtaaaattaagccattagaggatgcattaagtggtgcaccagcatggatatctggtctacggagagaacagtccgtatcaagaagcaaaacagattttataaacaaagatgaacggtttaaatctatcaaagtttgtcccttaattcattggacgtgggacgatgtatgggagtatatcaaagacaataacttaccgtacaatgaattacatgataatggatatccgagtattgggtgtattccttgtacttcccaagtgagtgattcctctgattcacgtgcaggaagatgggcgggtacccaaaagacggaatgtggtctccatacttccgattaa

SEQ ID NO: 5793 - protein, 240 aa, Oceanobacillus iheyensis HTE831
MGGYSVTYSNFVKDPYKDWFPDDETNGASKILQWAYEVYGTDIVYACSFGAEGMVLIDLISKTQKNADIVFLDTDLHFQETYDLIEDIKVKYPTLNIHIKKPDLTLEEQAAEHGSALWKRQPDQCCYIRKIKPLEDALSGAPAWISGLRREQSVSRSKTDFINKDERFKSIKVCPLIHWTWDDVWEYIKDNNLPYNELHDNGYPSIGCIPCTSQVSDSSDSRAGRWAGTQKTECGLHTSD

SEQ ID NO: 5794 - DNA, 759 bp, Brucella suis 1330
  CDS (1)..(759): transl_table=11
gtgctgcctgacgccgacattgccgatgcggatgagcgcgctgccgcgcaagcccggcttctcgaagcaagccacggcgcatccgcgccgcacgaaataatcgcgcttgtcacgcatgagcttttcgaggggcgggttgcggttgtttcgtccttcggggcggaatcggcggtgctcctgcatatgatctcgcagatcgaccgggcaacgccggtgctgtttctcgatacgggcaagcattttcgcgccacactcgattatcgccatcaactggtgggtcgcctgggccttgccgatgtgcgggatatcctgcctgttgcggacagcctggcaaaggaagacccgttcggcgccttgtcgatgaccgacaaggaccgttgctgctttatccgcaaggtggagccgatggcgcgcgccgttgcgccttaccgggcatggatgacgggacgtaagcagtttcaggcatccacccgcaatgggctgccggtgtttgaatcggttggcccgcgtatccgtatcaacccgctggcgcgctggcgggccgaagacctcagggcctatgccgaaaagtacagcctgccgccgcacccgctgaccgcgcagggctatcgctccatcggctgcatgccttgcacacgccccgtctcggagggcgaggatcagcgtgccggacgctgggcggggtcggaaaagaccgaatgcggcattcatctttccggccttgccgatagcctgaagggcatcccgaaagctgtgtaa

SEQ ID NO: 5795 - protein, 252 aa, Brucella suis 1330
MLPDADIADADERAAAQARLLEASHGASAPHEIIALVTHELFEGRVAVVSSFGAESAVLLHMISQIDRATPVLFLDTGKHFRATLDYRHQLVGRLGLADVRDILPVADSLAKEDPFGALSMTDKDRCCFIRKVEPMARAVAPYRAWMTGRKQFQASTRNGLPVFESVGPRIRINPLARWRAEDLRAYAEKYSLPPHPLTAQGYRSIGCMPCTRPVSEGEDQRAGRWAGSEKTECGIHLSGLADSLKGIPKAV

SEQ ID NO: 5796 - DNA, 732 bp, Bradyrhizobium japonicum USDA 110
  CDS (1)..(732): transl_table=11
gtgaacgcaattgcgcctcaggtatctcctgtgtccgtttccgcgctgccctctgccgcggaactcgatcgcgccttgcgcgatgcctcgcccgcggaggtcatcgccgcggccctgaaggcggtcggccgcgacaagcttgcgctggtgtcgtccttcggcacggaatcggcgacgcttctgaaggtgatggcggacgtcgatccgtcgatccccgtgatcttcctcgacaccggctggctgttcgaggagacgctcgcctatcgcgacatgctgatcgcgacgctggggctcaaggacgtccgctcgatcaggccggcggaggagacgctgtcgcgcgaggatcccgaccgcgacctctggttctccgatcccgacgcctgctgccgcatccgcaaggtggagccgctggcgcgcgcgctgaagccgttcgacgcctggatcaacggccgcaagcgcttccagggcaatgcgcgcgccgacattccggtggtcgaggacgacggcgcgcggttgaagttcaaccccttcgccaacgtttcgcgcgaggaactcgaggcgattttcgtccgcgccaaattgccgcgtcatccactggccgcctccggtttcctgtcggttgggtgtatgccttgcaccagcagaacggccgaaggcgaggatgcacgcgccggtcgctggcgcggccgggccaagacagaatgcggcatccacacgatgaagacttcgtag

SEQ ID NO: 5797 - protein, 243 aa, Bradyrhizobium japonicum USDA 110
MNAIAPQVSPVSVSALPSAAELDRALRDASPAEVIAAALKAVGRDKLALVSSFGTESATLLKVMADVDPSIPVIFLDTGWLFEETLAYRDMLIATLGLKDVRSIRPAEETLSREDPDRDLWFSDPDACCRIRKVEPLARALKPFDAWINGRKRFQGNARADIPVVEDDGARLKFNPFANVSREELEAIFVRAKLPRHPLAASGFLSVGCMPCTSRTAEGEDARAGRWRGRAKTECGIHTMKTS

SEQ ID NO: 5798 - DNA, 738 bp, Streptomyces avermitilis MA-4680
  CDS (1)..(738): transl_table=11
atgaggacggttcaggccgacacggacaccggcacagagcgtgcgaccggccgcgacgcggagctgaagacgctcgccgagcaggccgggcgcgacctggaggacgcctccgccctggagatcctccagtgggcggcggacaccttcggcaagaagttctgcgtgacctcctccatggaggacgccgtggtcgcccacctcgcctcccggaccttccccggtgtggacgtggtcttcctcgacaccggctaccacttcccggagaccatcggcacccgcgacgcggtcgaggccgtgatggacgtcaacgtcatcacgctcaccccgcgccggacggtcgccgagcaggacgcggagtacggcccgaagctgcacgaccgcgaccccgacctgtgctgcaagctccgcaaggtccagccgctggagcagggcctgaccgcgtacgacgcctgggcgacgggcctgcgccgcgacgagtccccgacccgggcgaacaccccggtcgtcagctgggacgagaagcgccgcaaggtgaagatctcgccgatcgcccgctggacccaggacgacgtggacgcgtacgtcgcggagcacggcgtgctgaccaacccgctgctgatggacggctacccctccgtgggctgcgcgccctgcacccgccgtgtgctggagggcgaggacgcgcgcgccggccgctgggcgggcagcaccaagaccgagtgcgggctgcacggatga

SEQ ID NO: 5799 - protein, 245 aa, Streptomyces avermitilis MA-4680
MRTVQADTDTGTERATGRDAELKTLAEQAGRDLEDASALEILQWAADTFGKKFCVTSSMEDAVVAHLASRTFPGVDVVFLDTGYHFPETIGTRDAVEAVMDVNVITLTPRRTVAEQDAEYGPKLHDRDPDLCCKLRKVQPLEQGLTAYDAWATGLRRDESPTRANTPVVSWDEKRRKVKISPIARWTQDDVDAYVAEHGVLTNPLLMDGYPSVGCAPCTRRVLEGEDARAGRWAGSTKTECGLHG

SEQ ID NO: 5800 - DNA, 918 bp, Rhodopirellula baltica SH 1
  CDS (1)..(918): transl_table=11
atgcccattcgcctgaacgagacagccgtggtgaaccccacttatgtcccctctgaatccgaatccacacctgtctcggctgagccagcatccagaccgtcgttgcgtgttctcacgccggctgagatcgctcacaacgcggctgctgcgggccctgacgtcgatgcgcaggggattccaaccaaacgtggtgccctggcggcggatcctcccctggctcccacagacgaatttctggccgaactgaagcgagacagcgattcattggaatccgcgactccacaagaagtgctgaaatgggcggtggatcgatttgccccgaaattcaccatggcgaccgccttcggccccgaaggcatgacgatcattcacatgctcgccgaaattgctcccgaaacgccaattttcaacttagaaaccggctaccaatttcgagaaactctcgatcttcgcgagaaggtcaaggaacgctacgggatcgaagtccagtacaaatacccgtcgacgacggtcgaggaattcgaaacgctccatggcggaccgctctacaagaccgaccccaatcgctgctgcttcgaacgcaaactacgcgtgctacatcgtgcggccagtggttggcatgcatgggccagcgctatccgtcgcgaccagagcgaagatcgtgcgaaggctccgatcgttggctgggacaagaaattccagctggtaaagatcagtcctctggcaaactggaccaaaaaagatgtttggtcgctgatctcgaaagagagcatcccatacaacccattgcacgaccaaggctatccgagcatcggatgccaagcttgcacgcgtcctgtccaacttggcgaagacgaacgagcaggtcgttggagtggattccaaaagaccgaatgcggattgcacacctcggaatga

SEQ ID NO: 5801 - protein, 305 aa, Rhodopirellula baltica SH 1
MPIRLNETAVVNPTYVPSESESTPVSAEPASRPSLRVLTPAEIAHNAAAAGPDVDAQGIPTKRGALAADPPLAPTDEFLAELKRDSDSLESATPQEVLKWAVDRFAPKFTMATAFGPEGMTIIHMLAEIAPETPIFNLETGYQFRETLDLREKVKERYGIEVQYKYPSTTVEEFETLHGGPLYKTDPNRCCFERKLRVLHRAASGWHAWASAIRRDQSEDRAKAPIVGWDKKFQLVKISPLANWTKKDVWSLISKESIPYNPLHDQGYPSIGCQACTRPVQLGEDERAGRWSGFQKTECGLHTSE

SEQ ID NO: 5802 - DNA, 723 bp, Prochlorococcus marinus subsp. pastoris str. CCMP1986
  CDS (1)..(723): transl_table=11
atgattaagaaaacgctagaaagtattcaacttaatttagaagggcataataaaaaattaaaagatatgacccccaaagaaataatattatggggttataaaaactttggtaatcaattcgctattacaacaagctttggtatacaatcatcagttattttacatatggtgcatcagcactcactacaaaaaaaaattaagattttctggatagatacaggttacttaccctcagagacttataaatatgcagagagactaattaatgatttatctttagaaattgaggttttacaaagtgaactatctccagcaagaatggaatccctttatggaaaactttgggaaactaataaatctagtgatttagataaataccatgacataagaaaaatcaaacctttagaaaatgctttagataaacacgacatattctgctgggctagcggtgttagatcggagcaaacgaaaaataggaataaaatgaattttgttgacgtaattcgcaaacgactttctttaaggcccttactcaactggaaaaacaaagatattttttattacatgaaagaaaatcaattaccgtcacacccacttttctcaaaaggttattcaactgttggagattggcattccagttctcctgaaagtgttgataaagaaggcaggacaacaagatttggcggaatgaagcaagaatgtggaattcatactgaaaattaa

SEQ ID NO: 5803 - protein, 240 aa, Prochlorococcus marinus subsp. pastoris str. CCMP1986
MIKKTLESIQLNLEGHNKKLKDMTPKEIILWGYKNFGNQFAITTSFGIQSSVILHMVHQHSLQKKIKIFWIDTGYLPSETYKYAERLINDLSLEIEVLQSELSPARMESLYGKLWETNKSSDLDKYHDIRKIKPLENALDKHDIFCWASGVRSEQTKNRNKMNFVDVIRKRLSLRPLLNWKNKDIFYYMKENQLPSHPLFSKGYSTVGDWHSSSPESVDKEGRTTRFGGMKQECGIHTEN

SEQ ID NO: 5804 - DNA, 765 bp, Synechococcus sp. WH 8102
  CDS (1)..(765): transl_table=11
atggatggggtccgcggcatgacgggcgtgttggttcgggacaatctcgatgcggaccgcggcagcctggagccgttgagtcctcaagatcgactggcttgggcacaccagcgcttcggatccggatttgctctcaccaccagcttcggcatccaatcggcggtgctgctgcacatgctcagtcaactgccggagggtgacgccgttcctgtgatctgggtggacactggctatctgccggaggagacctaccgctatggcgcccagctcacgaagctgctcagcatccgcctggtggtggctcaaagcgccatgtcgccggctcggatggaggctctgcatggccgcctctgggacaccggacagctcgatgatcttgagaaataccaccagatccgcaaggtggagcccctggatcgggctttggcgcaactggaggtgagctgctgggccagtggcgtgcgtcgcggccagactgaccaccgccgcgcgatgaccgtgctggacccgatccgagagcggctgtctctgcgtccgctgttggattggacccagaaggacatctactactacatgcaggacaacaacctgccgcaacacccgttgttcgagcagggatactcaaccgtgggggattggcactccagtgctccggatggcgctgagctcagcggacgtaacacccgtttcgggggcctgaaacaggaatgtgggatccacgttccccaggaggccgtggaaggcttgatgggggatgggatctag

SEQ ID NO: 5805 - protein, 254 aa, Synechococcus sp. WH 8102
MDGVRGMTGVLVRDNLDADRGSLEPLSPQDRLAWAHQRFGSGFALTTSFGIQSAVLLHMLSQLPEGDAVPVIWVDTGYLPEETYRYGAQLTKLLSIRLVVAQSAMSPARMEALHGRLWDTGQLDDLEKYHQIRKVEPLDRALAQLEVSCWASGVRRGQTDHRRAMTVLDPIRERLSLRPLLDWTQKDIYYYMQDNNLPQHPLFEQGYSTVGDWHSSAPDGAELSGRNTRFGGLKQECGIHVPQEAVEGLMGDGI

SEQ ID NO: 5806 - DNA, 705 bp, Chromobacterium violaceum ATCC 12472
  CDS (1)..(705): transl_table=11
atgagcctggagtccaaactcgccgccaccacggccctgctgcaaaccatcgccgccgaacatcccgacgcggtgctggccaacagctacggcgccgaagacatggtgctgaccgacctgatcgcccgtctcggcctgccgctggaaagcttcagcctggacaccggccgcctgccggccgaaacctatgagttgatgcagcaagtcgccgagcgttatccaggccatccggtcaggatgtacttccccgacaccgccgccaccgagcagtacgtcaacttccacggcatcaacggcttctatcggagcgtcgagttgcgcaagtcctgttgcgcggttcgcaagctggagccgctgaagcgcgcgctggccggccgatcggcctggatcaccggcctgcgccgccagcagtcgccgacgcgccaggacctggccgacagggagtacgacgccgacaacgggctcgtgaaattcagcccgctgctggaatggacggaagccgaagtgtggcagtacctgaaggaaaaccaggtgccgtacaacgcgctgcacgatcggcactatccgtcgataggctgcgcgccctgtacccgcgccatcagcgtgggcgaagacgtgcgcgccggccgctggtggtgggaaaacccggaaaccaaggagtgcgggctgcacgcgaagtccagtccgctgcagcgccccgtctga

SEQ ID NO: 5807 - protein, 234 aa, Chromobacterium violaceum ATCC 12472
MSLESKLAATTALLQTIAAEHPDAVLANSYGAEDMVLTDLIARLGLPLESFSLDTGRLPAETYELMQQVAERYPGHPVRMYFPDTAATEQYVNFHGINGFYRSVELRKSCCAVRKLEPLKRALAGRSAWITGLRRQQSPTRQDLADREYDADNGLVKFSPLLEWTEAEVWQYLKENQVPYNALHDRHYPSIGCAPCTRAISVGEDVRAGRWWWENPETKECGLHAKSSPLQRPV

SEQ ID NO: 5808 - DNA, 726 bp, Gloeobacter violaceus PCC 7421
  CDS (1)..(726): transl_table=11
gtgaatttactgcaggaccaaccggcgatgggcatcgaccagacgactctggagcatctggcccggcagtgggaggatctggctcctgaggccatcctggcggaagcggtgcgctgttttggcgacaagttggtgctggcgagcgccttcggtcccgagtcgatcattttgctcgacatgctggtgaaggtgtggccccggccgcaggcattcttcctcgagacgggctttcattttcccgagacgctggcgctcaaagaccgggtgctcgcgcgctttccgcagttgcagcttgaggtggtggggccgctgatgtccgtcgctcagcaaaatgccatctacggcgagcgcctgcacgatcgcaacccggatcattgctgcgccattcgcaaagtcgagccgctcaaccgcgccctcgccccttacaaagcctggattgccggcatgcgccgcgaacagtcgccgacccgcggccagattggcgtcgtgcagtgggattcgcgccgcggcatggtcaagttcaatccgctggccacctggacgcacaagcaagtctgggcctacattgtcgagcgcgatttgccctataaccccctgcacgacgaggggtttccgtcgatcggctgctcgcctcttaactgcaccgccccggtggccgacggggcggacccgcgctcggggcgctggcggggcaaggccaagaccgagtgcggcctgcatgcgtga

SEQ ID NO: 5809 - protein, 241 aa, Gloeobacter violaceus PCC 7421
MNLLQDQPAMGIDQTTLEHLARQWEDLAPEAILAEAVRCFGDKLVLASAFGPESIILLDMLVKVWPRPQAFFLETGFHFPETLALKDRVLARFPQLQLEVVGPLMSVAQQNAIYGERLHDRNPDHCCAIRKVEPLNRALAPYKAWIAGMRREQSPTRGQIGVVQWDSRRGMVKFNPLATWTHKQVWAYIVERDLPYNPLHDEGFPSIGCSPLNCTAPVADGADPRSGRWRGKAKTECGLHA

SEQ ID NO: 5810 - DNA, 840 bp, Vibrio vulnificus YJ016
  CDS (1)..(840): transl_table=11
ttggcgatttcactgttcgtgttggcattattgaagaagttatcatttctaaaagggatttctatgcttgattctgttgcttcaacgctgcagctatcagaattactctcgttaaccaaggcggagcaaagtatccgccttgccgaaatcaacgttgagttagagatgctgtcagctcaagagagggtcgcttgggctctgcaaaatttggaaggggcacacgctgtttcgtcgagttttgggattcaagcggctgtcatgctgcatttgttatcgaagcagcaagccgatattcccgtcattttgaccgatacgggctacctatttcctgaaacgtatcaatttattgatgagttaactaaatctctaaacctaaacctcaaagtataccgagcgaatgagagtgcaaactggcaggaagctcgatacggtaaactgtgggagcaaggtatagaaggaatagaaaaatacaacaagcttaataaagtcgaacctatgcgtcgtgcactgaatgagcttaatgttaaaacctggttttccggattacgccgagagcaatctcaatcccgagcaggcctacctattctgtcgatacaaaatggagtgtttaaattcttgcctgtagttgattggagtaacaaagacgtacactactatttaaaagaacacggtctttcatatcatcccctttgggagcagggctatctttctgtaggagatacgcatacaactcaaaaatgggagccagggatgagtgaagaagaaactcgtttctttggcttgaagcgtgagtgtggacttcacgaagaagataatgaacaagatggttctggtatttaa

SEQ ID NO: 5811 - protein, 279 aa, Vibrio vulnificus YJ016
MAISLFVLALLKKLSFLKGISMLDSVASTLQLSELLSLTKAEQSIRLAEINVELEMLSAQERVAWALQNLEGAHAVSSSFGIQAAVMLHLLSKQQADIPVILTDTGYLFPETYQFIDELTKSLNLNLKVYRANESANWQEARYGKLWEQGIEGIEKYNKLNKVEPMRRALNELNVKTWFSGLRREQSQSRAGLPILSIQNGVFKFLPVVDWSNKDVHYYLKEHGLSYHPLWEQGYLSVGDTHTTQKWEPGMSEEETRFFGLKRECGLHEEDNEQDGSGI

SEQ ID NO: 5812 - DNA, 744 bp, Mycobacterium avium subsp. paratuberculosis K-10
  CDS (1)..(744): transl_table=11
atgaccgaacgaacgaccaaacttccagaggccgaactgcgtgaactagccgcccgcggcgccgccgagctcgaaggcgccagcgccagcgacgtgttgcgttggaccgacgagacattcggcggcgtcaacgggccacgcggatgggccacctgcaactacgtggtggcctcgagcatgcaggaagcggtgttgatcgacctggccgccaaggtccgccccggtgtgccggtggtcttcctggacaccggctaccacttcgccgagaccatcgggacccgggatgcgatcgaatccgtctacgacatccgggtgctcaacgtcactcccgagcacagcgtcgccgagcaggacaaactgctgggcaaggacctgttcgcgcgcgaccccggcgaatgctgccggctgcgcaaggtcgccccgctgggcaagacgctgcgcggatactcggcctgggtgaccggcctgcgccgctcggaggccgcgacacgggccaacgcgccggtgatcggcttcgacgagggcttcaagctggtcaaggtcaaccccatggccacctggaccgacgaggacgtgcagaactacatcgacgagcacaacgtgctggtcaatccgcttatctacgaaggctattcgtcgatcggctgcgccccctgcacggccaagccgctggccggcgccgacccgcgcagcgggcgctggcagggcctggccaagacggaatgcgggctgcacgcctcgtaa

SEQ ID NO: 5813 - protein, 247 aa, Mycobacterium avium subsp. paratuberculosis K-10
MTERTTKLPEAELRELAARGAAELEGASASDVLRWTDETFGGVNGPRGWATCNYVVASSMQEAVLIDLAAKVRPGVPVVFLDTGYHFAETIGTRDAIESVYDIRVLNVTPEHSVAEQDKLLGKDLFARDPGECCRLRKVAPLGKTLRGYSAWVTGLRRSEAATRANAPVIGFDEGFKLVKVNPMATWTDEDVQNYIDEHNVLVNPLIYEGYSSIGCAPCTAKPLAGADPRSGRWQGLAKTECGLHAS

SEQ ID NO: 5814 - DNA, 1029 bp, Magnaporthe grisea 70-15
  CDS (1)..(1029)
atgaagcccctccacgtcaagttcgaggacgccgcagagatggactcgggctactgctcggccagctcgtcgacggcatctctccctcaggtttccttcacaccctctcacctgcgccatatcaacgaccagctcgagaagatgcaagccatggacatcctccgcttctgccgcgtcctcttcccaaacctataccagacgacggcctttggcctgacggggctcgtgacgcttgacatgctatccaagatggagaaggagtcttccttcctgccttcggtcgaactcatattcctcgacaccctgtaccactttgacgagacgtaccagctcgtcgagagggtcaaggagcggtacagcaacgtcaagatgcacgtgtacaagccggcagactgcgggacggtggccgacttcgagacgaagtacggcgagaagctgtatgagactagcgccgagttctacgactgggtggccaaggtcgagccccagcagcgcgcctactcggacctcaacgtcggtgccgtcctcaccggccgccgcaggtctcagggcggccagcgcaacaagatccccatcgtcgaggtcgacaacgagacaggcatcgtcaagatcaaccccctcgtcaactggtcgttccaggacgtgcaaaagtacatcaaggagaacgacgtcccgtacaacgtcctgctcgacagggggtacaagtcggtcggcgactggcactcgaccagccccgtggctgagggagaggacgagagggccggaaggtggaagggtcagaacaagaccgagtgcggaatccataacaagaagtcgcgttacgcccagtttcttgaggaggccgacaggaaggctgcggaggctgccaaggctgccaaggctgctacggcggcggccatgcaagactcgccggtcggcagcgagattgcagatgatgctcgctggcacgctgcgaggaggccaggtgctcgccggcgccaacatcatcaccaggaccatgtcccttctgccgtcacctcatccgcttga

SEQ ID NO: 5815 - protein, 342 aa, Magnaporthe grisea 70-15
MKPLHVKFEDAAEMDSGYCSASSSTASLPQVSFTPSHLRHINDQLEKMQAMDILRFCRVLFPNLYQTTAFGLTGLVTLDMLSKMEKESSFLPSVELIFLDTLYHFDETYQLVERVKERYSNVKMHVYKPADCGTVADFETKYGEKLYETSAEFYDWVAKVEPQQRAYSDLNVGAVLTGRRRSQGGQRNKIPIVEVDNETGIVKINPLVNWSFQDVQKYIKENDVPYNVLLDRGYKSVGDWHSTSPVAEGEDERAGRWKGQNKTECGIHNKKSRYAQFLEEADRKAAEAAKAAKAATAAAMQDSPVGSEIADDARWHAARRPGARRRQHHHQDHVPSAVTSSA

SEQ ID NO: 5816 - DNA, 951 bp, Gibberella zeae PH-1
  CDS (1)..(951)
atgcctaccttcatctctgaatcatcctcgcaggtgtccctccccgacatgaagcttgaatgcgagtcaggctatgtctctggacaaaactcagaatactcttcaccatcatcatcaaccactcttcctcgagtcactctcacaaagccccatattgaccacctcaacaacatgcttgaggacatgcaccccatggacattctccgattctgcaaggtcatgttccctaacctgtaccaatcgactgcttttggcttgaccggtctcgccaccatggacatgctctccaagattcaaaaggagcaccccaacactcccactgtcgacctcatcttcttggataccttgtaccacttcaaggagacacacgacctcgtcgaccgagtcaaggcccggtaccccaacgttcccgttcacatttacaagcctgacggtgtcaacaacgccgaagaattcgaggacatgtacggcaaggagatgtggaacaccgctagcgaaatgtatgactggattgtcaaggttgagccccttcagcgagcgtacgatgagctcaaggttgctgccgtcctcaacggtcgccgacgatctcagggtgctgcccgcggctccatccccatcatcgagattgatgatgagcgtggtgttgtcaagatcaaccccttggccacttggtctttcaagcaggttgatgcatacatcaaggagaacaacgtcccctacaacgctctcctcgatcaaggctacaagtctgtcggcgactggcactccaccgtccccgtcaaggagggcgaagatgagcgagccggccgatggaagggccaggacaagaccgagtgtggtattcacaacaagcaatctcgctactccgagtttgttgccatgatggagcgcaagcaacaagaggaaaagctcgctgctgctcttgagaaagtggctctgcccacagtctaa

SEQ ID NO: 5817 - protein, 316 aa, Gibberella zeae PH-1
MPTFISESSSQVSLPDMKLECESGYVSGQNSEYSSPSSSTTLPRVTLTKPHIDHLNNMLEDMHPMDILRFCKVMFPNLYQSTAFGLTGLATMDMLSKIQKEHPNTPTVDLIFLDTLYHFKETHDLVDRVKARYPNVPVHIYKPDGVNNAEEFEDMYGKEMWNTASEMYDWIVKVEPLQRAYDELKVAAVLNGRRRSQGAARGSIPIIEIDDERGVVKINPLATWSFKQVDAYIKENNVPYNALLDQGYKSVGDWHSTVPVKEGEDERAGRWKGQDKTECGIHNKQSRYSEFVAMMERKQQEEKLAAALEKVALPTV

SEQ ID NO: 5818 - DNA, 780 bp, Candida glabrata CBS 138
  CDS (1)..(780)
atgaaagtatataacttgaataacgggatatcggtcactgaggagcagcttgcgcactggaaccaggcgctgtcgcagctggagccacaagaaatactgaagtggtcactggccacattcccacacttattccagaccactgcgtttgggctcactggtctggctacgatagacatgctttccaagctcggtgccgatgcgctagtgccgttgattaccattgacacattgcacttattcccacagactgtgacactgagggagaacgtcgaagataagtactacaggcctcatggcaagacgatccacgtctacaagcccatcggttgcgacaccgagcagcagtttgcggacaagtacggtgagttcctgtgggagaccgacgacgacaagtacgactacctggttaaagtggaaccggcagccagggcctacaaggacttgcaagtaaccgctgtgttcactggcaggagaaagtcgcaagggtcagccagatcggagctgcagttcgttgagatcgaggaactcacgggaatcataaagatcaacccgttggccaattggacatttgaccaggtcaagcagtacatcgacgacaacgcagtcccatacaatgagctactcgacctaggctacaagtccatcggtgactaccattcaactgtacctgtcaaggaaggtgaagacgagagaagtggcagatggaagggcaaagccaagacggagtgcgggatccacgagacgagcaggttcgccaagttcctgaaacaggatacctga

SEQ ID NO: 5819 - protein, 259 aa, Candida glabrata CBS 138
MKVYNLNNGISVTEEQLAHWNQALSQLEPQEILKWSLATFPHLFQTTAFGLTGLATIDMLSKLGADALVPLITIDTLHLFPQTVTLRENVEDKYYRPHGKTIHVYKPIGCDTEQQFADKYGEFLWETDDDKYDYLVKVEPAARAYKDLQVTAVFTGRRKSQGSARSELQFVEIEELTGIIKINPLANWTFDQVKQYIDDNAVPYNELLDLGYKSIGDYHSTVPVKEGEDERSGRWKGKAKTECGIHETSRFAKFLKQDT

SEQ ID NO: 5820 - DNA, 795 bp, Kluyveromyces lactis NRRL Y-1140
  CDS (1)..(795)
atgagtcaacaagtgtttcagctgaataacgcagtaacggtaactcaagaagaaatcgatcattggaatgaaaagttaagtgaattgtcacctgaagaaattatacgttgggctatcgttactttcccacatttatttcaaaccactgcgtttggcttaactgggttggctactatcgatatgctttctaagattaatcaaaatgaaacagaaccaatcgttccattaatatttattgatacattgcaccatttccctcagacgttagagcttttgaaagtggtagaaactcggtattacaagccaagaggacagaatgtcaatgtatatcagccgaaagattgtggttcggagcaagaatttgctgccaaatacggtgatttcttatgggatacagacgatgataaatacgatttcctagtcaaggtggaacctgctcatagagcttataaggaattgcaagtgactgctgtattcactggtagaagaaagagtcaaggtggtgcaaggtcgaatctgaaattcatcgaattggacgaattcaatcatatcatcaagatcaacccgctagcgaactgggacttcaaccaagtgcaaagttatatccgtgataataacgtaccttacaatgaattgctagatctaggataccggtcgattggtgattatcactctacacaacctgttcaagaaggtgaggatgagagatcaggcaggtggaagggtaaggcaaagacggaatgtgggattcacgagacaagcagatttgcacaatatctcaaacaaagagaatga

SEQ ID NO: 5821 - protein, 264 aa, Kluyveromyces lactis NRRL Y-1140
MSQQVFQLNNAVTVTQEEIDHWNEKLSELSPEEIIRWAIVTFPHLFQTTAFGLTGLATIDMLSKINQNETEPIVPLIFIDTLHHFPQTLELLKVVETRYYKPRGQNVNVYQPKDCGSEQEFAAKYGDFLWDTDDDKYDFLVKVEPAHRAYKELQVTAVFTGRRKSQGGARSNLKFIELDEFNHIIKINPLANWDFNQVQSYIRDNNVPYNELLDLGYRSIGDYHSTQPVQEGEDERSGRWKGKAKTECGIHETSRFAQYLKQRE

SEQ ID NO: 5822 - DNA, 783 bp, Debaryomyces hansenii CBS767
  CDS (1)..(783)
atgacaataacagggcctgtaaacttatctgctgagcatttgcaacatttgaacgaaaaacttcaggagttatcaccagaggaaatcatcaagtgggcttatattacttttccaaacttatatcaaaccactgcttttggattaacaggattagttaccatagatatgatctcaaagttaaaaccagaagaagatcatttcatagaccttatttttattgacactttgcatcactttcctcaaacttatgatttggttaacaacgtaagcaaaaagtataattctaagatccacacattcaaaccgttaaacgtcgaaactgaatctgaatttgcacaaagatacggagatcaactatgggaaaccaacgactcgtattatgatttcttaataaaggttgagccttctcaacgagcatataaagatttgcaagtggttgcagtgttgacaggtagaagaaagtcccaaggtggggcccgtggctcattgccggtgattgaaattgaagaatcgagtggtaccatcaagattaacccgttgtgtaactgggacttcaataaggtgaaaagctacatcgacgaaaataacgtgccgtataatgaattattagatttaggctacaaatcgatcggtgactggcactcgactgtccccgttgccgaaggtgaagatgaaagaagtggtagatggaagggtaaagccaagactgaatgtgggattcacgaaactagcaagtttgcccaatatttaaaatcgaatgagaatcctaccatcaattcttag

SEQ ID NO: 5823 - protein, 260 aa, Debaryomyces hansenii CBS767
MTITGPVNLSAEHLQHLNEKLQELSPEEIIKWAYITFPNLYQTTAFGLTGLVTIDMISKLKPEEDHFIDLIFIDTLHHFPQTYDLVNNVSKKYNSKIHTFKPLNVETESEFAQRYGDQLWETNDSYYDFLIKVEPSQRAYKDLQVVAVLTGRRKSQGGARGSLPVIEIEESSGTIKINPLCNWDFNKVKSYIDENNVPYNELLDLGYKSIGDWHSTVPVAEGEDERSGRWKGKAKTECGIHETSKFAQYLKSNENPTINS

SEQ ID NO: 5824 - DNA, 768 bp, Yarrowia lipolytica CLIB122
  CDS (1)..(768)
atgtctatctctgtgtcgacgtcgcaactggaccactacaacgcgctgctgagtcagctggagccgcaacagatcattcaatgggcggtgctcaccttccccaacttgttccagaccacggcgtttggactcacgggattagtcagcactgacatgatcagcaagctggagcagtcacgtggcggccacgctgtcgatcttatttttctcgacaccctgtaccatttcgacgaaacgctgcagctggtcgaccgggtccaggccaagtacccatcggcgaaaatccacagattccgacccgagggcttcgagtcgcgtgcggagtttgaaaaggtgtatggcgattcccttttcgacacaaacgacgatctctatgattatctggtcaaggtagagccttctcagcgggcctacaaggagctggatgttgttgctgttctgaccgggcgtcgcaagtcccagggagacgcacgtgactctctaaagattgtggagattgaagccgagaccaatctcatcaaaatcaaccctcttgccaactggtcgtttgcccaggtcaagaattatatcgattccaacgacgtgccttacaactccttgttggataaggggtaccgatctgtgggcgattttcactcaactgtgccggtcaaggagggcgaaaatgagcgagccggacgatggaagggtaaacagaagactgagtgtggcattcatcagcagaaacgatttgctcagttctcgggggtcaatgttcgggctatttaa

SEQ ID NO: 5825 - protein, 255 aa, Yarrowia lipolytica CLIB122
MSISVSTSQLDHYNALLSQLEPQQIIQWAVLTFPNLFQTTAFGLTGLVSTDMISKLEQSRGGHAVDLIFLDTLYHFDETLQLVDRVQAKYPSAKIHRFRPEGFESRAEFEKVYGDSLFDTNDDLYDYLVKVEPSQRAYKELDVVAVLTGRRKSQGDARDSLKIVEIEAETNLIKINPLANWSFAQVKNYIDSNDVPYNSLLDKGYRSVGDFHSTVPVKEGENERAGRWKGKQKTECGIHQQKRFAQFSGVNVRAI

SEQ ID NO: 5826 - DNA, 909 bp, Aspergillus nidulans FGSC A4
  CDS (1)..(909)
atgcattccaactacccctccgattcggagactgcggaactaagagactctactgagtcgggctatgtcagtggtggctcaagtgaagagtatctaccagagattgtcttcaccaaacctcatcttcagttcctcaaccgacaacttcaattccttgaaccccaagatgtcctcagatggtgtgtcacttcgctacctcacctgtatcagaccaccgcctttggtcttactggtcttgtgatcatggatatgctttccaaactgtccatccctcgccctcaaatggtcaacctcatcttcctcgacactctgcaccacttccccgagacattgaaacttgtcgacaatgtccgcaagaggtacccgctacagcacatccatgtctacaagccccagggtgttgagaccgaagaggagtttgctaagaagcacggtgaacgcctgtgggaaaaggatgaccagctgtacgactggattgccaaggtcgagcctgctcaacgtgcctaccgtgagctcaacgttcacgcagtcctcaccggacgccgccgcagccaaggaggcaagcgtggagacctggacattattgaggtggacgaagccggcctcattaagatcaaccctctcgccaactggacctttgaccaggtcaagcagtatgtcaaggagaatgatatcccctacaacgagttactcgacaagggctacaagagcgttggtgactatcactctacatcccccgtcaaggagaacgaagacgaacgatcaggccgctggaagggccaggcgaaaaccgagtgtggtatccacaaccctcggtcaaagtacgcccagtacttgatggatatggaacgcaagcgacaggaggaagctttgtctcaagcgttgcagaacaagcttaccaccgcttaa

SEQ ID NO: 5827 - protein, 302 aa, Aspergillus nidulans FGSC A4
MHSNYPSDSETAELRDSTESGYVSGGSSEEYLPEIVFTKPHLQFLNRQLQFLEPQDVLRWCVTSLPHLYQTTAFGLTGLVIMDMLSKLSIPRPQMVNLIFLDTLHHFPETLKLVDNVRKRYPLQHIHVYKPQGVETEEEFAKKHGERLWEKDDQLYDWIAKVEPAQRAYRELNVHAVLTGRRRSQGGKRGDLDIIEVDEAGLIKINPLANWTFDQVKQYVKENDIPYNELLDKGYKSVGDYHSTSPVKENEDERSGRWKGQAKTECGIHNPRSKYAQYLMDMERKRQEEALSQALQNKLTTA

SEQ ID NO: 5828 - DNA, 759 bp, Candida albicans SC5314
  CDS (1)..(759): transl_table=12
atgggaaacatagttcaattaacaccagagcatatttcgtttcttaacgagcacttgaaaactctttcggcatacaatattatcaaatgggcatactttactttccccaatttgtatcagacaacagcttttggattaacagggttggtgactgtcgacatcatatctaaattatcccaggaattggaaaaggatcacttgattgatttgatctttcttgacacattgtaccatttcccacaaactcatgaattggttcaaaaggtcgaacaaaaatatcgcccaaaattacatgtctacaaaccaaaggatgtgagcacggaacaagaatttgctgcaaaatatggtgaccagttgtgggaatcaaatgacgcatattacgatttcttggtaaaggtggaaccgagccaacgtgcttacaaagagttgggagtttcggctgtgctaactggaagaagaaagtctcaaggtggtgcccgtagtgaattgacagttttagaatacgaggaaacaagtggaattatcaagattaacccattatggaattgggatttcaaacaggtaaaggcgtatattgatgataataaggttccatacaatgaactattagatttaggttacaagtctattggtgattggcattctactgtacctgtagctgacggtgaagatgaaagaagtggacgatggaaaggtaaggcaaagactgaatgtggaatccatgtaactacaaagtacacggaatatatgaaggaatag

SEQ ID NO: 5829 - protein, 252 aa, Candida albicans SC5314
MGNIVQLTPEHISFLNEHLKTLSAYNIIKWAYFTFPNLYQTTAFGLTGLVTVDIISKLSQELEKDHLIDLIFLDTLYHFPQTHELVQKVEQKYRPKLHVYKPKDVSTEQEFAAKYGDQLWESNDAYYDFLVKVEPSQRAYKELGVSAVLTGRRKSQGGARSELTVLEYEETSGIIKINPLWNWDFKQVKAYIDDNKVPYNELLDLGYKSIGDWHSTVPVADGEDERSGRWKGKAKTECGIHVTTKYTEYMKE

SEQ ID NO: 5830 - DNA, 918 bp, Ustilago maydis 521
  CDS (1)..(918)
atgactgcccccaaccagatcgcccagtcttcaaaacaggccgaagaggaggctcagatccgccacgtcatccgaaatctcgaagccatcaaccgtaagctcggtgaagctgacccaaccgaaatcatcgaatgggccatcgacaaccttcccagtctctaccagaccaccgctttcggtatcaccggctgcatcaccgtcgacatgatttcgcgcatcagcgagcagcgtgccgccaaggctggccttcccgccaaacacctcgtcccactcatctttgtcgacacgctctatcactttccccagacgctcgacctggcccacaaggcagccaagcactacaacgctcctatgcacatctactacccaccgggcaccaacacggtgcgcgagtttgaggaaaagtggggcccacaattgtgggagaaggacgaggatacgtacgactacttggtcaaggtggaacctgcacgacgatcatacgaagagcttggcgttcgcgccgtattcaccggtcgacgtcgatcgcaaggtgccgatcgcgcctcgttgaaagcggtcgaagtggacgagaccgggttggtcaaggtgaatgcgctgatgaactggtcctttggtcaggttgatgcgtacgccaaagccaatgctgttccgtacaacgagcttctcgatttgggttacaagtcgatcggcgactggcactcgactgcacttcccggtaccggagatgcgggcgagcgtgccggcaggtggaaggacaaggctggcaagaccgagtgcggtttgcacaaggactacttcaagatgaagaacctcgccgagaagaagctgcgtgaagcagagctggcgcgcaaggatgaggcaaaagacaaggatgcttctcaagcgctctcgtctccaccagcagcgaccgcatag

SEQ ID NO: 5831 - protein, 305 aa, Ustilago maydis 521
MTAPNQIAQSSKQAEEEAQIRHVIRNLEAINRKLGEADPTEIIEWAIDNLPSLYQTTAFGITGCITVDMISRISEQRAAKAGLPAKHLVPLIFVDTLYHFPQTLDLAHKAAKHYNAPMHIYYPPGTNTVREFEEKWGPQLWEKDEDTYDYLVKVEPARRSYEELGVRAVFTGRRRSQGADRASLKAVEVDETGLVKVNALMNWSFGQVDAYAKANAVPYNELLDLGYKSIGDWHSTALPGTGDAGERAGRWKDKAGKTECGLHKDYFKMKNLAEKKLREAELARKDEAKDKDASQALSSPPAATA

SEQ ID NO: 5832 - DNA, 819 bp, Cryptococcus neoformans var. neoformans B-3501A
  CDS (1)..(819)
atgtccagtgaagacatcctcactccccagtacacccctgaagaaatcgagcgatttaacgccgaactcgacggcaagactcctcaggagatcttgacctgggctgtcgacaacgtcgatggcttgtaccagactactgctttcgggctgactggtaccgccgctgtagatatgatttccaagatttctttggaccgcgaagaaactcaccttgttccccttatcttccttgacacccttcaccacttccctgaaactcttgctctcgctcaaaccatggccgacacctacctcgctccgttacacatttacactccccccggcgtttctactgctgaagaattcgccgtcaagtatggcgagaagctctgggagactgatgaaggcgcctacgattatctggtgaaggttgaacctgcagccagggcttacaaggagctgggcgtccgggcggtcatcactggtaggcgaagaagccaaggcgccgatcgagcagacttgaaggtgctcgaagtcgatgagaggggattgctcaagatcaaccctttgatcggatggagctttaaagaggtcaaggaatacattgacaaggaaggagttccttacaacccacttctcgacaagggctaccgatctatcggtgacgtccactccaccgccccccctgaccccaacgccgccagtgatgctgctgaacgaagtggtcgatggcaaggtaaggccaagaccgaatgtggtttacacagcaactattttgagatgaagaagaagtttgaagagaaagcggccgctgcgggcgaagcttccaagcagtcataa

SEQ ID NO: 5833 - protein, 272 aa, Cryptococcus neoformans var. neoformans B-3501A
MSSEDILTPQYTPEEIERFNAELDGKTPQEILTWAVDNVDGLYQTTAFGLTGTAAVDMISKISLDREETHLVPLIFLDTLHHFPETLALAQTMADTYLAPLHIYTPPGVSTAEEFAVKYGEKLWETDEGAYDYLVKVEPAARAYKELGVRAVITGRRRSQGADRADLKVLEVDERGLLKINPLIGWSFKEVKEYIDKEGVPYNPLLDKGYRSIGDVHSTAPPDPNAASDAAERSGRWQGKAKTECGLHSNYFEMKKKFEEKAAAAGEASKQS

SEQ ID NO: 5834 - DNA, 723 bp, Prochlorococcus marinus str. AS9601
  CDS (1)..(723): transl_table=11
atgattgaaaaaattcacaaagatattcaaactaacttgaggaaatataatcaagatcttgtagatatgaagcctcaagcaatgcttacatggggttataaaaaatttgataaacaatttgctattacaacaagttttggtatacagtcatcagtccttttagatatggtcagcaaattatccctacaaaaaaaaatcaaaatattttggatagatacaggttaccttcctccagaaacataccattacgctgaaaagcttattgataatttatccttagaagttgaagttctgcaaagtgaattatctccagcaagaatggaagccaaatatggaaaactttgggaaacaaaaaaagagagtgatttagataagtatcatgaattgagaaagataaaacctttagaaaatggtctagaaaaatatgatatttcctgctgggcaaacggcgttagatcaagtcaaacagaaaatagaaacaaaatgaaattcatagacgtaattcgtcaaaggctctctttaagacctttattaaattggacaaataaagatattttttattatatggaagagaataatttgcctgcccatccactttttatcaaaggttattcttctgtaggagattggcattcaagcagtcccgatggtcttgaaacaaagggcagagatacaagatttggaggaattaaacaagaatgtgggattcacactaataattaa

SEQ ID NO: 5835 - protein, 240 aa, Prochlorococcus marinus str. AS9601
MIEKIHKDIQTNLRKYNQDLVDMKPQAMLTWGYKKFDKQFAITTSFGIQSSVLLDMVSKLSLQKKIKIFWIDTGYLPPETYHYAEKLIDNLSLEVEVLQSELSPARMEAKYGKLWETKKESDLDKYHELRKIKPLENGLEKYDISCWANGVRSSQTENRNKMKFIDVIRQRLSLRPLLNWTNKDIFYYMEENNLPAHPLFIKGYSSVGDWHSSSPDGLETKGRDTRFGGIKQECGIHTNN

SEQ ID NO: 5836 - DNA, 726 bp, Prochlorococcus marinus str. MIT 9515
  CDS (1)..(726): transl_table=11
atgatgattgagaaaactctagaaagtataaaacttaatttagaagagcaaaataaaaaattaaaagatatgacctcaaaagaaataatgttatggggttatagaaactttgataatcactttgctattactacaagctttgggatacagtcatcagtgatattgcatatggtgaatgaatgctcattacaaaagaaaattaaaatcttttggatagatacaggttacttaccctcagagacatataaatatgcagagagacttattaatgatttatctttagagattgaggttttacaaagtgaaatatcgccggcaagaatggaatcgctatatggcaaactttgggaaactaataaatctagtgacttagataaataccatgacataagaaaagtcaaacctttagaaaaggctttagatagtcataacattaattgctgggctagtggtgtgagatcagaacaaacgaataatagaaataaaatgaaatttgttgatgtaatacgaaaccgactttctttaaggccattactgaactggaaaaacaaagatatttattattacatgaaagaaaatcaattaccttctcacccacttttttcaaaaggttattcaactgtaggtgattggcattctagctctcctgatagtatagagaatgaaggcaggtcaacaagatttagggggatgaagcaagagtgtggaattcatactgaaaattaa

SEQ ID NO: 5837 - protein, 241 aa, Prochlorococcus marinus str. MIT 9515
MMIEKTLESIKLNLEEQNKKLKDMTSKEIMLWGYRNFDNHFAITTSFGIQSSVILHMVNECSLQKKIKIFWIDTGYLPSETYKYAERLINDLSLEIEVLQSEISPARMESLYGKLWETNKSSDLDKYHDIRKVKPLEKALDSHNINCWASGVRSEQTNNRNKMKFVDVIRNRLSLRPLLNWKNKDIYYYMKENQLPSHPLFSKGYSTVGDWHSSSPDSIENEGRSTRFRGMKQECGIHTEN

SEQ ID NO: 5838 - DNA, 720 bp, Clostridium thermocellum ATCC 27405
  CDS (1)..(720): transl_table=11
atggtgcagttggatttggagaaattaaacaaagaatattctgataaaagtcctgaagatattgtgaggtttgttgttgaaaacataggtattgagaaagttgcattggcttcaagtctttcaattgaagatcaagtgctgacggatatattgcttaaaatcaatccaaaagtaagggtgtttttccttgatactggaagacattttcagcaaacctatgaccttatggaagaaaccatgcacagatacggtttccactacgaagtttatgctccggaaagcaaagaactggagcaggccgtttcgaagtacggtcccaatttcttttacgaaagcgttgaacttaggaaaaagtgctgtgaaataagaaaggtaaatccgctaaaaagggtcctgagcactgtggatgcctggatttgcggcttaaggagagaacaatcgttgacgcgccaggaattgaatatttttgaatgggacggccttcattcaatttataaaataaatcccattgttttctggtctgaagatagggtgtgggaatacattaaaaaatataatattccgtacaattccctgtacagcaagggttttcggagcattggatgccaaccatgcaccagggcggtaagacccggcgaggatgttcgcagcggcagatggtggtgggaagaccctgacaaaaaagagtgcgggctgcacgcaagagtgggacaggtgtaa

SEQ ID NO: 5839 - protein, 239 aa, Clostridium thermocellum ATCC 27405
MVQLDLEKLNKEYSDKSPEDIVRFVVENIGIEKVALASSLSIEDQVLTDILLKINPKVRVFFLDTGRHFQQTYDLMEETMHRYGFHYEVYAPESKELEQAVSKYGPNFFYESVELRKKCCEIRKVNPLKRVLSTVDAWICGLRREQSLTRQELNIFEWDGLHSIYKINPIVFWSEDRVWEYIKKYNIPYNSLYSKGFRSIGCQPCTRAVRPGEDVRSGRWWWEDPDKKECGLHARVGQV

SEQ ID NO: 5840 - DNA, 723 bp, Prochlorococcus marinus str. MIT 9301
  CDS (1)..(723): transl_table=11
atgattgaaaaaatccacaaaaatattcaaactaacttgatgaaatataatcaagagcttgtaaatatgaagcctcaagaaattcttacatggggttatgaaaagtttgatgatcaatttgctattacaacaagttttggtatacagtcatcagtccttttacatatggtcagcaaattatctctacaaaaaaaaatcaaaatattttggatagatacaggttacctacctacagaaacataccattacgctgaaaatcttattgatcgtttatccttaaaagttgaagttctgcaaagtgaattatctccagcaagaatggaggccaaatacggaaaactttgggaaacaaataaagtgagtgatttagacaagtatcatgaattaagaaagataaaacctctagaaaatggtctagaaaaatatagtatttattgctgggcaagcggagttagagcaggccaaacagaaactagaaacaaaatgaaattcatagacgtaattcgtcaaagactctctttaagacctttattaaattggacaaataaagatattttttattatatggaagagaataatttacctgcccatccactttttatcaaaggttattcttctgtaggagattggcattcaagcagtcccgatggtatggaaacaaagggcagagatacaagatttggagggattaaacaagaatgtggaatacacactaataattaa

SEQ ID NO: 5841 - protein, 240 aa, Prochlorococcus marinus str. MIT 9301
MIEKIHKNIQTNLMKYNQELVNMKPQEILTWGYEKFDDQFAITTSFGIQSSVLLHMVSKLSLQKKIKIFWIDTGYLPTETYHYAENLIDRLSLKVEVLQSELSPARMEAKYGKLWETNKVSDLDKYHELRKIKPLENGLEKYSIYCWASGVRAGQTETRNKMKFIDVIRQRLSLRPLLNWTNKDIFYYMEENNLPAHPLFIKGYSSVGDWHSSSPDGMETKGRDTRFGGIKQECGIHTNN

SEQ ID NO: 5842 - DNA, 729 bp, Herminiimonas arsenicoxydans
  CDS (1)..(729): transl_table=11
atgaacgaaactgatttcgccacgctggttgcgaccacgcaaaaaacgctgcagcacgtggcggatcagtttgcgcccgccgttttcgcttccagcctggcagcagaagaccaggtgctgaccgacatgatactgcgcagcaaactgccgatcacgattttcacgctggaaaccggccgcctgcatgcagaaacactgggcgtgctcgatcgcatcaaggaaacctacggtgtcgagatcgccttgtatcgtccgcagccggaagcggttgacgcctacgtcaggcaaaacggcttgaatgccttttatgaaagcgtggacatgcgcaaggagtgctgccgcatccgcaaggtcgaacccttgaatcgcgccttgcaaggcaatcgttcatggattaccggccagcgccgcgcgcaatcaagtacgcgcgccgaactccatgtgcaggaacaggatgacgcgcacgacatggtgaagttcaatccgctggcggactggtcggaagcagatgtctggcattacatccgcagcaacaacgtgccgtacaacccgctgcacgacaaaggctacccatccataggctgcgaaccctgcacccgcgccatacagcccggcgaagatgtacgcgcaggtcgctggtggtgggaaaacccggaatccaaggaatgcggtttgcacgtcgttgacggcaagctgatcagaatcaaacccgtatctactacagcgtga

SEQ ID NO: 5843 - protein, 242 aa, Herminiimonas arsenicoxydans
MNETDFATLVATTQKTLQHVADQFAPAVFASSLAAEDQVLTDMILRSKLPITIFTLETGRLHAETLGVLDRIKETYGVEIALYRPQPEAVDAYVRQNGLNAFYESVDMRKECCRIRKVEPLNRALQGNRSWITGQRRAQSSTRAELHVQEQDDAHDMVKFNPLADWSEADVWHYIRSNNVPYNPLHDKGYPSIGCEPCTRAIQPGEDVRAGRWWWENPESKECGLHVVDGKLIRIKPVSTTA

SEQ ID NO: 5844 - DNA, 774 bp, Synechococcus sp. WH 7803
  CDS (1)..(774): transl_table=11
atgaggaacggcatcattgcgatgacaggcgctgccgcggacttggattgcggcggtgatcccgcccagctgacgcgtctgagggaggaccttgagtccttagagcctgcgcagcggctgcagtgggcgcgggatcagttcgggtcgggattcgcgatgaccacgagctttgggatccaatcgtccgtgctccttcacatgctttctggtctgccggattttgaatcggtgccggtgatttgggtggataccggttatttgccccaagagacctatcgctacgccaaaacgctctgcgaccgtcttggtcttcaacccgatgtcgtccaatcgtctgtgtccccagcacggatggaagccctgcatgggcgactttgggaaacgggcagcgacagcgaccttgatcaataccttcaactgcgcaaagttgagcctctcgagagtgcgctcgatcgccttgctgtgcgctgttgggcgagtggggtgcgcagccgacagaccagtcacagaagcacgatgacggtgctggatccgatccgcggccgactctccctcaggccgcttctgcattggaccaatagagacatcttctattacatgcaggatcacgacctaccgcagcatcctctgtttgatcagggatattccacagttggcgattggcattccagtgctccagacggtgtggatggcgagggacgcagcacacgttttggtggacaacgacaggagtgtgggattcatgtgcctggggtgatgggtgacggcatttga

SEQ ID NO: 5845 - protein, 257 aa, Synechococcus sp. WH 7803
MRNGIIAMTGAAADLDCGGDPAQLTRLREDLESLEPAQRLQWARDQFGSGFAMTTSFGIQSSVLLHMLSGLPDFESVPVIWVDTGYLPQETYRYAKTLCDRLGLQPDVVQSSVSPARMEALHGRLWETGSDSDLDQYLQLRKVEPLESALDRLAVRCWASGVRSRQTSHRSTMTVLDPIRGRLSLRPLLHWTNRDIFYYMQDHDLPQHPLFDQGYSTVGDWHSSAPDGVDGEGRSTRFGGQRQECGIHVPGVMGDGI

SEQ ID NO: 5846 - DNA, 735 bp, Erwinia carotovora subsp. atroseptica SCRI1043
  CDS (1)..(735): transl_table=11
atggccgaatttaaccttgaggcgctcaacgcgttaccgaaagatgaacaggtggccgcgttggcggctgtgaatggccagcttgaacagctgtccgcgcaggagagggtgagctgggcgctggagaatttgccgggcgatttcgttttgtcgtccagtttcggcattcaggctgcgatatcgctgcatctggtgacgcaacagcggccggatattccggtcatccttacggataccggctatctgtttcctgaaacctaccagtttattgatgcactgacggaacagctgaagctgaatctgcacgtgtatcgcgccgcagagtctccagcatggcaagagtctcgttatggcaagctgtgggatcagggcgtggaaggtattgagcgctacaacctgctgaataaagttgagccgatgaatcgggcgttgagtgagctaaacgctgggacgtggtttgctggcctgcgccgtgaacagtccggcagccggggggagttgcccgtgctggcgattcagcgcggcgtctttaaattcctgccgattatcgattgggataaccggacggtgtatcagtatctgaaagaaaacggcctgagttaccatccgctgtgggatcagggctatttgtccgtcggcgatacgcacaccactcgcaaatgggagccgggcatgagcgaagaagaaacccgcttcttcggcttaaagcgcgagtgcgggttgcacgaagggtaa

SEQ ID NO: 5847 - protein, 244 aa, Erwinia carotovora subsp. atroseptica SCRI1043
MAEFNLEALNALPKDEQVAALAAVNGQLEQLSAQERVSWALENLPGDFVLSSSFGIQAAISLHLVTQQRPDIPVILTDTGYLFPETYQFIDALTEQLKLNLHVYRAAESPAWQESRYGKLWDQGVEGIERYNLLNKVEPMNRALSELNAGTWFAGLRREQSGSRGELPVLAIQRGVFKFLPIIDWDNRTVYQYLKENGLSYHPLWDQGYLSVGDTHTTRKWEPGMSEEETRFFGLKRECGLHEG

SEQ ID NO: 5848 - DNA, 702 bp, Symbiobacterium thermophilum IAM 14863
  CDS (1)..(702): transl_table=11
atggctgaaaagagatggagcccggaggagatcgccgccgcggcccggtccctggaggggcaggggcctgtcgcggcgctccgctgggcctacgaacagtttgcaccggaggagatcgccttcgcgtgctccttcggggccgaggacgtggccctggcccacatgatcagccgggtggcgcccggcgcccaggtcttctacctggacaccgactttctgttccccgagacctaccggaccatcgaggcggtccgggccgcctatcccctgcggatccggcgggtgtcccccgcgctcacgccccgggagcaggcggagcggtacggcgacgaactgtggagccgcgaccccgatctctgctgcagcctgcggaaggtggagcctctccgggaggtgctccgggggctgaaggcgtggatcaccggcatccgccgggcgcagtcgcccacccgggccggggcgcaggtggtggagtgggacaggaagttcggcctggtgaaggtcaaccccctggtggactggaaggacgcggacgtctggaagtacatcctcgagcacaacgtgccgtacaacccgctgcacgaccggggctacccctccatcggctgcacgcattgcacccgtccggtcaggccgggggaggatccccgggccggccgctggtccggcttcgccaagaccgagtgcgggctgcaccagtga

SEQ ID NO: 5849 - protein, 233 aa, Symbiobacterium thermophilum IAM 14863
MAEKRWSPEEIAAAARSLEGQGPVAALRWAYEQFAPEEIAFACSFGAEDVALAHMISRVAPGAQVFYLDTDFLFPETYRTIEAVRAAYPLRIRRVSPALTPREQAERYGDELWSRDPDLCCSLRKVEPLREVLRGLKAWITGIRRAQSPTRAGAQVVEWDRKFGLVKVNPLVDWKDADVWKYILEHNVPYNPLHDRGYPSIGCTHCTRPVRPGEDPRAGRWSGFAKTECGLHQ

SEQ ID NO: 5850 - DNA, 711 bp, Bacillus licheniformis ATCC 14580
  CDS (1)..(711): transl_table=11
atgaacgatgttttaacgtatagcacatgggatgaaaaagcttctgaagaggtgatggatactttcagcggcgagatggacgttttgaaatgggcgtacagcacgtatcaaaaaatcgtttacgcctgcagcttcggcgcggaaggaatcgttttgatcgacttgatttcaaaggttgtgaaagaagcggacatcgtgtttttagatacaggactgcattttccggaaacatatgagctgatcaatgaagtgaaagatcgctatcccggtctgtcgatccactttttaaaacccggcctctcacttgaagagcaggaaaaacgctatggcagcgaactttggaagcgccagccggaccagtgctgccgccttcgcaaaatcgagccgctcagggagcatctgtcaggcatggaagcctggattaccgggctgaggcgggagcagtcggaaacacggaaacatgtccgatatatcaacaaggacgacaattttaaactgattaaaatctgcccccttattcactggacatgggaggatgtctggacttacattaagctgaatcagctgacgtatcacaagcttcatgatcaagattatccgagcatcggctgtgaggtgtgtacgcttcccgtgacagacagcggcaatttaagagcgggaaggtgggcccaccaggaaaaaacagaatgcgggctgcatcaattccggtag

SEQ ID NO: 5851 - protein, 236 aa, Bacillus licheniformis ATCC 14580
MNDVLTYSTWDEKASEEVMDTFSGEMDVLKWAYSTYQKIVYACSFGAEGIVLIDLISKVVKEADIVFLDTGLHFPETYELINEVKDRYPGLSIHFLKPGLSLEEQEKRYGSELWKRQPDQCCRLRKIEPLREHLSGMEAWITGLRREQSETRKHVRYINKDDNFKLIKICPLIHWTWEDVWTYIKLNQLTYHKLHDQDYPSIGCEVCTLPVTDSGNLRAGRWAHQEKTECGLHQFR

SEQ ID NO: 5852 - DNA, 723 bp, Methylococcus capsulatus str. Bath
  CDS (1)..(723): transl_table=11
atgacacagaccgagatcgacacgctccaggccgaactggccggccgctccccccgcaccattctggaaacggcattgagccgcttccagcggatcgcggtatcgttcagcggggcggaagacgtcgttttggtggaaatggccgcgcggttgcgaccgggcatcgaggtcttcaccctggacacgggacgcctgcatccggagacctaccgcttcatcgaagaagtgcgcgagcgctttgccgtccgcctcgacgtgctgtcaccggacgccgcggaactggaagcaatggtgcgggaaaaaggactgttcagcttctaccgcgacggtcatcaggaatgctgcggaatccgcaaggtccggcccttgcgccggaagctggcgacgctcgatgcatggatcaccggtcagcgccgggaccagaacccgacccggcaggcggtccctgaagtggaagccgatccagcttttgcgactggacatcaccccctcgtgaaattcaatccgctggcagcctggacttccgcccaggtatgggattacatcacggcctgcgaaatcccgttcaacgccctgcatctcaaagggtatgtcagcatcggctgcgaaccctgcacccgcccggtccgcccgggccaacacgaacgcgagggccgctggtggtgggaggatgcactcaagaaggaatgcggcctgcacatcggcgacgcttccagggtttga

SEQ ID NO: 5853 - protein, 240 aa, Methylococcus capsulatus str. Bath
MTQTEIDTLQAELAGRSPRTILETALSRFQRIAVSFSGAEDVVLVEMAARLRPGIEVFTLDTGRLHPETYRFIEEVRERFAVRLDVLSPDAAELEAMVREKGLFSFYRDGHQECCGIRKVRPLRRKLATLDAWITGQRRDQNPTRQAVPEVEADPAFATGHHPLVKFNPLAAWTSAQVWDYITACEIPFNALHLKGYVSIGCEPCTRPVRPGQHEREGRWWWEDALKKECGLHIGDASRV

SEQ ID NO: 5854 - DNA, 726 bp, Bacillus clausii KSM-K16
  CDS (1)..(726): transl_table=11
atggcttacgtttttgagcaaatggaggctaccgactatgaaaaggtaaataccaagttgaaaaatcgggatagcctggatattttgcgctgggcgaatcaaacgtatggtgaaaagctcgtgtatgcttgcagttttggagccgaggccatggtgctgcttgacttgttgtcaaaaatacaaaaagaagcccacattttgtttttagatacagattttcattttgccgaaacgtacgaattgatcgaacgtgtaaaggaacgatacccgacatttcgtattaacatggctaaacctgctttgtctccagaggaacaagcggaacgttacggcgatgaactatggcttaaaaatccagaccagtgctgtcaaattcgaaaattggatgtgctggcccgtgagcttgagccttacgatgcttggctttcaggcttaaggcgtgagcagtctccaacacgagcaaataccgagtttgttaatcaggataagcgctttaaaaaggtgaaggtttgtccgttgattcattggacggaagaagaaatatggatgtacatcaaattgcatcaattgccctacaatgagttgcacgaccagcactatccgagcattggctgtacgtactgcacgaaagcggtcatgcctggggaagatgctcgaagcggccgctgggcgggaacaggaaaaacggaatgcgggttgcatgcaccaacgaaaggagattcatga

SEQ ID NO: 5855 - protein, 241 aa, Bacillus clausii KSM-K16
MAYVFEQMEATDYEKVNTKLKNRDSLDILRWANQTYGEKLVYACSFGAEAMVLLDLLSKIQKEAHILFLDTDFHFAETYELIERVKERYPTFRINMAKPALSPEEQAERYGDELWLKNPDQCCQIRKLDVLARELEPYDAWLSGLRREQSPTRANTEFVNQDKRFKKVKVCPLIHWTEEEIWMYIKLHQLPYNELHDQHYPSIGCTYCTKAVMPGEDARSGRWAGTGKTECGLHAPTKGDS

SEQ ID NO: 5856 - DNA, 762 bp, Colwellia psychrerythraea 34H
  CDS (1)..(762): transl_table=11
atgcttaataccacaacaggtattgccgataaagagcttaccagcccttttgaagtaacctttcctcatcctgctataggagagtggaatcaatctttggaaaaacaaacagcgattgctcgtgcagagtgggcaatggaaaacttgccaggtcagtttgttttatcttcaagctttggtattcaatctgcggtgatgttgcatttacttacccaagtagatagcaatattccggtattgataacggatacaggacatttatttcctgaaacctatcgattcattgagcagttgactgatcgtttgaacttgaacttacaagtctatcaagcaaaagaaagtgccgcatggcaacaagccaagtacggtgatgaatgggcgcaaagtgatgatgcacttaaagcctataatcgccgtaataaagttgaaccgctagagcgcgggttatctgacttaaatgctaatacttggttttctggtgttcgtcgtcaacaatcagctcaccgagaaggtttgtctgttgtgggtacactgcgtggtcgttataaagtacatccaataattgattggagtaataaagacgtacatgagtacttaactaagcacaacttaccataccatcccctttgggatgaaggttatgtatcggttggtgatgtacatagcacaaaaccattaacattgggtatgagtgaaagtgatactcgcttcggcggcggtcaacgtgaatgtggtttgcatactgatggtgatggtatttaa

SEQ ID NO: 5857 - protein, 253 aa, Colwellia psychrerythraea 34H
MLNTTTGIADKELTSPFEVTFPHPAIGEWNQSLEKQTAIARAEWAMENLPGQFVLSSSFGIQSAVMLHLLTQVDSNIPVLITDTGHLFPETYRFIEQLTDRLNLNLQVYQAKESAAWQQAKYGDEWAQSDDALKAYNRRNKVEPLERGLSDLNANTWFSGVRRQQSAHREGLSVVGTLRGRYKVHPIIDWSNKDVHEYLTKHNLPYHPLWDEGYVSVGDVHSTKPLTLGMSESDTRFGGGQRECGLHTDGDGI

SEQ ID NO: 5858 - DNA, 720 bp, Dechloromonas aromatica RCB
  CDS (1)..(720): transl_table=11
atgacccccagcctgctcaacatcacgccagaactgaccgccagcgttgccgtcaagaccaaaacggtcaaagcactgctcgccgacatcgcgaccaactggtcgagcgccgccttcgccaacagcctgggcgccgaggacatggtactgactgacctgatcgtcaaggccaagctgccgatcgaaatcttcagcctcgacaccggccgcctgccgctcgaaacctacgacctgatcgccgcggtcgacaagcattacggcctgaaactgaagctctatttcccgcaggccgaagaagtcgaaagctacgtccgcaaccacggcatcaacgccttctacgaatcggtcacgctgcgcaaggcctgctgttacgcccgcaaggtcgagccgctgaaacgcgccctggctggcaagcgagcctggatcaccggcatgcgcgccgagcaggcggcgactcgcgggaacctcgccatccgcgagtacgatgaaggcaatggtctggaaaaattcaatccgctgtcggactggaccgagaaggaagtctggacctacatcaagcagaacgccgtgccctacaacgccctgcacgacaagttctaccccagcatcggctgcgccccctgcacccgcgccatttcgcccggcgaagacatccgggctggccgctggtggtgggagaatcctgagtccaaggagtgcggactgcacgtcaagggctga

SEQ ID NO: 5859 - protein, 239 aa, Dechloromonas aromatica RCB
MTPSLLNITPELTASVAVKTKTVKALLADIATNWSSAAFANSLGAEDMVLTDLIVKAKLPIEIFSLDTGRLPLETYDLIAAVDKHYGLKLKLYFPQAEEVESYVRNHGINAFYESVTLRKACCYARKVEPLKRALAGKRAWITGMRAEQAATRGNLAIREYDEGNGLEKFNPLSDWTEKEVWTYIKQNAVPYNALHDKFYPSIGCAPCTRAISPGEDIRAGRWWWENPESKECGLHVKG

SEQ ID NO: 5860 - DNA, 783 bp, Thermobifida fusca YX
  CDS (1)..(783): transl_table=11
gtgcgcccgagtcttccgcctctccttcgtcgggctccacgccgcggcgttccccccttccactacgacgccgaccggggaggagcagcgttgaacatcacggccgacggcgcggcgttcgccgctgaggctgccgcccgcctggaagaagccagcgccaccgagatcatccagtgggccgccgacacgttcggcgaccggctgtgcctgaccgcgtcgatggcggacgccgtcatggtggacctggtctcgaaagtagtcccgggcatcgacgtgatcttcctggacaccggctaccacttcccggagacgctggggacccgcgacgcggtcgcgcagacctacccgatcaacctgatcacggtcacccccagccggaccgtagcggaacaggatcgcgacctcggtccccggctgtacgcccgcaaccccgacctctgctgctacctgcgcaaagtagagccgctgcagcgggcgttgcagtcctacgacgcctggctgaccgggctgcgccgcgacgaggcggtgacccgccgcaccgtgggggtcgtgcagtgggacgcccgcaagaagaagatcaaagtcaatccgatcgcccgctggacccaagagcaggtggactcctacatcgctgagcacggggtgctcgtcaacccgctgcaggacgacggctacccctcgatcgggtgtgcgccgtgcactcagcgggtgccggaaggcgccgacccccgcagcggtcgctgggcgggaacagggaaagtcgaatgcggtctccacagttga

SEQ ID NO: 5861 - protein, 260 aa, Thermobifida fusca YX
MRPSLPPLLRRAPRRGVPPFHYDADRGGAALNITADGAAFAAEAAARLEEASATEIIQWAADTFGDRLCLTASMADAVMVDLVSKVVPGIDVIFLDTGYHFPETLGTRDAVAQTYPINLITVTPSRTVAEQDRDLGPRLYARNPDLCCYLRKVEPLQRALQSYDAWLTGLRRDEAVTRRTVGVVQWDARKKKIKVNPIARWTQEQVDSYIAEHGVLVNPLQDDGYPSIGCAPCTQRVPEGADPRSGRWAGTGKVECGLHS

SEQ ID NO: 5862 - DNA, 726 bp, Anabaena variabilis ATCC 29413
  CDS (1)..(726): transl_table=11
atgacagcttctacggcatttaaaacccaaacaaacgaatttaatttagatgaattaaatcaacagtttgaaactgccactcctaaagaaattctggcatggtctatagagcatatccccacagggttggtacaaactagcgcctttaatgtggatgacttagtaattacccatatcctttatagtgaactcaagcaaccagtacctgtaatctttctcgatactctgttccactttcaacaaactctagaactcgttgcaaaagcgaaagaaatatacaacctagatttacaaacctacaaaactccagatgtagacacccgcgaagcctttactgctaaatatggcgaggcgctttgggataaagatattacacaatttcaccaagttaccaaaattgaacctctacaacggggtttagatgaactcaacacagttgcgtggattactggtcgtcgccgtgatcaagcagttacccgcgctaatatgcctgtatttgaattagatggcaaaggtcgtttgaaagtaaatcccctagctacttggacacgtcaagatagttgggcttacgtagccgaacatggtgtgatttacaacccactccacgaccaaggttatcccagcattggcgatgaacccatcaccaccaaagtgggcgaaggcgaagacgaacgcgccggacgctggagaggaagcaataaaactgaatgtgggattcacatttag

SEQ ID NO: 5863 - protein, 241 aa, Anabaena variabilis ATCC 29413
MTASTAFKTQTNEFNLDELNQQFETATPKEILAWSIEHIPTGLVQTSAFNVDDLVITHILYSELKQPVPVIFLDTLFHFQQTLELVAKAKEIYNLDLQTYKTPDVDTREAFTAKYGEALWDKDITQFHQVTKIEPLQRGLDELNTVAWITGRRRDQAVTRANMPVFELDGKGRLKVNPLATWTRQDSWAYVAEHGVIYNPLHDQGYPSIGDEPITTKVGEGEDERAGRWRGSNKTECGIHI

SEQ ID NO: 5864 - DNA, 735 bp, Pseudomonas fluorescens PfO-1
  CDS (1)..(735): transl_table=11
atgagcccaacgttcgacgtcgtggaactcgccacgacctatgccaacaaatccgcgcaggacatcctcaaactcgcgttcgccgagttcggcgatgacctgtggatatctttcagcggcgccgaggatgtggtgctggtggacatggcctggaagctgaacaagaacgtcaaggtgttcagtctcgacaccggccgcctgcatccggaaacctaccgtttcatcgatcaggtgcgcgagcactacaagatcgacatcgaactggtctcgccggactacacgaaacttgaaccgttcgtgaaggaaaaaggcctgttcagtttctacaaggacggtcacggcgaatgctgcgggatccgcaagatcgagccgctgcgccgcaagctgtccggcgtcaaagcctgggccaccggccagcgccgcgatcaaagccctggcacccgcagcgctgtggcggtgatggaaatcgatacagcgttctccaccccggagcgcaccctgtacaagttcaacccgctggcacagatgaccagcgaggaaatctggggctacatccgcatgctggagctgccgtacaacagcctgcacgagcgcggctttatcagcatcggctgcgaaccgtgcactcgtcctgtcctgccgaaccagcacgaacgtgaaggtcgctggtggtgggaagaagcgacccaaaaagaatgcgggttgcatgccgggaacatcatcagcaaggcataa

SEQ ID NO: 5865 - protein, 244 aa, Pseudomonas fluorescens PfO-1
MSPTFDVVELATTYANKSAQDILKLAFAEFGDDLWISFSGAEDVVLVDMAWKLNKNVKVFSLDTGRLHPETYRFIDQVREHYKIDIELVSPDYTKLEPFVKEKGLFSFYKDGHGECCGIRKIEPLRRKLSGVKAWATGQRRDQSPGTRSAVAVMEIDTAFSTPERTLYKFNPLAQMTSEEIWGYIRMLELPYNSLHERGFISIGCEPCTRPVLPNQHEREGRWWWEEATQKECGLHAGNIISKA

SEQ ID NO: 5866 - DNA, 717 bp, Rhodobacter sphaeroides 2.4.1
  CDS (1)..(717): transl_table=11
gtggcggcgctcaacggtcgctacaagcaccacggcgcgacggccgtgctcgaacatgcgctgaaggatgcggatctgggccgggtggcgcttgtctcctccttcggggccgagtcggtcgtgcttttgcatctcgtctcggtcatcgcgcccgagacgccggtgatcttcatcgacacgcggatgctgtttcaggagacgctcgactatcagcgcgagctggccgacacgctgcacctctgcgacatccgcacgatccgggcgacccagccgcggatcgccttcgaggatccggacgggacgctgaaccgctacaacaccgacgcctgctgcgcggtgcgcaaggtcgagccgctcgaacgggcgctcaagcatttcgatggctggatcaccggccgcaagcgctaccagagcggcacgcgggcggcggtcgagttcttcgaggccgaggacgaccggcgcatcaaggtcaatccgctcgcccactgggggcgcgaggatctggaagactatatcgtcaacaacaacctgccgcgtcatccgctggtcgccaggggctatccctcgatcggctgcgagccctgcacctcgccggtggccgagggagaggatccccgcgcgggccgctggcgcggcagcgccaagaccgaatgcggcatccatttcatcaacggccgcgcggtgcgcggacccgtgaacaaggaggacgcggcatga

SEQ ID NO: 5867 - protein, 238 aa, Rhodobacter sphaeroides 2.4.1
MAALNGRYKHHGATAVLEHALKDADLGRVALVSSFGAESVVLLHLVSVIAPETPVIFIDTRMLFQETLDYQRELADTLHLCDIRTIRATQPRIAFEDPDGTLNRYNTDACCAVRKVEPLERALKHFDGWITGRKRYQSGTRAAVEFFEAEDDRRIKVNPLAHWGREDLEDYIVNNNLPRHPLVARGYPSIGCEPCTSPVAEGEDPRAGRWRGSAKTECGIHFINGRAVRGPVNKEDAA

SEQ ID NO: 5868 - DNA, 747 bp, Synechococcus sp. CC9605
  CDS (1)..(747): transl_table=11
atggtgtccatggcggtgcaaaacgagttgctcgaagggcgcaagctgctggagtcgatggagccgcagcagcgtttggcctggggattggagcagttcggggagaactttgctctcaccacaagttttgggatccaatcggctgtgcttttgcacatgttgagcaccctccccgggggtgatgcggtgccagtgatctggatcgataccggttatttgcctcctgatacctacacctacgccgctcaactcacccagcaactcaggattcgtctggtggtgagtcagagcgagatgtccccggctcggatggaggccctgcacgggcggctctgggagtccggtcgcgtcgaagacctcgagacctatcaccggattcgcaaggttgaacccctagagcgtgcgctcaacgatctagagacgcgctgttgggccagcggcgtgcgtcgagggcagaccgatcaccgccgctcgatgaccgccttggatccgattcgggagcgttggtccctgcgccccttgctcgagtggacgcagcgagacgtttattactacatgcaatcgaacaacctcccccagcacccattgttcgagcagggctattccaccgttggcgactggcattccagtggcccggacgtgggagatctgagtggccgcgacacccgcttcggcgggttgaagcaggagtgtggaattcatgtgccccaggaggccaacgaagggctgatgggcgatggcatctga

SEQ ID NO: 5869 - protein, 248 aa, Synechococcus sp. CC9605
MVSMAVQNELLEGRKLLESMEPQQRLAWGLEQFGENFALTTSFGIQSAVLLHMLSTLPGGDAVPVIWIDTGYLPPDTYTYAAQLTQQLRIRLVVSQSEMSPARMEALHGRLWESGRVEDLETYHRIRKVEPLERALNDLETRCWASGVRRGQTDHRRSMTALDPIRERWSLRPLLEWTQRDVYYYMQSNNLPQHPLFEQGYSTVGDWHSSGPDVGDLSGRDTRFGGLKQECGIHVPQEANEGLMGDGI

SEQ ID NO: 5870 - DNA, 708 bp, Geobacter metallireducens GS-15
  CDS (1)..(708): transl_table=11
atgactgcaaccattcagaaaacaatcccccaacttccccaggacgccactccacaggacatcctcagggccggagtgtcggcgaccgagggttctgtcaagctcgcctgctccttctctgtggaggacgtcatcatcatcgacatggcaaaggaactggggtgcccgattgggatattcgccctcgacacggggcgcctccacgaggagacctacgaggtggcagacgccatcacggagcgctaccggatcccgatagactggtatttcccgcggcacgagacggtggaaaagctcgaacgcgacaaggggcttttctctttccgtgaatccctggataaccgccatgagtgctgccacatccgcaaggtggagccacttggccgggcgctcaaggggcttgccggctggatcaccgggctccgccgcgaacagagcgtcacgcggaccggcctcgctcccatcgagagcgacgaagcaaacggcggcatcctgaaaatcaacccgctcctggagtggagtgaggaacaggtctgggagtacgccgaaaagcgccgggtaccggtgaaccgtctccataaacagggatacccttcgatcggctgcgctccctgcacccgccccgtggccccgggcgagcatccccgagccggacgatggtggtgggagaatccggagcataaagagtgcgggttgcaccggcactga

SEQ ID NO: 5871 - protein, 235 aa, Geobacter metallireducens GS-15
MTATIQKTIPQLPQDATPQDILRAGVSATEGSVKLACSFSVEDVIIIDMAKELGCPIGIFALDTGRLHEETYEVADAITERYRIPIDWYFPRHETVEKLERDKGLFSFRESLDNRHECCHIRKVEPLGRALKGLAGWITGLRREQSVTRTGLAPIESDEANGGILKINPLLEWSEEQVWEYAEKRRVPVNRLHKQGYPSIGCAPCTRPVAPGEHPRAGRWWWENPEHKECGLHRH

SEQ ID NO: 5872 - DNA, 726 bp, Prochlorococcus marinus str. MIT 9312
  CDS (1)..(726): transl_table=11
atgattgaaaacatccaaaaagatattcaacctgaattaataaataaatataatcaagagctaagagatatgactgctcaagaaatgcttacatggggttataaagagtttgataatcaattcgcaattacaacaagttttggtatacagtcatcagtccttttaaatatggtcagtaaattatgtctacaaaaaaaaatcaaaatattttggatagatacaggttatttacctccagaaacataccattatgctgaaaaacttattgtcgatttatctttagaaatagaagttctgcaaagtgaattatccccagcaagaatggagactatacacggaaaactttgggaaacaaataaagcgagtgatttagataagtatcatgatttgagaaagataaaacctttggaaaatggtctagaaaaatataaaattaactgttgggcaagcggtgttagatcaagccaaacagaaaatagaaaagaaatgaaattcttggacctaattcgtcaaagactttctctaaggcctttattaaattggacaaataaagatattttttattatatgaaagagaataatttacctgcccatccacttttcagcaaaggttattctactgtaggtgattggcactcaagcactcctgatggtaataaaacaaaaggaagagcaacaagatttggggggattaaacaagagtgtggaatacacactaataattaa

SEQ ID NO: 5873 - protein, 241 aa, Prochlorococcus marinus str. MIT 9312
MIENIQKDIQPELINKYNQELRDMTAQEMLTWGYKEFDNQFAITTSFGIQSSVLLNMVSKLCLQKKIKIFWIDTGYLPPETYHYAEKLIVDLSLEIEVLQSELSPARMETIHGKLWETNKASDLDKYHDLRKIKPLENGLEKYKINCWASGVRSSQTENRKEMKFLDLIRQRLSLRPLLNWTNKDIFYYMKENNLPAHPLFSKGYSTVGDWHSSTPDGNKTKGRATRFGGIKQECGIHTNN

SEQ ID NO: 5874 - DNA, 672 bp, Frankia sp. CcI3
  CDS (1)..(672): transl_table=11
atggatgccgcgttgcaggcccgggcgctgcgggccggggacgacctcgagggcgcgccggcggaggagatcctgcgctgggcggtcggggaattcgggacgaagctggcgatcgccgcctcgatggctgaggcgatcctcgtggacatgctcgcccggattcggtccgacgtccccgtggttttcatcgacaccggttatcacttccccgagaccgtcggtacccgggacgcggtggccggaacctacgacctgccgatcatcagcgcccgtccgcagctcaccgtcgtcggccaggacgccgtctacggccaggacctctaccggaccgacccggacctgtgctgccggatgcgcaaggtcgttccgctggatcgggccctggcgccctaccgtgcctgggccgcggggtcgcggcgggcggagtcgcccagccgggcgaagctccgggtcgtcgactgggacgcccgacggggcaaggtgaagatccacccgctcgcggcttggaccgacgaggacgtcgaacgctacgtggccgagcacggcgtcatcgtcaacccgctcctctccgatggttacgactcggtcggctgctggccgtgcacccggcggggcgccggccgggagggccggtgggtcggttcgatcaagacggagtgcggcatccactga

SEQ ID NO: 5875 - protein, 223 aa, Frankia sp. CcI3
MDAALQARALRAGDDLEGAPAEEILRWAVGEFGTKLAIAASMAEAILVDMLARIRSDVPVVFIDTGYHFPETVGTRDAVAGTYDLPIISARPQLTVVGQDAVYGQDLYRTDPDLCCRMRKVVPLDRALAPYRAWAAGSRRAESPSRAKLRVVDWDARRGKVKIHPLAAWTDEDVERYVAEHGVIVNPLLSDGYDSVGCWPCTRRGAGREGRWVGSIKTECGIH

SEQ ID NO: 5876 - DNA, 813 bp, Novosphingobium aromaticivorans DSM 12444
  CDS (1)..(813): transl_table=11
atggacagcaccgtgacccgcaagatcgacctgctcgacaccgcgccgcgctttaccgagacggacgcgatccgcctcaacaacctgttccggggcaccgacacgcacgacatgctgcgttcggtgatccgcgacgggctggcgggcgacctcgcggtcgtgtcgagcttcggcgcggaaagcgcggtgctgctccacctgatcgccgaagtcgacccttcggtgccggtcctgtttctcgaaacgggcaagcatttccgcgagaccgttgcctatcgcgacgagttgatcggcttcctgggcatgaccaacctgcagatcatcgaacccgacgcggcggtcatcgccaagaaggacgagaacgggctgcgctggtcctgggacccggatggctgctgcgagatccgcaaggtcgagccgctggccagggccctgctccacttcgatgcatcgatcaccggccgcaagggcttccagtcgaagacccgcgcagggcttccacggttcgagatcgaccgttcggacgcgcaaggacggttgaagatcaacccgctcgcgtcatgggacaagaccatgctcgaggcctatttcgcagagcatggcttgccgccgcatccgctggtcgcgcagggctatccctcgatcggctgcgcgccctgcaccagcaaggttgcccccggtgaagacccgcgctcgggccgctggaagggctgggacaagaccgaatgcggcatccattcgcccaccgacgacgaagccgcaggcaagaagcctggcgacgaactgcccccaggatacgaaccggtcttctga

SEQ ID NO: 5877 - protein, 270 aa, Novosphingobium aromaticivorans DSM 12444
MDSTVTRKIDLLDTAPRFTETDAIRLNNLFRGTDTHDMLRSVIRDGLAGDLAVVSSFGAESAVLLHLIAEVDPSVPVLFLETGKHFRETVAYRDELIGFLGMTNLQIIEPDAAVIAKKDENGLRWSWDPDGCCEIRKVEPLARALLHFDASITGRKGFQSKTRAGLPRFEIDRSDAQGRLKINPLASWDKTMLEAYFAEHGLPPHPLVAQGYPSIGCAPCTSKVAPGEDPRSGRWKGWDKTECGIHSPTDDEAAGKKPGDELPPGYEPVF

SEQ ID NO: 5878 - DNA, 753 bp, Desulfitobacterium hafniense Y51
  CDS (1)..(753): transl_table=11
atgaacagatcggagctcgatttggagcttgatgaaataaaccaagcctttgccggggaagatccccgcaagcttttggcctatgtggtggaaaaaatcggtccggcgcggattgctctggcttccagcctttccatcgaagatcaggtgctgacccagatgttattgaaggtcgatgcccgggcccggatcttctttatcgatacgggacggaattttcagcagacttatgatctgatggaggagaccatgggccgctataagttccactatgaggtatatgcgccggagaattcggagctggagccgtttctggcggaatatggccccaacgctttttatgacaaggttgaactgcgtcaaaaatgttgtgagctgagaaaagtcaggcccttgcagcgggtcttatctgccgtggacggctggatttgcggactgcgcagggagcagagccccacccgccaggaaatcggtttgctggaatgggattctcaccacgctatctataaagtgaatcctctggcggcctggagcgaagagcaggtttgggcttatatccgccgggaaaacattccctacagttccctatacaacaaaggtttccgcagcattggctgtcagccctgcacccgggcggtggcccccggggcggatgtacgcagcggcaggtggtggtgggaagatccctctaaaaaagaatgcgggctgcatccatccctgaacccgcctgcaaaggaggaagaaaagcgatga

SEQ ID NO: 5879 - protein, 250 aa, Desulfitobacterium hafniense Y51
MNRSELDLELDEINQAFAGEDPRKLLAYVVEKIGPARIALASSLSIEDQVLTQMLLKVDARARIFFIDTGRNFQQTYDLMEETMGRYKFHYEVYAPENSELEPFLAEYGPNAFYDKVELRQKCCELRKVRPLQRVLSAVDGWICGLRREQSPTRQEIGLLEWDSHHAIYKVNPLAAWSEEQVWAYIRRENIPYSSLYNKGFRSIGCQPCTRAVAPGADVRSGRWWWEDPSKKECGLHPSLNPPAKEEEKR

SEQ ID NO: 5880 - DNA, 726 bp, Saccharophagus degradans 2-40
  CDS (1)..(726): transl_table=11
atgagcaacaccatcgacttcaccgatattgatgcgaagctgcaacaagcttcaccgcaagaaatactcgcttacgcgcttgccgaaaacgacaacctcgcaatatcgtttagcggtgcagaagatgttgtactagttgatatggcttctaaaataaaacccggcgttcaggtgttttgtttagatactggcagattacatgcagagacctaccaatttattgagcaagtacgcaaacactacgatattaagctcgacgtgttgtttccagattctgccgcagtacagaagcttgtggcggaaaaaggcctttttagctttttcgaagacaatcaccaagaatgctgtggcatacgcaaagtaggccctctgcgcaaaaaactattggaagtagacgcttgggttacgggccagcgcaaagatcagagccctggcacacgcgcctctattccggtaatccaaaacgatcgtgtttttgcacgcccaggagacaccctaaccaaatttaaccccttggttaattggacatcacaacaggtttgggattacattcgctctgaaggcgtaccatacaacagcctgcacgatcgaggctttgtctctataggctgcgaaccctgcacacgcccaacgggccctggccagcatgagcgtgaaggccgctggtggtgggaagaagccaccaagaaagaatgcggtttacacgccactaacgttaaaaaatag

SEQ ID NO: 5881 - protein, 241 aa, Saccharophagus degradans 2-40
MSNTIDFTDIDAKLQQASPQEILAYALAENDNLAISFSGAEDVVLVDMASKIKPGVQVFCLDTGRLHAETYQFIEQVRKHYDIKLDVLFPDSAAVQKLVAEKGLFSFFEDNHQECCGIRKVGPLRKKLLEVDAWVTGQRKDQSPGTRASIPVIQNDRVFARPGDTLTKFNPLVNWTSQQVWDYIRSEGVPYNSLHDRGFVSIGCEPCTRPTGPGQHEREGRWWWEEATKKECGLHATNVKK

SEQ ID NO: 5882 - DNA, 705 bp, Acidobacteria bacterium Ellin345
  CDS (1)..(705): transl_table=11
atgagtagcacaacattcgatctcggattccaggccaaaattgccgctgcgcaagctctcgtgcaggaatccatcgaacacgcgaagcgaccgtgcttgacgtgcagcttccaggcagaagacgtcgtggtgcttgacctgcttcggcaagtggtgcctgacatccccgtactgttcctcgataccggatatcacttcgcggaggtctatcagtaccgggacgagatcgcctcgaaatggcggctgaacctaatcaatctgctgcccaagcaatccgtggccgagcaggagagtgcgtttggcattctttaccaaactgcgccggaccgctgttgcggtgctcgaaaagtagaaccgctgttccgcgccctggagaattattcgacatggttcacggggctgcgccgtgagcagtccaagagtcgatcggcgctgcagtcgatcgatctctttacgctgccaaccggaacggagattcagaaggtcagcccacttgccgagtggagcacccgggatgtgtggacgtacgcctcggcacatggcatcccgttgcttcccctttatgagaagggctactccagcattggatgtgagccctgcacgagcctgccctccgagggcgatcctcgatctggccgatggggcggccacaagcttgagtgcggtattcacatccaaccgtcggcaacttccgagaaaccctaa

SEQ ID NO: 5883 - protein, 234 aa, Acidobacteria bacterium Ellin345
MSSTTFDLGFQAKIAAAQALVQESIEHAKRPCLTCSFQAEDVVVLDLLRQVVPDIPVLFLDTGYHFAEVYQYRDEIASKWRLNLINLLPKQSVAEQESAFGILYQTAPDRCCGARKVEPLFRALENYSTWFTGLRREQSKSRSALQSIDLFTLPTGTEIQKVSPLAEWSTRDVWTYASAHGIPLLPLYEKGYSSIGCEPCTSLPSEGDPRSGRWGGHKLECGIHIQPSATSEKP

SEQ ID NO: 5884 - DNA, 762 bp, Silicibacter sp. TM1040
  CDS (1)..(762): transl_table=11
atgacccgtatagatcaggagatcaggggccatcccgccgctgctggcagcgctgaggccctggccgagcaggttgcggcgctcaatgcccgcttcaaacaccactcggccacctccgtgatggaaggggcgctgcgggatgctggcaatatcgcgctggtgtcgtcctttggggcggaatcggtggtgctgttgcatatggccgccgtgatcgacccctcggtgccggtgctctttgtggacacggaactcttgttcacagagacgctggtctaccagcaagaagtgagcgagcgcctaggcctcaggaatgtgcatgtcatcaaggcggatgacatcgccgaaaaagacccctatggcgcgatgcggttttccgacaccgacgcctgctgcaccctgcgcaagaccattccgctgcaaaaggcgctcgccggctatgacggctggatcaccgggcgcaaacggtttcagtccggcacccgcgccgcgctcgacttctttgaggtcgaggatggcaccggacgaatgaagatcaacccactggcccattgggcgcccgaagacgtgcgcgcctatatggatgaaaaccgcctgccccgtcacccgctggtggccaagggctatccatcgatcggctgcgaaccctgcaccagcccggtcgcagaaggcgaagacccccgcgccggtcgctggcgcaaccagaacaaggaagaatgcggcatccacgttgtggatggcaaattcgtccgtacaggagcttga

SEQ ID NO: 5885 - protein, 253 aa, Silicibacter sp. TM1040
MTRIDQEIRGHPAAAGSAEALAEQVAALNARFKHHSATSVMEGALRDAGNIALVSSFGAESVVLLHMAAVIDPSVPVLFVDTELLFTETLVYQQEVSERLGLRNVHVIKADDIAEKDPYGAMRFSDTDACCTLRKTIPLQKALAGYDGWITGRKRFQSGTRAALDFFEVEDGTGRMKINPLAHWAPEDVRAYMDENRLPRHPLVAKGYPSIGCEPCTSPVAEGEDPRAGRWRNQNKEECGIHVVDGKFVRTGA

SEQ ID NO: 5886 - DNA, 723 bp, Myxococcus xanthus DK 1622
  CDS (1)..(723): transl_table=11
atgtcgcccccgcagccccaggcctcggccctgctcgccgaagccgctgaagtgaaggacgcccccgcgcaggacctcctcgcctggaccgagcgccgcttcggtgcgcgcgcggccatcgcctccagcttcggcgtggaggacatggtcctcatcgacctggcgcgccagcatgcgcccagcctgcgcctcttcacgctcgacaccggacgcctgcccccggagacgtacgaactcatggaggtggtgcgtaagcgctacggcgtcaccgtggagacgtacttccccgagcgcgcgcgcgtggaggcgttggagtccacgaacggctacttctccttccgccagagcctagaggcacgcaaggcgtgctgcgccatccgcaaggtggagcccctgtcgcgcgcgctcgcgggtcaacaggcgtgggtgacgggattgcgccgtgagcagtccgtcacccgcaccgacgtggcgacgttagaggtggacagcgcgcatgggctgctcaagctcaacccgctggccacgtggagcagccgggacatctgggcctacgtccgggcgaagagcgtgccctacaacgcgctccatgaccgtggctacccgtccatcggctgtgcgccctgcacgcgcgcggtgaaaccctacgaggacgagcgcgcgggccgctggtggtgggagtccgcggagaaccgcgagtgcggcctccacccggtccgatga

SEQ ID NO: 5887 - protein, 240 aa, Myxococcus xanthus DK 1622
MSPPQPQASALLAEAAEVKDAPAQDLLAWTERRFGARAAIASSFGVEDMVLIDLARQHAPSLRLFTLDTGRLPPETYELMEVVRKRYGVTVETYFPERARVEALESTNGYFSFRQSLEARKACCAIRKVEPLSRALAGQQAWVTGLRREQSVTRTDVATLEVDSAHGLLKLNPLATWSSRDIWAYVRAKSVPYNALHDRGYPSIGCAPCTRAVKPYEDERAGRWWWESAENRECGLHPVR

SEQ ID NO: 5888 - DNA, 756 bp, Rubrobacter xylanophilus DSM 9941
  CDS (1)..(756): transl_table=11
atgccggaggctcccgcgaaggagcgcaagaagcaacgagaggcccgcgaggaggtgttgcgtgccgccggggagctggagggggccgcgccgcaggaggttctgcgttgggcggtcgggttcttcggcaggaggctcaccctctccgtctccttcggggggccggaggggatggtccttctggacatgctctcgcggataaccgacgacgtctgggtcttcacgctggacaccggctttctcttcgaggagaccgtccggttccgggaggaggccatgcgccgctaccggctgccgctccgggtggtgcgtccggagctctccgtggaggagcaggtggaacgctacgggccgcggctctggagctgcgcgccggacatctgctgcgaggtccgcaaggtcgagccgcagcggcggtggctctccaacttcgacgcctgggtcaccggcatccggagggaccagacggcggcgcgggcggacacccccgtcgtcggctgggacgagttcttcggggtgttcaagatagcccccctggcctcctggagcagggagcgggtgctgcggtacgccggggagcacggggtgccgctcaacccgctgctctccagggggtacgccagcatcggctgcgagccgtgcacccgccccgtccgggagggcgaggacgagcgcgccggccggtggccggggatggagaagaccgagtgtggcctgcacatagcaaacgggaaggtgcgtcgtgcggtttcttag

SEQ ID NO: 5889 - protein, 251 aa, Rubrobacter xylanophilus DSM 9941
MPEAPAKERKKQREAREEVLRAAGELEGAAPQEVLRWAVGFFGRRLTLSVSFGGPEGMVLLDMLSRITDDVWVFTLDTGFLFEETVRFREEAMRRYRLPLRVVRPELSVEEQVERYGPRLWSCAPDICCEVRKVEPQRRWLSNFDAWVTGIRRDQTAARADTPVVGWDEFFGVFKIAPLASWSRERVLRYAGEHGVPLNPLLSRGYASIGCEPCTRPVREGEDERAGRWPGMEKTECGLHIANGKVRRAVS

SEQ ID NO: 5890 - DNA, 738 bp, Mesorhizobium sp. BNC1
  CDS (1)..(738): transl_table=11
atggcagcgaagccaaagccgcttgacgccgaaatcgaggcgctggaactcgatgcgcgttacggccatttggcggccgaggcgatcgtcgagcttgccgtgaaccggttccgcgacgagggcggtattgccaccgtctcctctttcggtgccgattcggccgtgcttcttcacatggtcgccagcgtcgacaagagcttgcccgtgctcttcctcgataccggccagcattttggtgagacgatcgaatatcgcgaccagttggcgtcggatcttggcctgtcaaacctggtggtcgttcacccgaagtccgagatgctgagcgcgcgcgatccgggtaatgatcttcacaagagcgactccgatctgtgctgcgagattcgcaaggtggagcccatggcgcgcgcggtggagccgtattccgcctggttcaccggccgcaagcgccaccaggcggagtcgcgggcgcaaatgccggtattcgaggcggttggtccgcgcattcgcatcaacccgctcgcccgctggaccacggccgaccaggccgcctatatgcgcgcgaacgacctgcgcgagaatccgctggtggcctatggctatctctcgatcggctgctttccctgcacgcagcccgtgaagcccggcgaggatcaacgcagcgggcgctgggcaggcttggctaaaaccgaatgcggcatccatctgccgggtcttgaagctctcaccaacgcggcgtga

SEQ ID NO: 5891 - protein, 245 aa, Mesorhizobium sp. BNC1
MAAKPKPLDAEIEALELDARYGHLAAEAIVELAVNRFRDEGGIATVSSFGADSAVLLHMVASVDKSLPVLFLDTGQHFGETIEYRDQLASDLGLSNLVVVHPKSEMLSARDPGNDLHKSDSDLCCEIRKVEPMARAVEPYSAWFTGRKRHQAESRAQMPVFEAVGPRIRINPLARWTTADQAAYMRANDLRENPLVAYGYLSIGCFPCTQPVKPGEDQRSGRWAGLAKTECGIHLPGLEALTNAA

SEQ ID NO: 5892 - DNA, 804 bp, Trichodesmium erythraeum IMS101
  CDS (1)..(804): transl_table=11
atgctacaacagagtttaatcagactcaataaaaatggacaatacaattatcaagattacaggtatttaccagaactagatcttggggttgttaatcaggaacttagtcaagcagatcctcacactttagtacagtgggggttaaaaatttttaaggaaggtctggttatgagtaccagttttggtattcaggctgctgttatgttacacctagttacaagtgttatacctaatattcctgttatctggattgatacaggatatttaccagccgaaacctataaatttgctgaagagttgatagaacgactgaaacttaatgtgaaagtttatcagtcacatattagtccaggtcggatggaagctttatatggcagactttgggcagaaaaagatcttgaggctcttaaccgctatgaccaaattcgcaaagtagaacccatgcaacgagcattgagagagctgaaggccactgcttggttagctgggttaaggggagaacaaaccaagcaccgccaaagtttagatcgcattagtaaacagtcgaatatatataaaattttaccaatactcaattggaatgcacgggatatttatcaatatttaactgctcataatttaccatatcatccattttttgatttgggatacactactgtaggagattggcattctagtcggcctcttactactgatgatcaagatgaacgggatactcgcttttatggtcttaagcaggagtgtgggctacatttgcctcaaacacaagaagaggctcaaagtcttgattctagtttattgtaa

SEQ ID NO: 5893 - protein, 267 aa, Trichodesmium erythraeum IMS101
MLQQSLIRLNKNGQYNYQDYRYLPELDLGVVNQELSQADPHTLVQWGLKIFKEGLVMSTSFGIQAAVMLHLVTSVIPNIPVIWIDTGYLPAETYKFAEELIERLKLNVKVYQSHISPGRMEALYGRLWAEKDLEALNRYDQIRKVEPMQRALRELKATAWLAGLRGEQTKHRQSLDRISKQSNIYKILPILNWNARDIYQYLTAHNLPYHPFFDLGYTTVGDWHSSRPLTTDDQDERDTRFYGLKQECGLHLPQTQEEAQSLDSSLL

SEQ ID NO: 5894 - DNA, 774 bp, Synechococcus sp. CC9311
  CDS (1)..(774): transl_table=11
atgagggatgtgtccacctccaagaatcagcctgtcgttgccgctggccccaaggctgaggcggcagaactccaacacgcgcgtgagcagcttgagccgttggatgcgcgcgcaaggttgctatgggcctatgagcagtttgggtcgggttttgccctgacaacgagcttcggaatccaatcctctgtgttgctgcacttgttgagcgggatggatcgaggccgagatattccagtgatctgggtggataccggctatctcccccctgagacctatcgctacgccgaagatcttcgcgaacgcttcgatctgaatctccacatcgctcagtcttcctcgtctgcagctcggatggaggcgctccatggccgcctctgggaatcaggtgttgttgaggacatggagctctacctcaaaatccgcaaggtagagccccttgaagaagcgatgcatcgtcttcaggtgtcttgctgggcgagcggtgtgcgccgtgctcagacggatacacgccgaagcatgactgcgctcgatcccattcgcggtcgcttgtccctgaggccgctattggagtggacctcacgcgatgtcttctactacatgaaggagaacgatcttcctcagcaccccttatttgatcaggggtattccacggttggagactggcactccagtggccctgacgggcaggaggcgacgggacgagacactcgctttgctggcctgaagcaggaatgtggcatccacgtgccaggtgttatgggtgatggcatctag

SEQ ID NO: 5895 - protein, 257 aa, Synechococcus sp. CC9311
MRDVSTSKNQPVVAAGPKAEAAELQHAREQLEPLDARARLLWAYEQFGSGFALTTSFGIQSSVLLHLLSGMDRGRDIPVIWVDTGYLPPETYRYAEDLRERFDLNLHIAQSSSSAARMEALHGRLWESGVVEDMELYLKIRKVEPLEEAMHRLQVSCWASGVRRAQTDTRRSMTALDPIRGRLSLRPLLEWTSRDVFYYMKENDLPQHPLFDQGYSTVGDWHSSGPDGQEATGRDTRFAGLKQECGIHVPGVMGDGI

SEQ ID NO: 5896 - DNA, 798 bp, Shewanella sp. MR-4
  CDS (1)..(798): transl_table=11
atggctgatcttgattctggggtgacgggttccggcttgccgaacgcgttgcagagcgtggtaagtcacagcgaacttaaagcgctgctgacggcgcctaaggatgtgcagcgagcggaactggaacgcattaatcgcttcttggccggattgacggctcaagaacgagtgctctggggcttagcctatttgccgggtaatcacgcgctgtcatccagttttgggatccaggcggcggtgatgctgcatatggtgagtcaggtgcaatcggatattccggtgatcttaacggatactgggtatctctttcctgagacataccagtttattgaccagcttaccgagcgcttatccttaaacctcaaggtttaccaagcgccgatgacctcggcatggcaggaagcgcgttttggcaagctgtgggagcagggcttagatgggctcgagcgttacaatcgactgaataaagtggagccgatgcaacgtgctttggcagaacttgaagtcggcacttggtttgcgggacttcgtcgcagtcagtcgagcactcgcgaagagttaccgatattggctatccacggaactcgctttaagctgcttccgattatcgagtggtcgaacaaagatgtgcatttgtatctgacgcaatttgacttgccttaccatccgctatgggatcaagggtatgtttctgttggggatacccattcgagtaaacccttagaattagggatgactgaagaagaaacccgctttaatggcttaaaacgcgaatgcggtttgcattacgaaatatag

SEQ ID NO: 5897 - protein, 265 aa, Shewanella sp. MR-4
MADLDSGVTGSGLPNALQSVVSHSELKALLTAPKDVQRAELERINRFLAGLTAQERVLWGLAYLPGNHALSSSFGIQAAVMLHMVSQVQSDIPVILTDTGYLFPETYQFIDQLTERLSLNLKVYQAPMTSAWQEARFGKLWEQGLDGLERYNRLNKVEPMQRALAELEVGTWFAGLRRSQSSTREELPILAIHGTRFKLLPIIEWSNKDVHLYLTQFDLPYHPLWDQGYVSVGDTHSSKPLELGMTEEETRFNGLKRECGLHYEI

SEQ ID NO: 5898 - DNA, 798 bp, Shewanella sp. MR-7
  CDS (1)..(798): transl_table=11
atggctgatcttgattctggggtgacgggttccggcttgccgaacgcgttgcagagcgtagtaagtcacagcgaactgaaagcgctgctgacggcgcctaaggatgtgcagcgagcggaactggaacgcattaatcacttcttggccggattgacggctcaagagcgagtgctctggggcttagcctatttgccggggaatcacgcgctgtcatccagttttgggatccaggcggcggtgatgctgcatatggtgagtcaggtgcaatcggatattccggtgatcttaacggatactgggtatctctttcctgagacatatcagtttattgaccagctcaccgagcgcttatccttaaacctcaaggtttaccaagcgccgatgacctcggcatggcaggaagcgcgttttggcaagctgtgggagcagggcttagatgggctcgagcgttataatcgactgaataaagtggagccgatgcaacgtgctttggcagaacttgaagtcagcacttggtttgcaggacttcgtcgtagccagtcgagcactcgcgaagagttaccgatattggctatccacggtactcgctttaagctgctgccgattatcgaatggtcgaacaaagatgtgcacttgtatctgacgcaatttgacttgccttaccatccgctatgggatcaagggtatgtttctgttggggatacccattcgagtaaacccttagaattagggatgactgaagaagaaacccgctttaatggtctaaaacgtgaatgcggtttgcattacgaaatatag

SEQ ID NO: 5899 - protein, 265 aa, Shewanella sp. MR-7
MADLDSGVTGSGLPNALQSVVSHSELKALLTAPKDVQRAELERINHFLAGLTAQERVLWGLAYLPGNHALSSSFGIQAAVMLHMVSQVQSDIPVILTDTGYLFPETYQFIDQLTERLSLNLKVYQAPMTSAWQEARFGKLWEQGLDGLERYNRLNKVEPMQRALAELEVSTWFAGLRRSQSSTREELPILAIHGTRFKLLPIIEWSNKDVHLYLTQFDLPYHPLWDQGYVSVGDTHSSKPLELGMTEEETRFNGLKRECGLHYEI

SEQ ID NO: 5900 - DNA, 738 bp, Alkalilimnicola ehrlichei MLHE-1
  CDS (1)..(738): transl_table=11
atggccaacagaccacaggcattgaagatccacccccagccggttctcgcccccggggagctcgactcggtccgacggcaactggcggcggcatcggcgcaggagcgtgtgcgctggggcctcgcccgcttccccggacgcattgtcctcgcctccagcttcggggcgcaggccgcggtgtccctgcacctggtgacccgtgaacagcccgacatccccgtggtactggtggataccggctatctcttcccggagacctaccgctttgtggacgagctcactgaacggctcggtctcaaccttcaagtcgcccgcccggcgcactccgcggcctggcaggaggcgcgcttcggccgtctctgggagcagggcgtcgaggggatcgaacgctacaatcggatgaacaaggtcgagcccatgcagcaggccctggagaccttgggggccgacgcctggtttgccgggctgcgccggcagcaggcgcactcgcggcaacaacggcaggtggtcgagatccagaacgaccgggtcaaggtgcatccgatcatcgactggacagaccgggatgtccaccgctacctgacccgccacgacctgccctaccaccccctctggcacgaaggctacgtctccatcggcgacgtccacaccacccgccggctcgccgacggcatgagcgaggaggagacgcgcttcttcggcctgcgccgggagtgcggtctgcacgacctggtctga

SEQ ID NO: 5901 - protein, 245 aa, Alkalilimnicola ehrlichei MLHE-1
MANRPQALKIHPQPVLAPGELDSVRRQLAAASAQERVRWGLARFPGRIVLASSFGAQAAVSLHLVTREQPDIPVVLVDTGYLFPETYRFVDELTERLGLNLQVARPAHSAAWQEARFGRLWEQGVEGIERYNRMNKVEPMQQALETLGADAWFAGLRRQQAHSRQQRQVVEIQNDRVKVHPIIDWTDRDVHRYLTRHDLPYHPLWHEGYVSIGDVHTTRRLADGMSEEETRFFGLRRECGLHDLV

SEQ ID NO: 5902 - DNA, 735 bp, Hyphomonas neptunium ATCC 15444
  CDS (1)..(735): transl_table=11
atggcctttgaaaccgacacattcgaggagcccaaagaccggctcgcgcgccttaacggagaactccggaatgcgtccgcgcaggaaatcctccgcgccgccatttcccgcgaatggcccggcgggctcacctatgtgtccagtttcggcgccgaaagcgtcgtcatgctcgccctcatcgctgaggtcgatccctccctgccaatcgtcttcatcgacaccggcatgcatttccctcagacgctggactataaagacgaggtcatcgaacgcctcggcctcaccggcgtgcgcaatatcacgcccagcgagactgagcgcaaagtgctcgaccccaagaacatgctctggaaaaccgatgccgacgcctgctgcgccctgcgcaaggtgcgcccgctggagccggcgctggagggcttcggcgcctgggtcacgggccgtaaacgcttccatggcggcgtccggatgagcctgccggtgtttgaatttgccgatggccgctacaaggtgaacccgctcgccaactggacgcaaggcgacgtggacgcctatctcgaagagaaaaacctgccccgccacccgctggtctcgcaaggctatccttcgatcggctgctggccctgcacccagcctgccgcagaccccaacgacccccgttcgggccgctgggtcggccaggaaaagtccgaatgcggactgcacgtcgaacgcaatgaacggccacgggttttctga

SEQ ID NO: 5903 - protein, 244 aa, Hyphomonas neptunium ATCC 15444
MAFETDTFEEPKDRLARLNGELRNASAQEILRAAISREWPGGLTYVSSFGAESVVMLALIAEVDPSLPIVFIDTGMHFPQTLDYKDEVIERLGLTGVRNITPSETERKVLDPKNMLWKTDADACCALRKVRPLEPALEGFGAWVTGRKRFHGGVRMSLPVFEFADGRYKVNPLANWTQGDVDAYLEEKNLPRHPLVSQGYPSIGCWPCTQPAADPNDPRSGRWVGQEKSECGLHVERNERPRVF

SEQ ID NO: 5904 - DNA, 804 bp, Pseudomonas aeruginosa UCBPP-PA14
  CDS (1)..(804): transl_table=11
atgccgccctttgctaccattcccgccacagagcgcaacagcgccgcccagcaccaggaccccagcccgatgagccagcctttcgaccttcccgccctcgcttccagccttgccgacaaatccccccaggacatcctgaaagccgccttcgagcacttcggcgacgagctgtggatctccttcagcggcgccgaggacgtcgtcctggtagacatggcctggaagctcaaccgcaacgtgaaggtgttcagcctcgacaccggtcgcctgcacccggaaacctatcgtttcatcgaccaggtccgcgaacactacggcatcgccatcgacgtgctttcccccgacccgcgcctgctcgaacccctggtgaaggaaaagggcctgttcagcttctaccgggacggccacggcgagtgctgcggcatccgcaagatcgaaccgctcaagcgcaagctcgccggcgtgcgcgcctgggccaccggccaacgccgcgaccagagccccggcacgcgcagccaggtggcggtgctggaaatcgacggtgccttttccacgccagaaaagccgctgtacaagttcaacccgctgtcgtccatgaccagcgaggaagtctggggctatatccgcatgctcgaactgccctacaacagcctgcacgaacgcggctatatcagcatcggctgcgaaccctgcacccgtccggtgctgcccaaccagcacgagcgcgagggccgctggtggtgggaggaagccacccacaaggagtgcgggctgcacgccggcaacctgatcagcaaggcctga

SEQ ID NO: 5905 - protein, 267 aa, Pseudomonas aeruginosa UCBPP-PA14
MPPFATIPATERNSAAQHQDPSPMSQPFDLPALASSLADKSPQDILKAAFEHFGDELWISFSGAEDVVLVDMAWKLNRNVKVFSLDTGRLHPETYRFIDQVREHYGIAIDVLSPDPRLLEPLVKEKGLFSFYRDGHGECCGIRKIEPLKRKLAGVRAWATGQRRDQSPGTRSQVAVLEIDGAFSTPEKPLYKFNPLSSMTSEEVWGYIRMLELPYNSLHERGYISIGCEPCTRPVLPNQHEREGRWWWEEATHKECGLHAGNLISKA

SEQ ID NO: 5906 - DNA, 1281 bp, Solibacter usitatus Ellin6076
  CDS (1)..(1281): transl_table=11
ttggataatctccccgaattcgaggcggcaaccgcctccgaagtcctttcctgggctatcgatacttttggcgagtccttcgcgattgcaaccagctttcaaaaggaaggcatggcaatcgtggatctggcctcgcgtatctcctccgaaattcgggttttcacattagacacgggccgtctgccggatgagacctaccagatgatggaaatggtccggcggcgctatggaattcaggtggaagtgatcttccccgaccgggcggaggtggaatctctggtcacgatccacggccccaacctattctatgcgagcgttcccggacgggaacgctgctgcgaagtgcgcaaggtccgtccgctggagcgcaagctgcaaagcctgaaggcttgggcgaccgggctgcgccgcgatcaatccgcgacacgctccgccgttcccaaggttgcgcgggtggacggccggctcaagctcaatccactggccgattggacggccgcgcaggttgaagaataccttgcgcggcacaacgttccgctccaccctctctatgagcgcggttataccagcatcggctgcgccccgtgcacgcgcccggttgagcctggcgaaagcgagcgcgccggacgctggtggtgggaagaagacgccaagaaagaatgtggaattcactttgccgccgatggcagtatgcgccgcggccaggcaggcgaggcacaagaggacgagatgcataaaggattcacgctgtggtttaccggcatgagcggcgccggcaagagtaccatctcccgccaactcgagttgaaactgcgtgagcgcggcgcacgtgtggaggtgctagacggcgatgtggtgcgcacccatctttccaaggggctcggcttcagcaaggaagatcgcgacgaaaacatccgccgcatcggcttcgtctgcgagctgctctcgcgcaatggcgtgatcgcgatcgcggcggcgatctctccgtaccgcgcggtccgcgacgaagtgcgcgcgcgcatccccaatttcgtggaggtctacgtggagtgtcccgtggaggtgctggcggagcgtgacgtcaaaggactctacaaacgtgcgcttgccggagagatcgcgcacttcaccggcatctccgacccgtacgaagccccgctggctccgcaggtcaccgtgaactcctcgcaggaaacacccgaacagagcgtagagaaaatctgggctacactggaacgtttgggtctggtttcctttgatcgatctccactcgcacactaa

SEQ ID NO: 5907 - protein, 426 aa, Solibacter usitatus Ellin6076
MDNLPEFEAATASEVLSWAIDTFGESFAIATSFQKEGMAIVDLASRISSEIRVFTLDTGRLPDETYQMMEMVRRRYGIQVEVIFPDRAEVESLVTIHGPNLFYASVPGRERCCEVRKVRPLERKLQSLKAWATGLRRDQSATRSAVPKVARVDGRLKLNPLADWTAAQVEEYLARHNVPLHPLYERGYTSIGCAPCTRPVEPGESERAGRWWWEEDAKKECGIHFAADGSMRRGQAGEAQEDEMHKGFTLWFTGMSGAGKSTISRQLELKLRERGARVEVLDGDVVRTHLSKGLGFSKEDRDENIRRIGFVCELLSRNGVIAIAAAISPYRAVRDEVRARIPNFVEVYVECPVEVLAERDVKGLYKRALAGEIAHFTGISDPYEAPLAPQVTVNSSQETPEQSVEKIWATLERLGLVSFDRSPLAH

SEQ ID NO: 5908 - DNA, 798 bp, Shewanella sp. ANA-3
  CDS (1)..(798): transl_table=11
atggctgatcttgattctggggtaacgggttctggcttgccgaacgcgttgcagagcgtggtaagtcacagcgaacttaaagcgctgctgacggcgcctaaggatgtgcagcaagcggaactggagcgcattaatcgcttcttggccggattgacggctcaagagcgagtgctctggggcttagcctatctgccgggtaatcacgcgctgtcatccagttttgggatccaggcggcggtgatgctgcatatggtgagtcaggtgcaatcggatattccggttatcttaacggatactggctatctctttcctgagacatatcagtttattgaccagcttaccgagcgtttatccttaaacctcaaggtttaccaagcgccaatgacctcggcatggcaggaggcgcgttttggcaagttgtgggagcagggcttagatgggctcgagcgttacaatcgactgaataaagtggagccgatgcaacgtgctttggcggaacttgaagtaggtacttggttcgcgggactacgccgcagccagtcgagcacacgcgaagagttaccgatattggctatccatggcactcgctttaagttgttgccgattatcgagtggtcgaacaaagatgtgcatctgtatctgacgcaatttgacttgccttaccatcctctatgggatcaaggttatgtttctgttggggatacccactcgagtaaacccttagaattagggatgactgaagaagaaacccgctttaatggcttaaaacgcgaatgcggtttgcattacgaaatataa

SEQ ID NO: 5909 - protein, 265 aa, Shewanella sp. ANA-3
MADLDSGVTGSGLPNALQSVVSHSELKALLTAPKDVQQAELERINRFLAGLTAQERVLWGLAYLPGNHALSSSFGIQAAVMLHMVSQVQSDIPVILTDTGYLFPETYQFIDQLTERLSLNLKVYQAPMTSAWQEARFGKLWEQGLDGLERYNRLNKVEPMQRALAELEVGTWFAGLRRSQSSTREELPILAIHGTRFKLLPIIEWSNKDVHLYLTQFDLPYHPLWDQGYVSVGDTHSSKPLELGMTEEETRFNGLKRECGLHYEI

SEQ ID NO: 5910 - DNA, 711 bp, Mycobacterium smegmatis str. MC2 155
  CDS (1)..(711): transl_table=11
gtgaccgacgtgacgacgtcaacggagaacgaactgcgcgaactcgccgagcgcggcgcggccgagctcgcggacgcgagcgccgaggagctgctgcgctggaccgacgagcacttcggcggcaactacgtggtggcatcgaacatgcaggacgcggtgctcgtcgagatggccgccaaggtgcgtcccggcgtggacgtgctgttcctcgacaccggataccacttcgccgagaccatcggcacgcgtgatgccgtcgaggcggtctacgacgtgcacgtggtcaacgtgacccccgagcgcaccgtcgccgagcaggacgaactgctgggtaagaatctgttcgcgcgcgaccccggtgagtgctgccggctgcgcaaggtggtgccgctgaccaacgcgctcaagggctactcggcgtgggtcaccggcatccgccgggtcgaggcgcccacccgcgccaacgccccgctgatcagctgggacaacgcgttcggcctggtgaagatcaacccgatcgcggcgtggaccgacgaggacatgcagaactacatcgacgccaacggcatcctggtcaatccccttgtctacgaaggttatccgtcgatcggctgcgcgccctgcaccagcaagccgattcccggggccgatccgcgcagtggccgctgggccgggctgtccaagaccgaatgcgggctgcacgtctcgtga

SEQ ID NO: 5911 - protein, 236 aa, Mycobacterium smegmatis str. MC2 155
MTDVTTSTENELRELAERGAAELADASAEELLRWTDEHFGGNYVVASNMQDAVLVEMAAKVRPGVDVLFLDTGYHFAETIGTRDAVEAVYDVHVVNVTPERTVAEQDELLGKNLFARDPGECCRLRKVVPLTNALKGYSAWVTGIRRVEAPTRANAPLISWDNAFGLVKINPIAAWTDEDMQNYIDANGILVNPLVYEGYPSIGCAPCTSKPIPGADPRSGRWAGLSKTECGLHVS

SEQ ID NO: 5912 - DNA, 702 bp, Nocardioides sp. JS614
  CDS (1)..(702): transl_table=11
atgaagacaccctccgagatcagcaggcttcgctcgctggtggcacagcgcgcgcgcgatctggaaggcgcctccgctgaggccgtgatcagctgggcgcaggagaccttcggagcccggctgtgcgcgacgtcctcgatgggcgacgtcgtcatcgtgcaccaggtgtctcggtacgcaccgggtctggatgtgctcttcctggataccggctaccacttcgcggagacgctggcctttcgtgagctcgtgtcgtcgtcgtacgacgtgaacgtggtcgacctccgaccggaacgcagcgtcgaagagcagttgcagctctgggaccgcgacctgttcgactccgatccggacggttgctgccggcttcggaaggtccttcccctgcggcgcgcactgacggggtatgacgcgtgggtcaccgggatcaggagggcggactccccgcggcgggcggagactccagtgctggcgtgggacgaggtcaaccaggtcgtgaaggtggcgcctttggcgacctggacccgcgagatggtggagggctacctcgaggaccacgcactcccccgcaaccggctaacggagctcggttacacgtcgatcggatgccaaccctgcacctctctgcccaccgggctggacccgcggtctggccggtggcccgggctgcagaagaccgagtgcggactccatcggacctag

SEQ ID NO: 5913 - protein, 233 aa, Nocardioides sp. JS614
MKTPSEISRLRSLVAQRARDLEGASAEAVISWAQETFGARLCATSSMGDVVIVHQVSRYAPGLDVLFLDTGYHFAETLAFRELVSSSYDVNVVDLRPERSVEEQLQLWDRDLFDSDPDGCCRLRKVLPLRRALTGYDAWVTGIRRADSPRRAETPVLAWDEVNQVVKVAPLATWTREMVEGYLEDHALPRNRLTELGYTSIGCQPCTSLPTGLDPRSGRWPGLQKTECGLHRT

SEQ ID NO: 5914 - DNA, 747 bp, Nocardioides sp. JS614
  CDS (1)..(747): transl_table=11
atgaccgcggcgaccacgaactcggctcgcaacttccgtggcatcgagaccgctggccgctcctccgaggagctgcgcgagctggtgtcccactggggcgccgagctcgagctcgcgcccgccgaggacatcgtcgagtgggcggtggcgaccttcggcgagaggttctgcgtgacgtcgtcgatggcggatgccgtcctcgcgcacctggtctcccgcgtcgcgccggggatcgacgtgctcttcctggacaccggctaccacttcgccgagacgatcgggacccgggacgcggtccaggcgacgctgccggtcaacctgatcacgatcaccccggtgcagtcggtcgccgagcaggacgcggcgtacggcacggacctctacaagaccgaccccgacctgtgctgcgcgctgcgcaaggtgcagccgctcgcggacgccctcgaggggtacgacgcgtgggcgaccgggctgcgccgcgccgagacccagcaccgcgtgatcgccccggtcatcggctgggacgccaagcgcggcaaggtcaaggtctcgccgctggcacgctggaccgacgaggagatcgagcgctacatcgccgaccacgacgtgctggtgaacccgctcgcgtacgacggctacccgtccatcggctgctggccctgcacacgccgcgtggctcccggcgaggacccacgcagcggccgttgggccggcaccaccaagaccgagtgcgggatccactcatga

SEQ ID NO: 5915 - protein, 248 aa, Nocardioides sp. JS614
MTAATTNSARNFRGIETAGRSSEELRELVSHWGAELELAPAEDIVEWAVATFGERFCVTSSMADAVLAHLVSRVAPGIDVLFLDTGYHFAETIGTRDAVQATLPVNLITITPVQSVAEQDAAYGTDLYKTDPDLCCALRKVQPLADALEGYDAWATGLRRAETQHRVIAPVIGWDAKRGKVKVSPLARWTDEEIERYIADHDVLVNPLAYDGYPSIGCWPCTRRVAPGEDPRSGRWAGTTKTECGIHS

SEQ ID NO: 5916 - DNA, 849 bp, Nocardioides sp. JS614
  CDS (1)..(849): transl_table=11
atgacgacgtacgacaggagaagcacggtgaccatcgtcgacgcgaggactgcctccaacccggccgagcgcgtggtcttcgacgacctcgagatcggcgagatcgccgtcgacctcgatgaccaggagcccgaggacgtcatcgcctgggcactcgaggagctcggtgatcggatcgccatcgtgacggccctgcaggtggacggcatggtcgtgctggacatggcgacccgtctccggccggacatccgggtcgtgacggtcgacaccggccggctcccggacgcaaccctgcgcttcatcgacgaggcccgggcgcactacccccggacccgctgggacgtgctccacccggacgcggccgaggtccaggcgatggtcgccgagcgcggcgtcgacctgtttcgctccagtgtcgccgaccggatgcggtgctgccaggtccggaaggtccggccgctcacccaggcgctgcgcgggctggacgggtggttcaccgggttgcggcgcgaccagtgggcctcgcgcgcggcgatcaagaaggtcgagctggaccacgaccacggtggcatcgtgaaggtcaacgccctggccgactgggcgagcgccgacgtgtggggctacgtcgaggagcacggtgtcccagtgcatccgctgtacgcgcagggttacacgagcctgggctgcggcccctgcacccgacctgtcgcggtgggagaggacgaccgtgccggtcgctggtggtgggagaagggcgcgcccaaggagtgcggcatccactgcccgatcgagaccggcagcttcgagcacgaggcggcagagatcctggcgtcgtcgacgcacgcgtga

SEQ ID NO: 5917 - protein, 282 aa, Nocardioides sp. JS614
MTTYDRRSTVTIVDARTASNPAERVVFDDLEIGEIAVDLDDQEPEDVIAWALEELGDRIAIVTALQVDGMVVLDMATRLRPDIRVVTVDTGRLPDATLRFIDEARAHYPRTRWDVLHPDAAEVQAMVAERGVDLFRSSVADRMRCCQVRKVRPLTQALRGLDGWFTGLRRDQWASRAAIKKVELDHDHGGIVKVNALADWASADVWGYVEEHGVPVHPLYAQGYTSLGCGPCTRPVAVGEDDRAGRWWWEKGAPKECGIHCPIETGSFEHEAAEILASSTHA

SEQ ID NO: 5918 - DNA, 771 bp, Azoarcus sp. BH72
  CDS (1)..(771): transl_table=11
gtgagcggcgcggtgtcgatgctgcgtccggcagccacgaatccggccacccgccccgagctgaccgaggcgctgcgcgccagcgtcagcgccaaggccgcggccgcgcgcgagttgctggccgccgcggtggccgaactcggtgccaatggcgagatcaccttcgccaacagcttcggcgccgaggacatggtgctgaccgacctgatcctgggcggcaagctgccgatcgagatcttctcgctcgacaccggccgcctgccggccgaaacctatacgctgatgggcgcagtcgagcagcgttacggcacgaagctgaaggtgttcttcccggacgcgaccgcggtcgagcagttcgtccgcagcgagggcatcaatgcgttctacgattcggtggagctgcgcaaggcctgttgcggcatccgcaagatggagccgttgcgccgcgcgctggccggcaagaaggcgtgggtgaccgggctgcgcgccgcgcagtcggtgacgcgtacgggccttgcgctgcgcgaattcgacaccgccaacgggctggagaaattcaacccgctgtccgactggacggaggccgaggtatgggcgtatatccggatcaacgaggtgccctacaacgcgctgcacgaccagttctatccgagcatcggctgcgcaccctgtacgcgcgcgatcgcgctgggcgaggacatccgcgccggccgctggtggtgggaagatcccgcttccaaggaatgcggtctgcacgtcaagaagacttga

SEQ ID NO: 5919 - protein, 256 aa, Azoarcus sp. BH72
MSGAVSMLRPAATNPATRPELTEALRASVSAKAAAARELLAAAVAELGANGEITFANSFGAEDMVLTDLILGGKLPIEIFSLDTGRLPAETYTLMGAVEQRYGTKLKVFFPDATAVEQFVRSEGINAFYDSVELRKACCGIRKMEPLRRALAGKKAWVTGLRAAQSVTRTGLALREFDTANGLEKFNPLSDWTEAEVWAYIRINEVPYNALHDQFYPSIGCAPCTRAIALGEDIRAGRWWWEDPASKECGLHVKKT

SEQ ID NO: 5920 - DNA, 726 bp, Nostoc punctiforme PCC 73102
  CDS (1)..(726): transl_table=11
atgacagtctccacggcatctagaaatcaagcgatcgcttttgacttagaaaaattaaatgagcaatttgaaactgccactcctaaagagatactggcatggtctatagagaatatcccaacgggattggtgcaaaccagcgcctttaacgtggatgacatgataattacccatattctttacagtgaactgaagcatcccgttcctgtgatctttctcgacactttacatcacttccctgagagcctagaattagtagccaaagccaaagaaatctacaatctggacttgcaaactttcaaaactccagacgtagaaacccgtgaagcctttgaagccaaatacggcgacaaactttgggatacggatattgccaaattccaccacattacaaaaattgaaccactgttacggggtctagacgaactcaacagcgtggcttggattaccggtcgccgccgtgaccaagcagtaacccgtgcgaatatgcccatatttgaatttgatggtaaaggtcggttgaaagtaaatcccattgctacctggacacgtcaagatacctgggtttacgtagctgaacacggagtcatctacaacccactccatgacaaaggctatcccagcataggcgaccaacccatcaccaccaaagtaggcgaaggtgaagacgaacgcgccggacgttggcggggaagtgataaaacagaatgcggaattcatatttag

SEQ ID NO: 5921 - protein, 241 aa, Nostoc punctiforme PCC 73102
MTVSTASRNQAIAFDLEKLNEQFETATPKEILAWSIENIPTGLVQTSAFNVDDMIITHILYSELKHPVPVIFLDTLHHFPESLELVAKAKEIYNLDLQTFKTPDVETREAFEAKYGDKLWDTDIAKFHHITKIEPLLRGLDELNSVAWITGRRRDQAVTRANMPIFEFDGKGRLKVNPIATWTRQDTWVYVAEHGVIYNPLHDKGYPSIGDQPITTKVGEGEDERAGRWRGSDKTECGIHI

SEQ ID NO: 5922 - DNA, 831 bp, Crocosphaera watsonii WH 8501
  CDS (1)..(831): transl_table=11
atgccccaatctaatctacatctcatcaactctcatgtagataaccatcaggtttccgaacatcactacaacaagcaaactcatcaagcttataaacctgaattatccttaaaagaagttaaccaaagcctagaaaatgccaacgctcaacaggttgtagaatggactagggagacctttggggaaggattagtcatgagtaccagttttggtattcaagctgctgtgatgctgcatctagtgaccgaagtagtgccagatattcccgttatctgggtggatacaggctatcttcctgctgaaacctatcgctttgccgaagaattaaccgaacggctcaaactcaatctcaaggtttatcagtctcctttcacccctgcgagaatggaagcactgtatggtaaactctggaatcaacacgatctaaattctcttaatcgttacgattttctccgaaaagtagaacccatgcaacgagctttgaaagaacttcaagccactgcttggttggcggggttacgtcgtcaacaaacggaacatagacagtccttagaaaaagttgaattacaaggggaaaagtacaaagtttatcctattttaacctgggattctcgcgatatttatcattatttaactgctcatgatttgccttatcatccttattttgataaaggctatgttacggtaggagactggcattctagtcgtccgttgatggctgatgatgaaagtgaaagagatagtcgttttcatggtgttaaacaagagtgtggcctccatttaaacttgtctcctggagcagcagaaagtttagattctagcaccctttaa

SEQ ID NO: 5923 - protein, 276 aa, Crocosphaera watsonii WH 8501
MPQSNLHLINSHVDNHQVSEHHYNKQTHQAYKPELSLKEVNQSLENANAQQVVEWTRETFGEGLVMSTSFGIQAAVMLHLVTEVVPDIPVIWVDTGYLPAETYRFAEELTERLKLNLKVYQSPFTPARMEALYGKLWNQHDLNSLNRYDFLRKVEPMQRALKELQATAWLAGLRRQQTEHRQSLEKVELQGEKYKVYPILTWDSRDIYHYLTAHDLPYHPYFDKGYVTVGDWHSSRPLMADDESERDSRFHGVKQECGLHLNLSPGAAESLDSSTL

SEQ ID NO: 5924 - DNA, 714 bp, Xylella fastidiosa Dixon
  CDS (1)..(714): transl_table=11
atgaccgtacttcccgccttacctcctctggacgatctggaaacgctcaacgtccacctagaaacgctgagtgctgaaaatcgcgtgtgctgggcactgcagcacgcccctgaccaccctgcactgtcttccagcttcggcgcgcaatcggccgtcatgctgcatctactcacccggtttgcaccggatatcccggtcattctggtcgacaccggctatcttttcccagaaacctaccgtttcgccgacacgctgaccgaacgactcaaactcaatctgaaggtataccagccgctgcgtagcggcacttggacggaagcccgtcatggtcgactatgggaacaagggatcgacggaattaatcaatacaacaccctgcacaaggtcgaaccgatgcgccgggcattagaggaattgcaagtcggcacctggtttaccggcctacgtcgcggacaatccagtacccgtacccaaacatcaatcgtgcaacgacgtgacgagcggtacaaaatcagtccaattgtcgactggaccgaccgtgatatctgggaatacatgaaacaccatgatctgccctatcacccgctttgggaacagggctacgtttcaatcggtgacattcacacgacacgccccttggaaccagacatgcgcgaagaagacacacgcttcttcggattcaaacgtgagtgcgggattcacgagaacatctaa

SEQ ID NO: 5925 - protein, 237 aa, Xylella fastidiosa Dixon
MTVLPALPPLDDLETLNVHLETLSAENRVCWALQHAPDHPALSSSFGAQSAVMLHLLTRFAPDIPVILVDTGYLFPETYRFADTLTERLKLNLKVYQPLRSGTWTEARHGRLWEQGIDGINQYNTLHKVEPMRRALEELQVGTWFTGLRRGQSSTRTQTSIVQRRDERYKISPIVDWTDRDIWEYMKHHDLPYHPLWEQGYVSIGDIHTTRPLEPDMREEDTRFFGFKRECGIHENI

SEQ ID NO: 5926 - DNA, 714 bp, Xylella fastidiosa Ann-1
  CDS (1)..(714): transl_table=11
atgaccgtacttcccgccttacctcctctggacgatctagaaatgctcaacgtccacctagaaacgctgagtgctgaaaatcgcgtgcgctgggcactggagcacggtcctgaccaccctgcactgtcttccagcttcggcgcgcaatcggccgtcatgctgcatctactcacccggtttgcaccggatatcccggtcattctggtcgacaccggctatcttttcccagaaacctaccgtttcgccgacacgctgaccgaacgactcaagctcaatctgaaggtataccaaccgctgcgtagcggcgcttggacggaagcccgtcatggtcgactatgggaacaagggatcgacggaattaatcaatacaacaccttgcacaaggtcgaaccgatgcgccgggcattagaggaattgcaagtcggcacctggtttacaggcctacgtcgcggacaatccagtacccgtacccaaacatcaatcgtgcaacgacgtgacgagcggtacaaaatcagtccaattgtcgactggaccgaccgtgatatctgggaatacatgaaacaccatgatctgccctatcacccgctttgggaacagggctacgtttcaatcggtgacattcacacgacacgccccttggaaccagacatgcgcgaggaagacacacgcttcttcggattcaaacgtgagtgcgggattcacgagaacatctaa

SEQ ID NO: 5927 - protein, 237 aa, Xylella fastidiosa Ann-1
MTVLPALPPLDDLEMLNVHLETLSAENRVRWALEHGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQRRDERYKISPIVDWTDRDIWEYMKHHDLPYHPLWEQGYVSIGDIHTTRPLEPDMREEDTRFFGFKRECGIHENI

SEQ ID NO: 5928 - DNA, 741 bp, Roseovarius nubinhibens ISM
  CDS (1)..(741): transl_table=11
atgcagccgaatgaggatcttggcacacgggtctccgggctcaacgactggtaccggctgaactcggccaccagcgtgctgcgccacgcgctcacggatcccgccgcgggtcagctggcgctggtgtcgagcttcggggcggaatcggtcgtgctcttgcacatggtgtcggtgatcgaccggaccaccccggtgatctttctcgacaccgagctgctctttgccgaaacgctggtctaccagcaggagctgagcgagcggctcggcctcaaggatctgcgcatcattcgcgcggacccggacgaggttcaggccaccgacccggaacagtcgctacaccgacgcgataccgacgcctgctgtacgctgcgcaagacccggcccttggcccgtgctcttgacgggttcgacggctggatcaccgggcgcaaacgctatcagggcggtgcccgcgccacgctcgatttcttcgagaccgaagagggcaccggccggatgaaggtcaacccgctggcccattggcgccccgaagacgtgcgcacctatatggaagaaaatcgcctgccaaaacatccgcttgtggcacgcggctacccgtcgatcggctgtatgccctgcaccagcccggtcaccgatggcgacacagacccccgcgccggacgctggcgcggccaagacaaaaccgaatgtggcatccatttcgtggatggaaaaatgatcagaaccggagaaaacgcatga

SEQ ID NO: 5929 - protein, 246 aa, Roseovarius nubinhibens ISM
MQPNEDLGTRVSGLNDWYRLNSATSVLRHALTDPAAGQLALVSSFGAESVVLLHMVSVIDRTTPVIFLDTELLFAETLVYQQELSERLGLKDLRIIRADPDEVQATDPEQSLHRRDTDACCTLRKTRPLARALDGFDGWITGRKRYQGGARATLDFFETEEGTGRMKVNPLAHWRPEDVRTYMEENRLPKHPLVARGYPSIGCMPCTSPVTDGDTDPRAGRWRGQDKTECGIHFVDGKMIRTGENA

SEQ ID NO: 5930 - DNA, 762 bp, Oceanicola batsensis HTCC2597
  CDS (1)..(762): transl_table=11
atgccgcctgaagccgcgatggatttcagcgcgcccgtcctgcccgagcaggaggagcgggtgcgcgtgctcaacgaccgctaccggcaccacggtgcgaccgccgtgctcgagggggccctgcgcgaccccgaggccgggaaaatcgcgctcgtgtcgtccttcggcgccgaatccgtggccctgctgcacctcgtctcgatggtcgatccctccacgccggtgctgttcatcgacacgcagatgctgttccgcgagacgctggactatcaggcggatctggcggaacggctgcacctcaaggacctgcggatcgtccgggccaatccgctggatctgcagaaggaagaccccgacgaccttctgcatacggtcgatacggacgcctgctgcgacctgcgcaagacacggccgctgcagcgtgcgctcagggagttcgacggctggatcaccgggcgcaagcggttccagggggcgacgcgctcggatctggaattcttcgaggccgacggcccgcaccggatcaaggtcaacccgctggcccactgggcgcccgaggatgtgcggacctatatggaagacaaccgcctgcccaggcacccgctcgtggcgaggggctatccctcgatcggctgcgcgccctgcacctcgcccgtggcgccgggagaagacccccgggccggacgctggcggggcgaggacaagaacgaatgtggcatccacttcgtggacggcaagatggtcagaggaggcgcggcatga

SEQ ID NO: 5931 - protein, 253 aa, Oceanicola batsensis HTCC2597
MPPEAAMDFSAPVLPEQEERVRVLNDRYRHHGATAVLEGALRDPEAGKIALVSSFGAESVALLHLVSMVDPSTPVLFIDTQMLFRETLDYQADLAERLHLKDLRIVRANPLDLQKEDPDDLLHTVDTDACCDLRKTRPLQRALREFDGWITGRKRFQGATRSDLEFFEADGPHRIKVNPLAHWAPEDVRTYMEDNRLPRHPLVARGYPSIGCAPCTSPVAPGEDPRAGRWRGEDKNECGIHFVDGKMVRGGAA

SEQ ID NO: 5932 - DNA, 804 bp, Erythrobacter sp. NAP1
  CDS (1)..(804): transl_table=11
atgaataagccccccgaacgtctcgaagcgccattcaccaccgacgaagcccgcgcacgtgcagtcgaccggctcgacacggggccgcgcttcaccgaacacgatgcggtgcgcctcaatcgcatgttccgcggctcatcgacgcaagagatgctcgaggcggtgatccagggacatctcgctggcgatatagcgatcgtatcgagtttcggtgccgagagcgcggtgctgctgcacctcgttgcgcaggtgaagccggacattccggtcctctttctcgacaccggcaagcattttgccgagacccttgaatatcgcgacgaggtggtcgcaaagatcggcctcaccaatctccagattctcactccggacgaagcggagctggccgaaaaggacgaaagcggtcttcgctggtcctacgaccccgatggctgctgcgagatccgcaaggtcaaaccgctggcgaaagcgctcgaccagttcgatgcaagctttaccgggcgcaaggcgttccagtcctcgaccagagccaatctgccgcgtttcgaaatcgacacgtccgacgcgcagggccgtctcaagatcaatccgctgatcgactgcagcgcagaggatatcggcgcctatttcgaggagcacgacctgcctcgccacccgctggtcgcacgtggcttcccctcgatcgggtgcgagccgtgcactcacaaggtcgcgccgggcgaagatccgcgctcaggccgttggaagggctgggacaagaccgaatgcggcatccacaagccgggcgaggaaccgttcttataa

SEQ ID NO: 5933 - protein, 267 aa, Erythrobacter sp. NAP1
MNKPPERLEAPFTTDEARARAVDRLDTGPRFTEHDAVRLNRMFRGSSTQEMLEAVIQGHLAGDIAIVSSFGAESAVLLHLVAQVKPDIPVLFLDTGKHFAETLEYRDEVVAKIGLTNLQILTPDEAELAEKDESGLRWSYDPDGCCEIRKVKPLAKALDQFDASFTGRKAFQSSTRANLPRFEIDTSDAQGRLKINPLIDCSAEDIGAYFEEHDLPRHPLVARGFPSIGCEPCTHKVAPGEDPRSGRWKGWDKTECGIHKPGEEPFL

SEQ ID NO: 5934 - DNA, 735 bp, Synechococcus sp. RS9917
  CDS (1)..(735): transl_table=11
atggcgttggtgatgacaggcgagcaggagctgctgcaggaccgtgccctgctggaaccgcttacgccgcgcgaccgtctgctttgggcggccgagcgctttggcgctggctttgccgttaccaccagtttcgggatccagtcggcggtgctgttgcacatgctcagcaccctgccgatgggacaggacatcccggtgatctgggtggatacgggctatctcccgcccgagacctaccgctatgccgacgcgctgacccagcgttttggcttgcgattgcatgtgacgcagagcccgctgtctccagcacggatggaggcccttcatggacagctctgggccacggggcggatggaggatctggatctttatctgcggctgcgcaaggtggaacccctggagcaggcgatggagaccctggaggtgcggtgctggtcgagtggggtgcgccgcggccagaccgaccatcgcggcaccatgtcgctgctggatccgatacggggtcggctctccctgcgaccgctgctggagtggactccgcgcgatgtgtactactacatgcaggagcatgctctgccccagcaccccctgttcgagcagggctattccacggtgggtgactggcactccagtgcacccgatggtgcggagcaatccgggcgccagacccgcttcggcggcatgaagcaggaatgcggcatccatctcccgggggtgatgggggacggcatctag

SEQ ID NO: 5935 - protein, 244 aa, Synechococcus sp. RS9917
MALVMTGEQELLQDRALLEPLTPRDRLLWAAERFGAGFAVTTSFGIQSAVLLHMLSTLPMGQDIPVIWVDTGYLPPETYRYADALTQRFGLRLHVTQSPLSPARMEALHGQLWATGRMEDLDLYLRLRKVEPLEQAMETLEVRCWSSGVRRGQTDHRGTMSLLDPIRGRLSLRPLLEWTPRDVYYYMQEHALPQHPLFEQGYSTVGDWHSSAPDGAEQSGRQTRFGGMKQECGIHLPGVMGDGI

SEQ ID NO: 5936 - DNA, 762 bp, Synechococcus sp. WH 5701
  CDS (1)..(762): transl_table=11
atgatggaggccatgatcagcctcaccacgaccccgttgccgacggatcggctgggccggactgtcgagccggaaccggccctgcgccttctggagccccttgatgccgctgggcaactggcctggggttacgaaaccttcggcgaggggttcgcgctcaccaccagtttcgggatccagtcggcggtgctgctgcacatggccagccgcctcagcgagaggatccccgtgctctgggtggacacgggctacctgcccagcgagacctacctctatgccgacaggctctgcaccgccctcaatctgaatctcaaggtggcgcaggcggatctctccccggcccggatggaggcgctctacggccgcctctgggaaaccggtggggtggaagaccttcagacttaccaccgcctgcgcaaggtggagcccctggatcggctcttccaggagctgggtgtgcattgctgggccagtggggtgcgcggtggccagaccgatcaccgcggcgccatggcccccctcgatggggtgcgcgggcgctggtcgcttcgacccctgctctcctgggggcctcgccaggtcttctattacatggagagccatgccctgccccagcacccgctgttcgagcagggctactccagcgtgggcgactggcattccagccgacctgacgatggtgacggccgcgccagccgcttcggggggctgaagcaggaatgcggcatccatctgccgggagtgatgggcgagggcatctga

SEQ ID NO: 5937 - protein, 253 aa, Synechococcus sp. WH 5701
MMEAMISLTTTPLPTDRLGRTVEPEPALRLLEPLDAAGQLAWGYETFGEGFALTTSFGIQSAVLLHMASRLSERIPVLWVDTGYLPSETYLYADRLCTALNLNLKVAQADLSPARMEALYGRLWETGGVEDLQTYHRLRKVEPLDRLFQELGVHCWASGVRGGQTDHRGAMAPLDGVRGRWSLRPLLSWGPRQVFYYMESHALPQHPLFEQGYSSVGDWHSSRPDDGDGRASRFGGLKQECGIHLPGVMGEGI

SEQ ID NO: 5938 - DNA, 753 bp, Synechococcus sp. WH 7805
  CDS (1)..(753): transl_table=11
atgacgagcgctgccgcggacttggactccagtggtgaatccgcgctcttgacgcatcagagagtccacctggaggcactcgagcctgttcaacgcttgcagtgggcgaagcagcacttcggtgcgggtttcgcaatgacaacgagcttcggcattcagtcttccgtgcttctccacatgctgagctctctgccggacgctgaggcagttccagtgatctgggtggataccggttacttaccgccggatacttatcaatatgcagacaaattgtgtgagctgttccacctccaaccggttgtggtccagtcaccgatgtctccggcaaggatggaagccctgcacgggcgtctctgggaaaccggaaaagacagcgaccttgacctctatctgcgtctacgcaagcttgagccgcttgaaagtgcactcgatcagttggctgtgacctgctgggccagtggggtgcgcagcgggcagaccgaccaccgacgcacgatgacggtgatcgatgaaatccgcggtcgctactccctcaggccgctcctgcattggaccaaccgagacatgtattactacatgcaagagcatgagcttccccagcaccctctgtttgaacgtggatactccaccgtcggtgattggcattcgagtgcgcctgacagcggcactgtcgtgggtcgcagcacacgcttcggagggcagagacaggaatgcggaattcacctgccgggggtgatgggcgaaggcatctga

SEQ ID NO: 5939 - protein, 250 aa, Synechococcus sp. WH 7805
MTSAAADLDSSGESALLTHQRVHLEALEPVQRLQWAKQHFGAGFAMTTSFGIQSSVLLHMLSSLPDAEAVPVIWVDTGYLPPDTYQYADKLCELFHLQPVVVQSPMSPARMEALHGRLWETGKDSDLDLYLRLRKLEPLESALDQLAVTCWASGVRSGQTDHRRTMTVIDEIRGRYSLRPLLHWTNRDMYYYMQEHELPQHPLFERGYSTVGDWHSSAPDSGTVVGRSTRFGGQRQECGIHLPGVMGEGI

SEQ ID NO: 5940 - DNA, 741 bp, Pseudoalteromonas tunicata D2
  CDS (1)..(741): transl_table=11
atgaatactttcaaacaaattttaacgcttgacccgcaaagccaaaccgaactattggctgaagcgaatgcgctgcttgctgataaaacagcagagcaacgagtagcttgggcgcttgaaaatctcccagacactcattttctatcatctagttttggcatccaagcggctgttatgttgcatttactcacaagccaaaaaccagatattcctgtggttttaaccgatactggttacctatttcctgaaacatatcagttcattgactcattaactgagcgcttaaatctcaacctcaaagtctatcgctcaacacatagccctgcatggcaagaagccaaatatggcaaattgtgggagcaagagggtgaaggtttaaagcaatataattacttaaataaagtagagccaatgacacgcgcgttaaaagagcttaacgctggcacttggtatagtggtttgcgacgcgggcaatcatcaacccgtgcagataaaaatattgttgaactaagccgtggcacggtaaagttttatccaatcattgattggcacaaccgcgacgtttatcaatacctgacaaaacatgaattaccttatcaccctctttgggagcatggttatgtgtctatgggtgatgtacacaccactcgtaaactagagcctggtatgaccgaagaagaaacccgcttctttggtttaaatcgcgaatgtggtcttcacatcgatggtgatggcatctaa

SEQ ID NO: 5941 - protein, 246 aa, Pseudoalteromonas tunicata D2
MNTFKQILTLDPQSQTELLAEANALLADKTAEQRVAWALENLPDTHFLSSSFGIQAAVMLHLLTSQKPDIPVVLTDTGYLFPETYQFIDSLTERLNLNLKVYRSTHSPAWQEAKYGKLWEQEGEGLKQYNYLNKVEPMTRALKELNAGTWYSGLRRGQSSTRADKNIVELSRGTVKFYPIIDWHNRDVYQYLTKHELPYHPLWEHGYVSMGDVHTTRKLEPGMTEEETRFFGLNRECGLHIDGDGI

SEQ ID NO: 5942 - DNA, 765 bp, Photobacterium sp. SKA34
  CDS (1)..(765): transl_table=11
atggctaaatttcaactggctgagttacttgagctgcctaaagtgagtcaaattattcagctggctgaaatcaatgccgagctggaggatatgacggcagagcagcgagtaagctgggctatcgacaaccttgaaggtggattttcactagcatcaagttttggtattcaatctgctgttatgttgcatttagttacaacagtaaagcccgatattcctgtggtattaaccgatacggggtatttatttcctgaaacgtatcagtttattgatagcttaacgaaacgattagatcttaatcttcatgtctacagcgcaaaacaaagcgccgcatggcaagaagcacgttatggtcaactgtggttgcaaggggttgatggcattaagcaatataatttgcttaataaagttgagccaatgcgtcgagcattagatgaactgcaagtgaaaacatggttttctgggctacgtcgtgaacaatcaaactcacgtgcgacattgccagtattagcgatccaaaatgggcgctttaagttcctgccattaattgattggagtaatgagcaaatcgatctgtatttacaacagcatgatttgccttatcacccattaaaagcgcaagactatctttctgtcggtgatatccatacgacagttaagtggcaaccggggatgaaagaagaagaaacgcgattcttcggtctaaaacgtgagtgtggtttacatgaagacagcgacacagaagcggatggttcaggaatttaa

SEQ ID NO: 5943 - protein, 254 aa, Photobacterium sp. SKA34
MAKFQLAELLELPKVSQIIQLAEINAELEDMTAEQRVSWAIDNLEGGFSLASSFGIQSAVMLHLVTTVKPDIPVVLTDTGYLFPETYQFIDSLTKRLDLNLHVYSAKQSAAWQEARYGQLWLQGVDGIKQYNLLNKVEPMRRALDELQVKTWFSGLRREQSNSRATLPVLAIQNGRFKFLPLIDWSNEQIDLYLQQHDLPYHPLKAQDYLSVGDIHTTVKWQPGMKEEETRFFGLKRECGLHEDSDTEADGSGI

SEQ ID NO: 5944 - DNA, 723 bp, Oceanospirillum sp. MED92
  CDS (1)..(723): transl_table=11
atgagtgagcaactaactgcagagctgcaagctaaagttgaagcaacagcggctctactgaacaaaggccatgctgatcatgagggatcgctggtttttgcaaacagcctgggggctgaagatgtcgtcattgctgacctgatcagcaagcactgtcctgaaattcgtaactttgtcttggatacaggtcgcttacctgaagagacattgaagcttctcgatgatgtacgtaagcaatatccagcgttgcaggttgatgtttattaccctgaagctgcggatgtcgaaggctatgtcgctgaaaatggcatcaacgctttctacgactctcaggatctgcgtaagggctgctgctttgtacgtaaaatcaagcccttaaaacgtgcactttccggcaacaaggcctggattacaggcctgcgccgtgaacagtccgtaacccgtgatgagattcagttcgaagagtgggatgaaggcaacaacatgcacaaactcaaccctctggctgactggtctgagaaagaagtttgggcatatatcaaagcttatgatgtcccttacaacgagctgcatgacaagcattaccccagcataggctgcgcaccttgtacacgcgccatctcaatgggtgaagatgtacgttctggtcgttggtggtgggaaaaccctgaaaatcgcgagtgcggattacatcctgcaacaccgctgaatttcaagaagtaa

SEQ ID NO: 5945 - protein, 240 aa, Oceanospirillum sp. MED92
MSEQLTAELQAKVEATAALLNKGHADHEGSLVFANSLGAEDVVIADLISKHCPEIRNFVLDTGRLPEETLKLLDDVRKQYPALQVDVYYPEAADVEGYVAENGINAFYDSQDLRKGCCFVRKIKPLKRALSGNKAWITGLRREQSVTRDEIQFEEWDEGNNMHKLNPLADWSEKEVWAYIKAYDVPYNELHDKHYPSIGCAPCTRAISMGEDVRSGRWWWENPENRECGLHPATPLNFKK

SEQ ID NO: 5946 - DNA, 765 bp, Xanthobacter autotrophicus Py2
  CDS (1)..(765): transl_table=11
atgacagccagccacagcgccagcctccccgccactcctttcgaccagccctcgaccggcgccccccttggcgcaggatccggcttcgacgcggcggcgctcaatgcgaagctcaggtcggccgcgccgctggagatcatcgcggcggggcttgccgcctttcccggccacatcgccgccgtctcgtccttcggaacggaatcggcggtgctgctgcacatgatcgcgcaggtggacaaggcgacgccggtgctcttcctcgacaccggccacctgttcgaggaaacgctggcctatcgcgacacccttattgcgtgcctcgggctgacgcaggtcctcaccttctccccggatccggcggcgctcgccgcgcgcgatcccgaaaacggcctgtgggcggatgacccggatgcctgctgcggcctgcgcaaggtggagccgctggcccgggcgctcggcccctatgcggcctggatcaacggccgcaagcgctaccaggcgtcgacccgcgccgacattcccttcgtggaggaggacggcgcgcgggtgaaattcaacccgctggcggcgctcggtcgcgacgacctgctcgcctacatggatgcccacgcgctgccgcggcaccccatggaacagttcggctttccctccatcggctgcatgccctgcacctcgcgggtgaagccgggggaggacccgcgcgccggccgctggcgcggaaagtccaagaccgaatgcggtatccatattggcgatgggaaataa

SEQ ID NO: 5947 - protein, 254 aa, Xanthobacter autotrophicus Py2
MTASHSASLPATPFDQPSTGAPLGAGSGFDAAALNAKLRSAAPLEIIAAGLAAFPGHIAAVSSFGTESAVLLHMIAQVDKATPVLFLDTGHLFEETLAYRDTLIACLGLTQVLTFSPDPAALAARDPENGLWADDPDACCGLRKVEPLARALGPYAAWINGRKRYQASTRADIPFVEEDGARVKFNPLAALGRDDLLAYMDAHALPRHPMEQFGFPSIGCMPCTSRVKPGEDPRAGRWRGKSKTECGIHIGDGK

SEQ ID NO: 5948 - DNA, 726 bp, gamma proteobacterium HTCC2207
  CDS (1)..(726): transl_table=11
atgagctcgatcaccaacatcgtcgatatagacagtgaactggcaacccagtcaccacaggaaattcttcgttacgctcttgagaactttgacaatattgcgatctcattcagcggtgctgaagatgtagtgttgatcgatatggcctataaaatccgcaaagacattcaagtcttttcgctggatacaggccggctccatgctcagacttatcgttttattgaagccgtgcgcaaccactacgacattaaaattgacctagtgatgccagaggcagccaaagtggaaaagctggtcaaagaaaaaggtctttttagcttttaccaagatgatcacaaagaatgctgtggcgtgcgcaagattgcaccactgcgtaagcagttattaacggtggacgcatggatcactggccagcggcgcgaccagagccccggcactcgcgctgaagtcccagtaatgcaagacgataaagccttttcccgcccagatgacagcctgaccaagttcaatccactggccaactggacatcaaagcaggtgtgggattatatccgcgcaaacaatgttccctacaatgagttgcatgatcagggatttgtcagcattggttgtgagccctgcacccgtcctactggacctggtcaacacgagcgcgaaggccgctggtggtgggaagaagcgacgttgaaagaatgtggtcttcacgcggttaatatcagtaaataa

SEQ ID NO: 5949 - protein, 241 aa, gamma proteobacterium HTCC2207
MSSITNIVDIDSELATQSPQEILRYALENFDNIAISFSGAEDVVLIDMAYKIRKDIQVFSLDTGRLHAQTYRFIEAVRNHYDIKIDLVMPEAAKVEKLVKEKGLFSFYQDDHKECCGVRKIAPLRKQLLTVDAWITGQRRDQSPGTRAEVPVMQDDKAFSRPDDSLTKFNPLANWTSKQVWDYIRANNVPYNELHDQGFVSIGCEPCTRPTGPGQHEREGRWWWEEATLKECGLHAVNISK

SEQ ID NO: 5950 - DNA, 738 bp, Oceanobacter sp. RED65
  CDS (1)..(738): transl_table=11
atgacatatacacaagaagaggttagcgaactaaataacggctttgcgagcgaacagccgaagtcgattattcgtcacggcttagaaaactttgagaacatcgccgtttcctttagtggtgctgaagatgttgtgcttgtagatatggctgtgaagattaatcctgacgcccacatattttgtttggatactggacggctacatccagagacatatgagttcttagaggatgtgcgaaagcattacaatattaagctggacataattagcccaaatgcagaggtgctggattctttcgtaaaagacaaggggttgtttagcttctatgaagatggccaccaggaatgctgtggcattcgaaagatagcccctttaaagcgcaaattaagtacactggatgcttggataacgggtcaaagaaaagaccaaagcccaggaactcgttctgatatcccagtctttcaacacgacactagtttcgcaaaagacggtattgaactttataagtacaatcccctagcaaactggtcctctgaagatgtatggaattacattaaaatgtttgacgtgccctacaacaagctacatgaacgaggctttataagtattggttgtcagccctgcaccagagcagtactgccaaatcaacacgagcgtgagggtcgctggtggtgggagaatgagggtcacaaggaatgcgggctccactcgagcaacattatcagtaaagagggttaa

SEQ ID NO: 5951 - protein, 245 aa, Oceanobacter sp. RED65
MTYTQEEVSELNNGFASEQPKSIIRHGLENFENIAVSFSGAEDVVLVDMAVKINPDAHIFCLDTGRLHPETYEFLEDVRKHYNIKLDIISPNAEVLDSFVKDKGLFSFYEDGHQECCGIRKIAPLKRKLSTLDAWITGQRKDQSPGTRSDIPVFQHDTSFAKDGIELYKYNPLANWSSEDVWNYIKMFDVPYNKLHERGFISIGCQPCTRAVLPNQHEREGRWWWENEGHKECGLHSSNIISKEG

SEQ ID NO: 5952 - DNA, 819 bp, Desulfitobacterium hafniense DCB-2
  CDS (1)..(819): transl_table=11
ttgggtgaagaaccggacagctttatgactgagtggggaatacagaaagggagaaggagaaatgaaatggacagatcggatttcaatttggatcttgatgagataaaccgagcctttgccggggaagacccccgcaagcttttggcccatgtggtggaaaaaatcggtccggcgcggattgctctggcttccagcctttccattgaggatcaagtactgacccagatgctattaaagatcgatgcccgggcccggatcttctttatcgatacaggccggaattttcagcagacttatgatctgatggaagagaccatgagtcgctatgagtttcattatgaggtatacgcgccggagaattcggagctggagccatttctggcggaatatggccccaacgctttttatgacaaggttgaactgcgccaaaaatgttgtgagctgagaaaagtcaggtccttgcagcgggtcttatctaccgtagatggctggatttgcggactgcgcaaggagcagagccccacccgccaggaaatcggtttgctggaatgggattcccgccacgctatctataaagtgaatcctctggcggcctggagcgaagagcaggtttgggcttatatccgccgggaaaacattccctacagttccctatacaacaaaggtttccgcagcattggctgtcagccctgcacccgggcggtggcccccggggcggatgtacgcagcggcaggtggtggtgggaagatccctctaaaaaagaatgcgggctgcatccatccctgaacccgcctgcaaaggaggaagaaaagcgatga

SEQ ID NO: 5953 - protein, 272 aa, Desulfitobacterium hafniense DCB-2
MGEEPDSFMTEWGIQKGRRRNEMDRSDFNLDLDEINRAFAGEDPRKLLAHVVEKIGPARIALASSLSIEDQVLTQMLLKIDARARIFFIDTGRNFQQTYDLMEETMSRYEFHYEVYAPENSELEPFLAEYGPNAFYDKVELRQKCCELRKVRSLQRVLSTVDGWICGLRKEQSPTRQEIGLLEWDSRHAIYKVNPLAAWSEEQVWAYIRRENIPYSSLYNKGFRSIGCQPCTRAVAPGADVRSGRWWWEDPSKKECGLHPSLNPPAKEEEKR

SEQ ID NO: 5954 - DNA, 780 bp, Vibrio sp. Ex25
  CDS (1)..(780): transl_table=11
atgcttgattctgtagcatccaggcttgagcttacagagttattgacattaacaaagacggagcaaatcctccgtcttgctcaaattaatgtcgagctcgaaaagctttcggcacaagatagagtaaagtgggctttagaaaatctagagggcgagtttgcggtttcttctagttttggtattcaagccgcggttatgcttcatttagtgactcaagtcaaagcggatatccccgtcattctaaccgatacaggatacctgtttgctgaaacctatcaattcattgatgagctgacagatgctctcaacctaaacttaaaagtttatcgagcgaaagaaagtgcgaattggcaagaggctcgatatggaaagttatgggagcagggtgtagagggaattgaaaaatacaacaagctcaataaagtggagccaatgcgtcgagcgctaaaagagcttaatgttggaacgtggttctctggactgcgtcgagagcaaagtaaatctcgtgcaggtttaccgattctatcaattcagaacggtgtgtttaaatttctaccagtaattgattggactaataaagacgttcattactacttagaacaacacggccttaaataccacccattgtgggatgaaggttacctttcagttggtgatacacataccactcgtaaatgggagccgggaatgtcagaggaagaaactcgattctttggcttaaagcgagaatgtggcctacacgaagatgatggttctgaacaagatgggtctggcatatag

SEQ ID NO: 5955 - protein, 259 aa, Vibrio sp. Ex25
MLDSVASRLELTELLTLTKTEQILRLAQINVELEKLSAQDRVKWALENLEGEFAVSSSFGIQAAVMLHLVTQVKADIPVILTDTGYLFAETYQFIDELTDALNLNLKVYRAKESANWQEARYGKLWEQGVEGIEKYNKLNKVEPMRRALKELNVGTWFSGLRREQSKSRAGLPILSIQNGVFKFLPVIDWTNKDVHYYLEQHGLKYHPLWDEGYLSVGDTHTTRKWEPGMSEEETRFFGLKRECGLHEDDGSEQDGSGI

SEQ ID NO: 5956 - DNA, 741 bp, Alteromonadales bacterium TW-7
  CDS (1)..(741): transl_table=11
atgagtgaatttaaaaatatattacagctagataaacaaagccaagcggctatgttagctgatgctaatggtgtattagcaaatatgagcgcagagcaacgtgttgcgtgggcgcttgaaaatttacccgataccgcgtttctatcgtcaagctttgggattcaagctgcggtgatgttgcatttaatgacaacccaacgcccagacattcctgttgtattaacagacaccggttatttgttccctgagacgtaccagtttattgagcaaatgagcgagcgtttgtcacttaatttaaaagtgtacaaggcgcagctgagcccagcatggcaagaagctaagtttggaaagttatgggagcaaggtgaggacggtattaagcaatataatcagcttaataaagttgagccaatgactcgcgctttaaaagaaattgaagcgggtacctggtttagtggtttacgtcgcgatcaatcttctacccgtgcagataagcagtttgtagaaataagccgtggtacggtaaaagtgtacccgattattgaatggtcaaaccgcgatgtatatcaatacctaactaagcatgacttaccttaccacccattatgggagcaagggtatgtatcaatgggcgatgtacacactacacgcaaactagagccaggcatgactgaagaagaaacccgcttttttggtttaaaccgtgaatgcggtcttcatatggatggtgatggtatttag

SEQ ID NO: 5957 - protein, 246 aa, Alteromonadales bacterium TW-7
MSEFKNILQLDKQSQAAMLADANGVLANMSAEQRVAWALENLPDTAFLSSSFGIQAAVMLHLMTTQRPDIPVVLTDTGYLFPETYQFIEQMSERLSLNLKVYKAQLSPAWQEAKFGKLWEQGEDGIKQYNQLNKVEPMTRALKEIEAGTWFSGLRRDQSSTRADKQFVEISRGTVKVYPIIEWSNRDVYQYLTKHDLPYHPLWEQGYVSMGDVHTTRKLEPGMTEEETRFFGLNRECGLHMDGDGI

SEQ ID NO: 5958 - DNA, 693 bp, Magnetospirillum gryphiswaldense
  CDS (1)..(693): transl_table=11
atgagccacgtggattacagtgctgcttacggtcacctgtccggtaaggatctgatcgaggtcatcgctcatcaggtgtttccgggcaaggtggcggtgacctcgtcgttcggggccgaatccgccgtgctgttggatctggtggcccaggtggatccgtccattccggtggttttcctcgataccggtgagttgttcgacgaaaccctggaataccgctatcggctcgagcgccagttggggttgaccaatgtggtggtggtgcgtccggcatcggaagacctgaccgaggccgaggatctatggcgcaccgatcatgatcgttgctgttatttgcgcaaggtgttgccgctggcccgtgcggtcgaggggtatgccggcctgatcgacggacgcaagcaagcccacggcttcgatcgccaagccttgtccaccgtccaggtgtcgggcgaggtggtcaaaatcagcccgctggccaattggagcgaggacgacgtacaaaaggcctttgtcagccgtggcctgcccacccatccgttggtcgagcagggctatcgctccatcggttgctggccgtgtacacgcccgaccaagccgggcgaatcggcccgcgccgggcgctgggccggcagcgccaagaccgaatgtggaattcatacccttgttcttggcagcgacggcgccgggatctga

SEQ ID NO: 5959 - protein, 230 aa, Magnetospirillum gryphiswaldense
MSHVDYSAAYGHLSGKDLIEVIAHQVFPGKVAVTSSFGAESAVLLDLVAQVDPSIPVVFLDTGELFDETLEYRYRLERQLGLTNVVVVRPASEDLTEAEDLWRTDHDRCCYLRKVLPLARAVEGYAGLIDGRKQAHGFDRQALSTVQVSGEVVKISPLANWSEDDVQKAFVSRGLPTHPLVEQGYRSIGCWPCTRPTKPGESARAGRWAGSAKTECGIHTLVLGSDGAGI

SEQ ID NO: 5960 - DNA, 1272 bp, Enteromorpha intestinalis
  CDS (1)..(1272)
atggcgctttcaattcgcgcgaaccgcctacgcgcgggcgcgatgccgctcaagcccgttcgcagtagcactcgtggctcagtgacgctttgcgagcgtgtgcgtgcgcccgtgcgcgcggctgcggccgcggtggccgcgccagagggcgcgaaggcgacggactgggctgcggagacgaaggagctcaacaacaagtcgccgctcgaaatcatggaccacgcactcgcgacgttcggcgacgaggtcgcgatcgcgttctcgggcgcggaggacgtggcgctcatcgaatacgctcacctgaccggccgcaagtaccgcgtcttctcgctggacacgggccgactcaaccccgagacgtaccagctcttcgacgccgtcgagaagcactacaagatcaggatcgagtacacgttcccggacgcgcaggagacgatggacctcgtgcgcgagaagggcctgttctctttctacgaggacggccatcaagagtgctgccgcgtccgcaaggtccggccgctgcgccgccagctcaagacgctgcaggcgtggatcacgggccagcgcaaggaccagtcccccggcacccgcatggaggtccccgccgtgcaagtggaccccgtcttcgagggccagtccggcggcgacggctccctcgtcaagtacaacccgctcaccaacatgacgtccgcggaggtctggaacttcctgcgcatcatgaacgtgcccagcaacaagctccacgagtgcggctacgtctccatcggctgcgaaccctgcacgcggcccgtgctgcccaaccagcaggagcgcgagggccgctggtggtgggaggactccgccgccaaggagtgcggcctgcactctggcaacgtcgtcgactctgctgaggcagaggccaaggcggaggcacccgacctgtggaccggcggggcggtcgaggcgctggacaaggcgacgctcgagaagctcgcaggcggcgaccgcgacaaggacaccatggtggtgttatacgcgccttggtgccctttctgccaggccttcgaacccgattacgagcccgtcgcgcaagagcccggcggagcgggcttcggcgtggccaagtacaacgcggacgctgaccgcgagtactcggagtcgctcggcctgaaaacgttcccgacaatcatcttcctgcccaagggttctgacaaggtggtcaagtttgagtcggatcggcggaccgtcgagtcgatgacgatgtgggcggcagcgctgggcgcacgcgagtga

SEQ ID NO: 5961 - protein, 423 aa, Enteromorpha intestinalis
MALSIRANRLRAGAMPLKPVRSSTRGSVTLCERVRAPVRAAAAAVAAPEGAKATDWAAETKELNNKSPLEIMDHALATFGDEVAIAFSGAEDVALIEYAHLTGRKYRVFSLDTGRLNPETYQLFDAVEKHYKIRIEYTFPDAQETMDLVREKGLFSFYEDGHQECCRVRKVRPLRRQLKTLQAWITGQRKDQSPGTRMEVPAVQVDPVFEGQSGGDGSLVKYNPLTNMTSAEVWNFLRIMNVPSNKLHECGYVSIGCEPCTRPVLPNQQEREGRWWWEDSAAKECGLHSGNVVDSAEAEAKAEAPDLWTGGAVEALDKATLEKLAGGDRDKDTMVVLYAPWCPFCQAFEPDYEPVAQEPGGAGFGVAKYNADADREYSESLGLKTFPTIIFLPKGSDKVVKFESDRRTVESMTMWAAALGARE

SEQ ID NO: 5962 - DNA, 915 bp, Phaeosphaeria nodorum
  CDS (1)..(915)
atgtcgtcacagctattcgacaacaaggagcaataccccccttcccccaccatcggaagtgaggaatctggctatgcctccgccacgtcaagccaggatggtcttgcagaagtctacttcagcaagcctcatctcaaattcgtcaatgctcagttgcagaagcttgaaccacaggaaatcttgaaatggtgcatcatgactctgcctggtcttttccagactactgcctttggtctcactggtctggttaccatcgacatgctttccaagctcgaaggacccttgaaccacaacattgatttgatcttcctcgacacactctaccacttcgacgagacctatgcgctcgttgacaaggtccgaagacgttatggaaccccagttcacgtctacaagcctgccggctgtgacagcgtcgacgacttcaccaagaagcatggaaacaagctttgggacaccaacgacgaactttacgactatgttgccaaggtggagcctgcggaacgcgcctactctgaccttcaagtcaaggctgttctgacgggacgccgtcgcagccaaggtgctcagcgtggcgacctggacattgtcgaagtcactgaggatggccttatcaagatcaatccattggccaactggagctttgcccaggtcaaggcatacgtcgacgccaacgatgttccgtacaacgacctcctcaaccaaggatacaagagtgttggtgactggcattccactcagccagtagcagcaggtgaggatgagcgatcaggacgctggaagggcaaggcgaagaccgagtgcggtatccataaccccaagtcgcgctacgcccagttcctgcgcgagcaggagctcaagaagcagcaggaggtgctgagcgatgctctacaaaaggtgtcgattgcgcaatag

SEQ ID NO: 5963 - protein, 304 aa, Phaeosphaeria nodorum
MSSQLFDNKEQYPPSPTIGSEESGYASATSSQDGLAEVYFSKPHLKFVNAQLQKLEPQEILKWCIMTLPGLFQTTAFGLTGLVTIDMLSKLEGPLNHNIDLIFLDTLYHFDETYALVDKVRRRYGTPVHVYKPAGCDSVDDFTKKHGNKLWDTNDELYDYVAKVEPAERAYSDLQVKAVLTGRRRSQGAQRGDLDIVEVTEDGLIKINPLANWSFAQVKAYVDANDVPYNDLLNQGYKSVGDWHSTQPVAAGEDERSGRWKGKAKTECGIHNPKSRYAQFLREQELKKQQEVLSDALQKVSIAQ

SEQ ID NO: 5964 - DNA, 927 bp, Aspergillus oryzae
  CDS (1)..(927)
atgcctgcaaagatgcctgatacctacccctcccacgctgaggactttgagtccaaggacaatgccacggactctgattatgttagtggtagctcgagtgacgattatctccccgagattgtcttcacgaaaccacatttgcagtttctcaacagacagctgcagttccttgagcctcaagatgtcttgagatggtgtgttacatcactccctcaccttttccagaccaccgcgtttggtcttactggactcgtcactcttgatatgctttccaagctggaggtccctcgccctcagatggtcgacctcatcttcctggacactcttcatcacttctcggaaacccttactctggtcgacaagattcgccagaagtaccccttgaacaacatccatgtctacaagcccaagggcctcaactctgaagaagagtttgccaagaagtacggtgcccgtctatgggaacgggatgatcagctctacgactgggccgccaaggtagagcccgcccagcgtgcctaccgtgaactgaacgttcatgctgtcctcaccggccgtcgccgtagccagggtggtaagcgtggtgaccttgacatcatcgaggttgacgaggctggtcttatcaagatcaaccctctggccaactggactttcgatcaagtcaagcagtacatcaaagacaacgatgtgccctacaatgagctgcttgaccgcggctacaagagcattggtgactaccactctacccaacccgtcaaggaaaacgaggatgaacggtccggtcgctggaagggccaagccaagaccgaatgtggcatccacaaccctcgctccaagtatgcccaatacctgatggagcttgagcgcaagcggcaggaggaggccctgtctcaggcgctgcagaaccaaatgaccactgctcaatga

SEQ ID NO: 5965 - protein, 308 aa, Aspergillus oryzae
MPAKMPDTYPSHAEDFESKDNATDSDYVSGSSSDDYLPEIVFTKPHLQFLNRQLQFLEPQDVLRWCVTSLPHLFQTTAFGLTGLVTLDMLSKLEVPRPQMVDLIFLDTLHHFSETLTLVDKIRQKYPLNNIHVYKPKGLNSEEEFAKKYGARLWERDDQLYDWAAKVEPAQRAYRELNVHAVLTGRRRSQGGKRGDLDIIEVDEAGLIKINPLANWTFDQVKQYIKDNDVPYNELLDRGYKSIGDYHSTQPVKENEDERSGRWKGQAKTECGIHNPRSKYAQYLMELERKRQEEALSQALQNQMTTAQ

SEQ ID NO: 5966 - DNA, 1395 bp, Catharanthus roseus
  CDS (1)..(1395)
atggctttggctttcacttcttcaactgcaattcatggctctctgtcttcttcatttgaacaaacaaaagcagcagcggcgcagtttggttcatttcagcctttggatcggccacatactatatcaccttcggtgaatgtttctcgtagacgtttggccgttaagccaattaacgctgagcctaaaaggaatgagtcaattgtcccctccgcagcaaccaccgttgctcccgaggttgaagagaaagttgatgtggaagactatgagaaattggctgatgagcttcaaaatgcctctcctcttgagatcatggacaagtccctggctaagtttggcaatgatatagctattgctttcagtggggccgaagacgttgccttgatagagtatgcacacttgactggtcgaccattcagagtatttagcttggacacagggagattgaatccggagacatataaattttttgatacggttgagaaacagtatggaattcatattgagtacatgtttcctgatgctgtcgaagttcaggctttagttaggagcaaggggcttttttctttctacgaagatggccaccaagagtgctgccgggtgaggaaggtcaggcccctgcgaagagcccttaagggattacgcgcatggatcactgggcagaggaaagatcagtctcctggcactaggtctgaaattccagttgtccaggttgaccctgtttttgaaggaatggatggtggtgtaggcagcttggtgaagtggaatcctgtggctaatgtggaaggaaaggatatctggaacttcctccgagccatggatgtgccggtgaacacattgcactcacaaggttatgtctcaattggctgtgagccgtgcacgaggccagtccttccagggcagcacgagagggaaggaaggtggtggtgggaagatgccaaagcaaaggaatgtgggttacacaaagggaatatcaaggaggaaactctgaataataatgggaatggagctgttaatggaaatggaagtgatactattgctgatatctttgataccaataatgtaacgagcttgagtaggcctgggattgagaatttgctgaagttggaggaaaggagagaggcatggctagttgtactttacgcaccttggtgccgtttttgccaggcaatggaaggatcatatcttgaattggcagaaaagttggctggttctggtgtaaaagttggaaagtttaaggcagacggtgatcagaaggcatttgcacagcaagaattgcagctgaatagcttccctacaattcttttcttcccaaagcactcatctaagcccataaaatatccatcagagaagagggatgtagactcattgatggcttttgttaatgccctgcgatga

SEQ ID NO: 5967 - protein, 464 aa, Catharanthus roseus
MALAFTSSTAIHGSLSSSFEQTKAAAAQFGSFQPLDRPHTISPSVNVSRRRLAVKPINAEPKRNESIVPSAATTVAPEVEEKVDVEDYEKLADELQNASPLEIMDKSLAKFGNDIAIAFSGAEDVALIEYAHLTGRPFRVFSLDTGRLNPETYKFFDTVEKQYGIHIEYMFPDAVEVQALVRSKGLFSFYEDGHQECCRVRKVRPLRRALKGLRAWITGQRKDQSPGTRSEIPVVQVDPVFEGMDGGVGSLVKWNPVANVEGKDIWNFLRAMDVPVNTLHSQGYVSIGCEPCTRPVLPGQHEREGRWWWEDAKAKECGLHKGNIKEETLNNNGNGAVNGNGSDTIADIFDTNNVTSLSRPGIENLLKLEERREAWLVVLYAPWCRFCQAMEGSYLELAEKLAGSGVKVGKFKADGDQKAFAQQELQLNSFPTILFFPKHSSKPIKYPSEKRDVDSLMAFVNALR

SEQ ID NO: 5968 - DNA, 702 bp, Bacillus licheniformis
  CDS (1)..(702): transl_table=11
atttttacttacagcacatgggaggaaccaaacatctcttttcaggaagatgactcttataaaggagcgctgtccgtcctgaaatgggcgtacggacattacggggatcagctcgtatacgcgtgcagcttcggaattgaggggatcgtcctgatcgatttgatttataaggtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaa

SEQ ID NO: 5969 - protein, 233 aa, Bacillus licheniformis
MFTYSTWEEPNISFQEDDSYKGALSVLKWAYGHYGDQLVYACSFGIEGIVLIDLIYKVKKDAVIVFLDTGLHFKETYETIDAVKERYPGLQIIMKKPELTVEEQAKEYGDELWKTAPNSCCEMRKVIPLRETLSGYPAWLSGLRREQSPGRSKTNFLNKDEKFKSIKVCPLIHWTWKDIWRYVTKHDLPYNPLHDQGYPSIGCAPCTSPAFTMDDLRSGRWNGSAKTECGLHE

SEQ ID NO: 5970 - DNA, 924 bp, Selaginella lepidophylla
  CDS (1)..(924)
atggcaacgacaacgacggcggctatggcgctagggcaggtatcgtccttgttcaatcaacctcaacatgcacgatcgtctctcagctggaggggcggtgtgcgagtcaacttcgttcaagcttgcgcttctaagagcgctgtcaatgccgccagtgcaaccgaggtgaaggagagcgtcgacatcaagcagtggaatgagcaaatatacgaaggtagacagcagcacttgcaatcgcaggctatggatgcactgaagaagtcactgtcgagcttcaaaaatccgacgttcccgtgtgcgttgattctgggggatgtggttcttttggatcttctacacagagttggtgctttagagaatggagctgtcaaagttgtatttattgacaccttccatttgtttccggagacatatgacttcctgaagactgttgaggaacggtacaagttcaaggcgcatgttttccatgcagcgggcttcaagaatcgggaagagtacgtcgcaaagcatggttccgacctctacatccgagatgttgatgagtacgacaagatctgcaaagttgagccttttaatcgagcactggcaacgctagaggtggatgcgatgataaacgggagacgaagagatcacggtgcagaaagggctcatttggaggttgttcaagacggtaagatggtgagcgttcagcctttggcgtactgggaattcagggactgctggaactatttaacaaagaacaacataccgtatcatccccttcacgataagggctatccaagcgttggagatatccagagcacattgcctgttccgaaagagaaatggttcgagtatggggcagagcggtctggacgttttcagggaatgacgaacaaggatggttcgctgaagactgaatgtggaattcattcgcagaagtag

SEQ ID NO: 5971 - protein, 307 aa, Selaginella lepidophylla
MATTTTAAMALGQVSSLFNQPQHARSSLSWRGGVRVNFVQACASKSAVNAASATEVKESVDIKQWNEQIYEGRQQHLQSQAMDALKKSLSSFKNPTFPCALILGDVVLLDLLHRVGALENGAVKVVFIDTFHLFPETYDFLKTVEERYKFKAHVFHAAGFKNREEYVAKHGSDLYIRDVDEYDKICKVEPFNRALATLEVDAMINGRRRDHGAERAHLEVVQDGKMVSVQPLAYWEFRDCWNYLTKNNIPYHPLHDKGYPSVGDIQSTLPVPKEKWFEYGAERSGRFQGMTNKDGSLKTECGIHSQK

SEQ ID NO: 5972 - DNA, 1371 bp, Ceratopteris richardii
  CDS (1)..(1371)
atggcatcagcgatagggagcgtatccatgaaacttcttcagggctctgtgctcgagcccttctcttcttcagtttcttctccccgtatggctctctcccccccttcttgcgtcgttagggcaggcttgtttggacaacggagttccgaaaacgtttttcaacgcagctgttccgtaccgcagtctgataagcaccgtggctgtcttaatgcagctatcgctactccagaagttgtgcaggaggacataaattatgaagatcttgctttacagctcgtagatgcttcacctcttgagattatggatagggctcttgccatgttccagtctgacatcgccattgctttcagtggtgcagaggatgttgcattgatcgagtatgccaaactgaccggcagaccattccgagtcttcagtctggacacggggcggcttaatcctgagacctataggttctttgatgaagttgagaaacactatggaatcaggattgagtacatgtttcctgatgcatcagaagtggaagcacttgttagaagcaagggaatgttttctttttatgaggatgggcaccaagaatgctgccgtatcagaaaagtgagacccctgagacgagctcttaaaggtttgaaggcgtggattacgggacaaagacgtgaccagtcacctggaacacggtcgaatattccaattgtgcagattgatccgtcctttgaaggcatggatggggggcctggcagtctcataaaatggaatcctgttgccaatgtcacaggcacagacatctggagcttcttgaggactatgaatgtccctgtcaatgtgttacactcgcaaggatatatttcaataggttgtgagccatgtactcgagcagtgcttcctggcatgcatgaaagggaagggcgatggtggtgggaggatgcaaaagcaaaggagtgtggcttgcacaagggaaacattgagactgctgaaactagtaataatggggcacagaatacagcttctgtatcagaactatttctaagcaaagacatcaaagccttttctcgagctgagattgaagaatttgcaaacttggagaaaagagagaattcctggattgtagtcctttatgcgccatggtgcccttattgtcaggcaatggaggcatcattcaatgagctggctgagaagcttggtggtacaaatgtaaaggttgggaagttcaatgctgacaaagaaaacaagccatatgctatggcagagctccagatgaagagtttccctactatcctctttttttcaaagaatttacggaatccaatcaagtatccttccgaacagagggatgtggactcttttcttgctttcataagagcactgcaatga

SEQ ID NO: 5973 - protein, 456 aa, Ceratopteris richardii
MASAIGSVSMKLLQGSVLEPFSSSVSSPRMALSPPSCVVRAGLFGQRSSENVFQRSCSVPQSDKHRGCLNAAIATPEVVQEDINYEDLALQLVDASPLEIMDRALAMFQSDIAIAFSGAEDVALIEYAKLTGRPFRVFSLDTGRLNPETYRFFDEVEKHYGIRIEYMFPDASEVEALVRSKGMFSFYEDGHQECCRIRKVRPLRRALKGLKAWITGQRRDQSPGTRSNIPIVQIDPSFEGMDGGPGSLIKWNPVANVTGTDIWSFLRTMNVPVNVLHSQGYISIGCEPCTRAVLPGMHEREGRWWWEDAKAKECGLHKGNIETAETSNNGAQNTASVSELFLSKDIKAFSRAEIEEFANLEKRENSWIVVLYAPWCPYCQAMEASFNELAEKLGGTNVKVGKFNADKENKPYAMAELQMKSFPTILFFSKNLRNPIKYPSEQRDVDSFLAFIRALQ

SEQ ID NO: 5974 - DNA, 735 bp, symbiont bacterium of Paederus fuscipes
  CDS (1)..(735): transl_table=11
atgagccagcctttcgatacctccgccctcgcctctagctactccgacaaatcgccacaagacatcctgaaactcgccttcgaacacttcgtcgatgatctatggatctctttcagcggtgccgaagacgtcgttctggtagatatggcctgtaaactcagtaaaagcatcaaagttttcagcctcgacactggtcgtctgcacccagaaacctatcgcttcatcgatcaggttcgcgagcactatggcatcaccatcgaaatcctttctcccgactcacgcttgctcgaaccattagtgaaggaaaagggcctgttcagcttttataaggacggccatggcgaatgttgcagtatccgcaagatcgaaccactcaagcgcaagcttgccgacgtgcgcgcttgggctaccggccagcgccgtgaccaaagtcccagcacccgcacccatgtggcggtgatcgaactggatagtacgttctccacgccggaaaaaccgttgtacaagttcaacccactatcggccatgaccagcgaggaagtctggacctacatccgcatgctggagctaccctacaatagcctgcacgaacgcggctacatcagcatcggttgcgagccctgcacacgcccggttctacccaaccagcacgagcgcgaaggccgctggtggtgggaagaagctacctacaaggaatgtggcctgcacgccggaaatctgatcagcaaagcctga

SEQ ID NO: 5975 - protein, 244 aa, symbiont bacterium of Paederus fuscipes
MSQPFDTSALASSYSDKSPQDILKLAFEHFVDDLWISFSGAEDVVLVDMACKLSKSIKVFSLDTGRLHPETYRFIDQVREHYGITIEILSPDSRLLEPLVKEKGLFSFYKDGHGECCSIRKIEPLKRKLADVRAWATGQRRDQSPSTRTHVAVIELDSTFSTPEKPLYKFNPLSAMTSEEVWTYIRMLELPYNSLHERGYISIGCEPCTRPVLPNQHEREGRWWWEEATYKECGLHAGNLISKA

SEQ ID NO: 5976 - DNA, 780 bp, uncultured crenarchaeote
  CDS (1)..(780): transl_table=11
atggacctgttaagttctgaccgtgttaaccgttctaaaccatcctttgaccaattaaattcaatatctgaagaaatggaatcaaagtctgctaaagaagtcataaggtgggctttggaatcgtatgcgccaaatgtcgcattggcgtccagttttggtgcagaagatgcagtgttgattgacttaatttgtgagatcgacggtgtgcactctaggatcttcacacttgatacaggcagattaaatcaagagacatacgacgtaatggaggatgtacgaaagagatatggtgtgacgatagaggtattctttccagatagtcctcaagttgaggaaatggttacacagaagggaataaatttgatgtatgggagtatcgagaatagaaagctatgttgtaaaataagaaaggttgacccacttaagagggcactgacaggattggagtgttggatcacgggattaaggcgcgagcaaaccattaccagaaatgaaattaaaaaaatcgaaattgattcagcgcatggaaacattgtaaaattgaatccacttgcagattggactttagaccaaatttggaaatatataaaagataatgagattccgtataataaattacatgaccttggatacccgagcataggatgcgctccttgtaccagggcagtgaagccaggagaagattctcgagctggcaggtggtggtgggagaattcatctcataaagaatgtggcctacattgggatcccgtgaaaaataagtcggacaggtcaagttag

SEQ ID NO: 5977 - protein, 259 aa, uncultured crenarchaeote
MDLLSSDRVNRSKPSFDQLNSISEEMESKSAKEVIRWALESYAPNVALASSFGAEDAVLIDLICEIDGVHSRIFTLDTGRLNQETYDVMEDVRKRYGVTIEVFFPDSPQVEEMVTQKGINLMYGSIENRKLCCKIRKVDPLKRALTGLECWITGLRREQTITRNEIKKIEIDSAHGNIVKLNPLADWTLDQIWKYIKDNEIPYNKLHDLGYPSIGCAPCTRAVKPGEDSRAGRWWWENSSHKECGLHWDPVKNKSDRSS

SEQ ID NO: 5978 - DNA, 726 bp, Xanthomonas oryzae pv
  CDS (1)..(726): transl_table=11
atgaccgcgctacctgccgcatcgatcacctcttccgcgttggacgatctggacgcgctcaatgcgcagctggaaggcctgcatgccgacgaacgcgtgtcctgggcgctgcagcacggcccgcaggacgcggcgctgtcgtccagcttcggcgcgcaatcggcagtgacgctgcatctgctcagccagcaacgcccggacatcccggtgatcctgatcgacaccggctacctgttcccggaaacctaccgcttcgccgatgccttgaccgaacggctcaagctcaatctcaaggtatatcgcccgctggtcagccgcgcctggatggaagcgcgccacggccgcctgtgggaacaaggcatggtcggcatcgatcagtacaacaacctgcgcaagatcgaaccgatgcgccgcgccttggacgaactcaacgtgggcacctggttcaccggcctgcgccgcagccaatccggcggccgcgcgcagacgccaatcgtgcagaagcgcggtgagcgctacaaaatcagccccatcgccgattggaccgatcgcgacgtgtggcagtacctgcagacgcacgagctgccgtaccacccactgtgggaacaaggctacgtgtccatcggcgatttccacaccacgcgtcgctgggaacccggcatgcgggaggaagacacgcgcttctttggcctgaagcgggagtgcggcatccacgaggatatctag

SEQ ID NO: 5979 - protein, 241 aa, Xanthomonas oryzae pv
MTALPAASITSSALDDLDALNAQLEGLHADERVSWALQHGPQDAALSSSFGAQSAVTLHLLSQQRPDIPVILIDTGYLFPETYRFADALTERLKLNLKVYRPLVSRAWMEARHGRLWEQGMVGIDQYNNLRKIEPMRRALDELNVGTWFTGLRRSQSGGRAQTPIVQKRGERYKISPIADWTDRDVWQYLQTHELPYHPLWEQGYVSIGDFHTTRRWEPGMREEDTRFFGLKRECGIHEDI

SEQ ID NO: 5980 - DNA, 981 bp, Physcomitrella patens
  CDS (1)..(981)
atggcgatggctatggcggatgctcaccttcgctcctccacgtcctgtgtaccttcgcactgccccgcgctggtgcctgccctggccaccctcacttcgctcaggaaatgtgcttttcataaaccctcgtttccctcccttgtctttcaaagctactgcttgggttgggctagtggaagaggaaagactgcagcatctgcagtgcctgttaccacctcgggttcaagtattgacattaagaagtgtaacgaacaagctcgggatgcccgacttcagcatctagaggcacaggcgttagaaaccttgcagaagactgtggaaaatttcgagaagccagcgtttccatgtgctttgatcgcaggtgatgtggtcatactagatcttcttcacaggataggagcgttttcagataataaagtaaaaataatcttcatcgacacttttcacctcttccctgaaacatataagtttctcagcgaagtggaggagcggtatggattcaaggcacatgtgtttcatgctgcagatgtaaacaacaaagaagcctatgacgccaaatttggttcagatttgttcataactgacatagaagagtacgaccgcatctgtaaagttgagccgttcagccgtgctctgaagacattggaggtagatgctatgatcaatgggcgtagacgtgatcatggcgcagaaagagcccatcttgaggtgttcgaggagggaaaaatggtgaaagtgcaacctcttgcgtattgggaattcagggattgctgggattacttgacgaaatattcgttaccttaccatcctctccacgaccaaggctttccgagcattggagacgtgcagtccacgataccagttcctcgtgagaagtggttcgagtatgccggagaacgatcaggccgctttcagggtttgacgaatccagatgggagtgcaaaaacagagtgtggaattcacgttggtggtagaacataa

SEQ ID NO: 5981 - protein, 326 aa, Physcomitrella patens
MAMAMADAHLRSSTSCVPSHCPALVPALATLTSLRKCAFHKPSFPSLVFQSYCLGWASGRGKTAASAVPVTTSGSSIDIKKCNEQARDARLQHLEAQALETLQKTVENFEKPAFPCALIAGDVVILDLLHRIGAFSDNKVKIIFIDTFHLFPETYKFLSEVEERYGFKAHVFHAADVNNKEAYDAKFGSDLFITDIEEYDRICKVEPFSRALKTLEVDAMINGRRRDHGAERAHLEVFEEGKMVKVQPLAYWEFRDCWDYLTKYSLPYHPLHDQGFPSIGDVQSTIPVPREKWFEYAGERSGRFQGLTNPDGSAKTECGIHVGGRT

SEQ ID NO: 5982 - DNA, 1377 bp, Arabidopsis thaliana
  CDS (1)..(1377)
atggcactagcaatcaacgtttcttcatcttcttcttctgcgatctcaagctctagcttcccttcttcagatctcaaagtaacaaaaatcggatcattgaggttattgaatcgtaccaatgtctctgcggcttctctgagtttgtccgggaagagatcctccgtgaaagctcttaatgtgcaatcaattacaaaggaatccattgttgcttctgaggttacagagaagctagatgtggtggaagttgaagactttgaggaactagcaaagagattagagaatgcttctcctcttgagatcatggataaagctcttgagaagtttgggaatgacattgctattgcttttagtggagctgaagatgttgctctgattgagtatgctcatttaactggaagaccttatagggtattcagtttggatacagggagattgaatccagaaacatatagactcttcgataccgtggagaaacattacggtattcggattgagtatatgtttcctgatgctgttgaggttcaagctttagttaggaacaagggtttgttctctttctatgaagatggtcaccaggagtgttgccgtattagaaaggtgagacctttgaggcgtgcgttgaagggtttacgtgcttggatcactggtcagaggaaagatcaatcacccgggacaagatcggagattcctgttgttcaggttgatccagtgtttgaaggattagatggtggagttggtagtttggtgaagtggaatccggttgctaatgttgaagggaatgatgtttggaatttcttgaggacgatggatgttcctgtcaacacgcttcacgctgcgggttatgtttcaatcggatgtgagccatgcacgagagcggttttgccgggtcagcatgagagagaagggagatggtggtgggaagatgctaaggctaaagagtgtggccttcacaaagggaatatcaaggagaataccaatggaaacgcaaccgctaatgtcaacgggacagccacagtcgcggatatcttcaatagcgagaatgttgtgaacttgagcaggcaagggattgagaatttgatgaagttagagaaccggaaagaggcttggatcgttgtgctttatgcaccgtggtgcccgttttgtcaggcaatggaagcttcattcgatgaattggcggataagctgggaggaagtggtgtgaaggttgctaagtttagagctgatggtgaccagaaggactttgccaaaaaggagttgcagcttggaagctttccaacaatacttgtgttcccaaagaactcttcaagaccaatcaagtatccatcagagaagagagatgttgattctttgacatctttcttgaatcttgttcggtaa

SEQ ID NO: 5983 - protein, 458 aa, Arabidopsis thaliana
MALAINVSSSSSSAISSSSFPSSDLKVTKIGSLRLLNRTNVSAASLSLSGKRSSVKALNVQSITKESIVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWNFLRTMDVPVNTLHAAGYVSIGCEPCTRAVLPGQHEREGRWWWEDAKAKECGLHKGNIKENTNGNATANVNGTATVADIFNSENVVNLSRQGIENLMKLENRKEAWIVVLYAPWCPFCQAMEASFDELADKLGGSGVKVAKFRADGDQKDFAKKELQLGSFPTILVFPKNSSRPIKYPSEKRDVDSLTSFLNLVR

SEQ ID NO: 5984 - DNA, 930 bp, Penicillium chrysogenum
  CDS (1)..(930)
atgccggccaagatgcccaactactcttccgagatggagggcgttgacaatcacgataacatgactgagtcgggctatgtcagtgctggttctggctctagcgaggactatgttcccgagattgttttcaccaagccccatcttcagttcctcaaccgccagttgcaattccttgaacctcaagagatcttgagatggtgcattacttcgcttcctcatctcttccagaccactgcctttggtctcacaggtcttgttacattagacatgctgtcgaagctggaggtgcctcgtccccagatggtcgacctcgtcttcctcgacactctctatcacttcgatgagacaatgtccctagtagaccgtgtacgccgcaggtaccccaacaacaatgtgcacatctacaagcccgctggcgttgaaaccactgccgaattcgaagccaagtacggcgctaagctctgggaagtcgacgaccaactctacgactgggtggccaaggttgagcccgctcagcgtgcctaccgtgagatgaatgttcatgccgttctcactggtcgccgccgcagccaaggaggcaaacgtggtgaccttgacatcattgaagtcgacgaggccggcctcatcaagatcaacccaatagccaactggtcctttgaccaggtcaagcagtacgtcaaggagaacgatgtgccctacaacgagctcctcgaccgtggttataagagcattggtgactggcactccacccagcccgttgctgagggagaggacgagcgctctggtcgttggaagggacagcagaagaccgagtgtggtattcacaaccctcggtccaagtatgcccagtacttgatggagatggagcgcaagcgtcaagaggaggccctctcacaggccttgcaaacgcagttgacgcctgttgtctga

SEQ ID NO: 5985 - protein, 309 aa, Penicillium chrysogenum
MPAKMPNYSSEMEGVDNHDNMTESGYVSAGSGSSEDYVPEIVFTKPHLQFLNRQLQFLEPQEILRWCITSLPHLFQTTAFGLTGLVTLDMLSKLEVPRPQMVDLVFLDTLYHFDETMSLVDRVRRRYPNNNVHIYKPAGVETTAEFEAKYGAKLWEVDDQLYDWVAKVEPAQRAYREMNVHAVLTGRRRSQGGKRGDLDIIEVDEAGLIKINPIANWSFDQVKQYVKENDVPYNELLDRGYKSIGDWHSTQPVAEGEDERSGRWKGQQKTECGIHNPRSKYAQYLMEMERKRQEEALSQALQTQLTPVV

SEQ ID NO: 5986 - DNA, 771 bp, Chromatium vinosum
  CDS (1)..(771): transl_table=11
atgactgaacgacgtcagccttccctatcgaccgacaccctgccgacccgtgaagccgccgcgatcgaactcctgtcccaggtctgccgcgagctggattccatcgtgttcgccaccagcctcggcgccgaagacatggtgctgaccgagatcatccggcgcgaacgcctgccgatccgcatcttcactctcgacaccggacggctgccgaccgagaccctggaactcatcgaggtggtcgaacgccactacgggacgcggatcgagcgctacgcgccgcacccggacgccatcgccgattatgtgagccgctacggtctcgacggtttctacgactcggtgcccgcgcgtcaggcctgctgccgggtgcgcaagctcgaacccctgaagcgtgccctggccggtcagtcggcctgggtcacgggtctgcgcgccgagcagtccgtcacccgcgccgagctgccggcgcgcgaatgggatgccgccaacggtctggagaagatcaacccgctcgccgactggagcgagcacgaggtctgggccttcatccggcaccatcgggtgccctacaacccgctgcacaaccagggttatcccagcatcggctgcgccccctgcacccgcgccatcacggtcggcgaggacgtgcgcgccgggcgctggtggtgggaaaaccccgagaccaaggaatgcggactacaccggcgtgagttcgcgccgcgccagccgtccgcccatccagcgatcgaacgcgacaggagcgccgcatga

SEQ ID NO: 5987 - protein, 256 aa, Chromatium vinosum
MTERRQPSLSTDTLPTREAAAIELLSQVCRELDSIVFATSLGAEDMVLTEIIRRERLPIRIFTLDTGRLPTETLELIEVVERHYGTRIERYAPHPDAIADYVSRYGLDGFYDSVPARQACCRVRKLEPLKRALAGQSAWVTGLRAEQSVTRAELPAREWDAANGLEKINPLADWSEHEVWAFIRHHRVPYNPLHNQGYPSIGCAPCTRAITVGEDVRAGRWWWENPETKECGLHRREFAPRQPSAHPAIERDRSAA

SEQ ID NO: 5988 - DNA, 900 bp, Aspergillus terreus
  CDS (1)..(900)
atgcccgcgaagatgcctgacaactaccccactgagtctgaggcctacgatgccaaagatactaccaccgaatccggatatgtcagtggtagctccagcgaggactatctcccggagattgtcttcaccaagcctcatctccagttcctcaaccgccagctgcagttcctcgagcctcaagatgtcctgagatggtgtgtcacatcactgcctcatctctttcagaccaccgccttcggtctgaccggcctggtcacgctggacatgctctccaagctggacgtgccccggccccaggtggtcgacctggtcttcctcgacaccctccaccacttcaaggagaccttggctctggttgacaaggtccgccagcgatacccgaacgtcaccatccacgtctacaagcccaagggcctggagacggaagaggaatttgccaagaagtacggtgcccgtctctgggagcgggatgaccagttctacgactgggtggccaaggtcgagccggctcagcgggcctaccgtgaactcaacgtccacgccgtgctgactggccgtcgtcgcagccagggtggcaagcggggagacctcgacatcatcgaagtcgacgaggctggtctcatcaagatcaacccgctggctaactggacctttgagcaggtcaaggcctacatcaaggagaacaacgtgccctacaacgagctccttgaccgcgggtacaagagcatcggggactaccactccacccagcccgtcagcgagaacgaggatgaacgctcgggccgctggaagggccaggagaagaccgagtgtggcatccacaaccctcgctccaagtacgcccagtacctgctggacatggagcgcaacggcaggaggaggctctctcacaggcgttga

SEQ ID NO: 5989 - protein, 299 aa, Aspergillus terreus
MPAKMPDNYPTESEAYDAKDTTTESGYVSGSSSEDYLPEIVFTKPHLQFLNRQLQFLEPQDVLRWCVTSLPHLFQTTAFGLTGLVTLDMLSKLDVPRPQVVDLVFLDTLHHFKETLALVDKVRQRYPNVTIHVYKPKGLETEEEFAKKYGARLWERDDQFYDWVAKVEPAQRAYRELNVHAVLTGRRRSQGGKRGDLDIIEVDEAGLIKINPLANWTFEQVKAYIKENNVPYNELLDRGYKSIGDYHSTQPVSENEDERSGRWKGQEKTECGIHNPRSKYAQYLLDMERNGRRRLSHRR

SEQ ID NO: 5990 - DNA, 1395 bp, Brassica juncea
  CDS (1)..(1395)
atggcactagcgatcaacgtttcttcatcttcttcttctgcgatctcaacctctagcttcccttcttcagagctcaaagtttcagctccacggatcggttcgttgaggttatcggatcgtgtcaatgtctcatcggtgtctctgagtctatccgggaaacgatcctcggtgaagcctctgaatgtgcagtcaattgcaaaggagtcgtttggttctatggtggcttctgaggttacagagaaacaagatgtggtggaagtggaagactttgaggagctagcaaagagtctagagactgcttctcctcttgagattatggacaaagctcttgagacattcggaaacgacatcgcaatcgcctttagtggagcagaagacgttgctctcatcgagtatgctcatcttactggaagacccttcagggttttcagtttggacacagggagattgaatcccgaaacatacagactctttgataccgtggagaagcactatggtattcgaattgagtatatgtttcccgatgctgttgaggttcaagctttggttaggaacaagggtttgttctctttctacgaagatggtcaccaagagtgttgccggatcagaaaggtgagacctttgaggcgtgcgttgaaggggttacgcgcttggatcactggacaaaggaaagatcaatcaccagggacaaggtctgagattcctgttgttcaagttgatccagtgtttgaagggttagatggtggagctggtagtttggtgaagtggaatccagttgcgaacgtcgagggaaacgatgtttggaacttcttgaggacaatggatgttcctgtgaacacccttcacgctgcggggtatgtttcaatcggatgtgagccgtgcacgagagcggttttgcctggtcagcacgagagagaagggagatggtggtgggaagatgctaaggctaaagagtgtggacttcacaaagggaatatcaaggagagtagcaacggaaacgctaccgctaatgtcaatggcacatcctccacggttgctgatatcttcaaaagcgagaatgttgtgagcttgagcaggcaagggatcgagaatctgatgaagctggagaatcgtaaagaggcttggatcgttgtgctttacgcaccttggtgcccgttttgtcaagcgatggaagcttcttttgatgagttggcggataagttgggtgggagtggcgtgaaggtggccaagtttagagctgatggtgaccaaaaggagtttgctaaaagggagctgcagcttgggagcttcccaacaatacttgtgttcccaaagaactcttcaagaccaatcaagtatccatcagagaagagagatgttgattctttgacatcgttcttgaaccttgttcggtga

SEQ ID NO: 5991 - protein, 464 aa, Brassica juncea
MALAINVSSSSSSAISTSSFPSSELKVSAPRIGSLRLSDRVNVSSVSLSLSGKRSSVKPLNVQSIAKESFGSMVASEVTEKQDVVEVEDFEELAKSLETASPLEIMDKALETFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKESSNGNATANVNGTSSTVADIFKSENVVSLSRQGIENLMKLENRKEAWIVVLYAPWCPFCQAMEASFDELADKLGGSGVKVAKFRADGDQKEFAKRELQLGSFPTILVFPKNSSRPIKYPSEKRDVDSLTSFLNLVR

SEQ ID NO: 5992 - DNA, 1365 bp, Brassica juncea
  CDS (1)..(1365)
atggccttagctgtcacttcttcttcaactgccatctctggatcaagtttctcacgctctggaccttgttctgatcgtaaagctcttcaaatctgttcgtttaggttatctgatctatcccatgtctctcaaagacgttactctctaaaggctgagtcaccacctacacgcaacgactctttggttacccgtgcttcgaccctaatcactcctggagtggaagagaaggaagaagacgttgaggatttcgagcaactcgcgaagaagctcgaagaggcttctccacttgaaatcatggacaaagctctccagagattcggaagcaacatcgcaattgctttcagtggtgcggaagatgttgcactgatcgaatacgctcggttaaccggaaggcccttcagggttttcagcttagacacagggaggttaaaccccgaaacctacaggctcttcgatgccgtggagaagcagtacgggatccgaatcgagtacacgttccctgatgcggtcgaggttcaagctttggtgaggaacaagggtttgttctctttctacgaggacggtcaccaggagtgttgccgtgtgaggaaagtaagacccttgcgccgcgctctcaagggtctcaaagcttggatcactggacagaggaaagatcagtctccagggacgagatcagagatcccgatcgttcaggtcgatccggtgtttgaagggttggatggtggtgttgggagtcttgtcaagtggaatcctttggctaatgtcgaaggtggtgatgtttggaacttcttgaggacgatggacgttccggtgaatgcattgcacgcgcaagggtatgtttctattgggtgtgagccgtgcactaggcccgtgcttccgggtcagcacgagagagaaggaaggtggtggtgggaagatgctaaagctaaagaatgtggtctgcacaaagggaacatcaagaaggaagatgactccaccaccgcggatttagcacctgctattgtgcatgatatcttcgaaagcagcaatgtggttgcattgagcagaggagggattgagaatctgttgaagcttggtaaccgcaaagagccgtggttggttgtgctttacgctccttggtgcccgttttgccaggccatggaagcttcctacgtcgaattggctgagaaactggcggtcaaagggattaaggtggccaagtttcgggctgatggtgaccagaaggagtttgccaagcaagagcttcaattaggaagcttcccgacgatacttctcttcccgaaaagcgctccgcgggcaattaagtacccgtcagagcatagagatgtggattcgcttatgtcatttgtcaatcttctccggtga

SEQ ID NO: 5993 - protein, 454 aa, Brassica juncea
MALAVTSSSTAISGSSFSRSGPCSDRKALQICSFRLSDLSHVSQRRYSLKAESPPTRNDSLVTRASTLITPGVEEKEEDVEDFEQLAKKLEEASPLEIMDKALQRFGSNIAIAFSGAEDVALIEYARLTGRPFRVFSLDTGRLNPETYRLFDAVEKQYGIRIEYTFPDAVEVQALVRNKGLFSFYEDGHQECCRVRKVRPLRRALKGLKAWITGQRKDQSPGTRSEIPIVQVDPVFEGLDGGVGSLVKWNPLANVEGGDVWNFLRTMDVPVNALHAQGYVSIGCEPCTRPVLPGQHEREGRWWWEDAKAKECGLHKGNIKKEDDSTTADLAPAIVHDIFESSNVVALSRGGIENLLKLGNRKEPWLVVLYAPWCPFCQAMEASYVELAEKLAVKGIKVAKFRADGDQKEFAKQELQLGSFPTILLFPKSAPRAIKYPSEHRDVDSLMSFVNLLR

SEQ ID NO: 5994 - DNA, 1365 bp, Arabidopsis thaliana
  CDS (1)..(1365)
atggctttagctgttacttcttcttcaactgcaatctctggatcgagtttctctcgttctggagcttcttctgaatctaaagctcttcaaatatgttcgattaggttatctgatcgaacccatttgtctcagagacgttactctatgaaacctttaaacgctgagtcacattcacgaagcgaatcttgggttactcgtgcttcaactctaattgctcctgaagttgaagagaaaggaggagaagttgaagactttgagcaacttgctaaaaagcttgaagatgcttctccacttgaaatcatggataaagctcttgagagattcggagaccaaatcgcaattgcttttagtggagctgaagatgttgcattgattgaatatgcacgtttaactggaaagccatttagggtttttagtttagatacagggagattaaaccctgaaacgtacaggctctttgacgcagtcgagaagcagtacgggattcgaattgagtacatgtttcctgatgcagttgaggttcaagctttagtgaggaacaagggtttgttctcattctatgaagatggtcatcaagagtgttgccgtgtgaggaaagttagacctttgcgtcgtgctcttaagggtcttaaagcttggattacaggacagaggaaagaccaatctccgggtacgagatctgagatccctattgttcaggttgatccagtgtttgaagggttagatggcggtgttggaagtcttgtgaagtggaatcctttggctaatgttgaaggagctgatgtgtggaactttctgagaactatggatgttccggtgaatgcattgcacgcacaagggtatgtgtcaatcgggtgtgagccgtgtactaggccggtgcttccaggccaacatgagagagaaggaaggtggtggtgggaagatgctaaagctaaagaatgtggtctacacaaagggaacatcaaggaggaagatggtgctgcagactcaaagcctgctgctgtgcaagagatatttgaaagcaacaatgtggttgcattgagcaaaggaggggttgagaatcttttgaagctagagaaccgtaaagaggcgtggttggtcgtactttacgctccttggtgccctttctgccaggcgatggaagcatcgtacatcgaattggctgagaaacttgcgggaaaaggagttaaagtggcgaaattccgagctgacggtgagcagaaggagtttgctaagcaagagcttcagttagggagcttcccgacgatacttctctttccgaaaagagctccacgggctattaagtacccttcagagcatagagatgttgattcactcatgtcgtttgtgaatcttcttcggtga

SEQ ID NO: 5995 - protein, 454 aa, Arabidopsis thaliana
MALAVTSSSTAISGSSFSRSGASSESKALQICSIRLSDRTHLSQRRYSMKPLNAESHSRSESWVTRASTLIAPEVEEKGGEVEDFEQLAKKLEDASPLEIMDKALERFGDQIAIAFSGAEDVALIEYARLTGKPFRVFSLDTGRLNPETYRLFDAVEKQYGIRIEYMFPDAVEVQALVRNKGLFSFYEDGHQECCRVRKVRPLRRALKGLKAWITGQRKDQSPGTRSEIPIVQVDPVFEGLDGGVGSLVKWNPLANVEGADVWNFLRTMDVPVNALHAQGYVSIGCEPCTRPVLPGQHEREGRWWWEDAKAKECGLHKGNIKEEDGAADSKPAAVQEIFESNNVVALSKGGVENLLKLENRKEAWLVVLYAPWCPFCQAMEASYIELAEKLAGKGVKVAKFRADGEQKEFAKQELQLGSFPTILLFPKRAPRAIKYPSEHRDVDSLMSFVNLLR

SEQ ID NO: 5996 - DNA, 1377 bp, Arabidopsis thaliana
  CDS (1)..(1377)
atggcactagcaatcaacgtttcttcatcttcttcttctgcgatctcaagctctagcttcccttcttcagatctcaaagtaacaaaaatcggatcattgaggttattgaatcgtaccaatgtctctgcggcttctctgagtttgtccgggaagagatcctccgtgaaagctcttaatgtgcaatcaattacaaaggaatccattgttgcttctgaggttacagagaagctagatgtggtggaagttgaagactttgaggaactagcaaagagattagagaatgcttctcctcttgagatcatggataaagctcttgagaagtttgggaatgacattgctattgcctttagtggagctgaagatgttgctctgattgagtatgctcatttaactggaagaccttatagggtattcagtttggatacagggagattgaatccagaaacatatagactcttcgataccgtggagaaacattacggtattcggattgagtatatgtttcctgatgctgttgaggttcaagctttagttaggaacaagggtttgttctctttctatgaagatggtcaccaggagtgttgccgtattagaaaggtgagacctttgaggcgtgcgttgaagggtttacgtgcttggatcactggtcagaggaaagatcaatcacccgggacaagatcggagattcctgttgttcaggttgatccagtgtttgaaggattagatggtggagttggtagtttggtgaagtggaatccggttgctaatgttgaagggaatgatgtttggaatttcttgaggacgatggatgttcctgtcaacacgcttcacgctgcgggttatgtttcaatcggatgtgagccatgcacgagagcggttttgccgggtcagcatgagagagaagggagatggtggtgggaagatgctaaggctaaagagtgtggccttcacaaagggaatatcaaggagaataccaatggaaacgcaaccgctaatgtcaacgggacagcctcagtcgcggatatcttcaatagcgagaatgttgtgaacttgagcaggcaagggattgagaatttgatgaagttagagaaccggaaagaggcttggatcgttgtgctttatgcaccgtggtgcccgttttgtcaggcaatggaagcttcattcgatgaattggcggataagctgggaggaagtggtgtgaaggttgctaagtttagagctgatggtgaccagaaggactttgccaaaaaggagttgcagcttggaagctttccaacaatacttgtgttcccaaagaactcttcaagaccaatcaagtatccatcagagaagagagatgttgattctttgacatctttcttgaatcttgttcggtaa

SEQ ID NO: 5997 - protein, 458 aa, Arabidopsis thaliana
MALAINVSSSSSSAISSSSFPSSDLKVTKIGSLRLLNRTNVSAASLSLSGKRSSVKALNVQSITKESIVASEVTEKLDVVEVEDFEELAKRLENASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWNFLRTMDVPVNTLHAAGYVSIGCEPCTRAVLPGQHEREGRWWWEDAKAKECGLHKGNIKENTNGNATANVNGTASVADIFNSENVVNLSRQGIENLMKLENRKEAWIVVLYAPWCPFCQAMEASFDELADKLGGSGVKVAKFRADGDQKDFAKKELQLGSFPTILVFPKNSSRPIKYPSEKRDVDSLTSFLNLVR

SEQ ID NO: 5998 - DNA, 702 bp, Bacillus subtilis
  CDS (1)..(702): transl_table=11
atgttaacgtatgataattgggaagaaccaacgattacatttccggaagacgatccttataaaggagcgctgtcagttttaaaatgggcatacggccattacggcgatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagatctcacccttgaggaacaagccgaagaacatggtgacaaactatgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatatacatcccggaatgaactggactacaatccgcttcatgaccaaggctatccaagtattggctgtgcgccttgcacttctcccgcttttacagcagaagatttgcgctcaggcagatggaatggtatggcgaaaacagaatgcggactgcatgaataa

SEQ ID NO: 5999 - protein, 233 aa, Bacillus subtilis
MLTYDNWEEPTITFPEDDPYKGALSVLKWAYGHYGDQLVYACSFGIEGIVLIDLIYKVKKDAEIVFLDTGLHFKETYETIERVKERYPGLNIILKKPDLTLEEQAEEHGDKLWEREPNQCCYLRKVVPLREALSGHPAWLSGLRRDQGPSRANTNFLNKDEKFKSVKVCPLIHWTWKDIWRYTSRNELDYNPLHDQGYPSIGCAPCTSPAFTAEDLRSGRWNGMAKTECGLHE

SEQ ID NO: 6000 - DNA, 681 bp, Bacillus anthracis
  CDS (1)..(681): transl_table=11
atgttgacgtatgaaacgtgggaagaaaatgaaacgaaaggcgcgctatcagtattaagttgggcgtataaagaatataaaagtgaaattgtatacgcatgtagcttcggagtggaagggatggtactactggatcttattaaccaagtaaatccatctgctaaagttgtatttttggatacaaacgtacattttcaagaaacgtatgaattaattcaaaaagtgcgggaacgatttccttcattgaatattatagaaaaacagccaaaacttacacttgatgaacaagacaaattgcatggtgacaagctatgggaaagcaatcctaatctctgttgtaagattagaaaaattttaccgttagaagaatcattagcgaatgaaaaagcgtggatatcagggttgaggagagaacaatcagaaacgcgtaagcatacaaagtttataaatcaagatcatcgttttcaatctattaaagtttgtccgctcattcattggacgtggaaagaagtatggcgatatgtatacaagcatagcttgccgtataactcattacatgatattggatatccaagtattgggtgtgagaagtgtacgttgcctgtaggagagggtggcgattcgagagatggtagatgggctgggaaagtgaaaactgaatgtggtcttcattatcaataa

SEQ ID NO: 6001 - protein, 226 aa, Bacillus anthracis
MLTYETWEENETKGALSVLSWAYKEYKSEIVYACSFGVEGMVLLDLINQVNPSAKVVFLDTNVHFQETYELIQKVRERFPSLNIIEKQPKLTLDEQDKLHGDKLWESNPNLCCKIRKILPLEESLANEKAWISGLRREQSETRKHTKFINQDHRFQSIKVCPLIHWTWKEVWRYVYKHSLPYNSLHDIGYPSIGCEKCTLPVGEGGDSRDGRWAGKVKTECGLHYQ

SEQ ID NO: 6002 - DNA, 696 bp, Bacillus halodurans
  CDS (1)..(696): transl_table=11
gtggaccaatcaatccaagtgaatataaacgaagtcaatcaagccttggagcgtaaagatagcctcgatgtgattaagtgggcgtacaaaacatatggagataagctcgtgtacgcctgtagcatgggggcggaaggaatggttctaatcgatcttattagtaaagtgaggcccgacgctccagtcatttttctcgatacagattttcatttttcagaaacatatgaattgattgaacgggtcaaggagcggtacccgaagcttcagctgaagttagtgaagccggaacttacacctgaggagcaagcagaaacatacggtgatcgcctgtgggaacgtcaaccagacctttgctgtaagttgcggaagctcgtcccgttggagaaggaacttgcccaatacgacgcatggatgtcagggctacgccgagatcaatcaccgactcgaacaaatactcaatttgtgaatgaggatcgccgctttggttcaacgaaaatttgtcctttaatccattggaccagtgaggaaatttggatgtatatcgagcttcatcaattaccgtataatgaccttcatgataagcagtatccaagtatcggctgcgagtattgcacgcgtcctgtaaaagaaggagaagatgaacgagcaggtcgctggtccaacacatcaaaaacagagtgtggattgcaccaataa

SEQ ID NO: 6003 - protein, 231 aa, Bacillus halodurans
MDQSIQVNINEVNQALERKDSLDVIKWAYKTYGDKLVYACSMGAEGMVLIDLISKVRPDAPVIFLDTDFHFSETYELIERVKERYPKLQLKLVKPELTPEEQAETYGDRLWERQPDLCCKLRKLVPLEKELAQYDAWMSGLRRDQSPTRTNTQFVNEDRRFGSTKICPLIHWTSEEIWMYIELHQLPYNDLHDKQYPSIGCEYCTRPVKEGEDERAGRWSNTSKTECGLHQ

SEQ ID NO: 6004 - DNA, 735 bp, Buchnera aphidicola subsp
  CDS (1)..(735): transl_table=11
atgtctaaattctatattgaaaatattaatctgttaaattctgaaaaaaaaaataatatactttctgaattaaatttacttctatccaattattctgcagaagaacgtatttcttgggcattaagccatttaccccatacacaaatcatgtcatcaagcttcggtattcagtcaacagtattattacatcttataatcaaaaaaaaaccggatattcctgttatattaattgatacaggttatttgtttcctgaaacatataattttattgattttttaactaataaatttcatttgaatttgaaagtttttagatcaacaatatcttctgcgtggcaggaagcgcgatatgggaagttatgggaaaaaggtattgaaggaattgatttttataataatattaataaagtacagcccatgaattttgctttgaatgaactatcagtacaaacatggtttgctggattgcgtcatgatcaatcaaaaagtcgaaatttattaccatatctttctattaaaaaaggaatatttaaaattttaccaatactagattggtctaaggataaaataaaagactatttaaaagaaaataatttagatacccatcctttatataataatggatattcgtctgtaggagatacacacactactaaaaaacacatgcctggtatgttagaggaagaaactcgtttttttggattaaaacgcgaatgtggtttacatgaaaattaa

SEQ ID NO: 6005 - protein, 244 aa, Buchnera aphidicola subsp
MSKFYIENINLLNSEKKNNILSELNLLLSNYSAEERISWALSHLPHTQIMSSSFGIQSTVLLHLIIKKKPDIPVILIDTGYLFPETYNFIDFLTNKFHLNLKVFRSTISSAWQEARYGKLWEKGIEGIDFYNNINKVQPMNFALNELSVQTWFAGLRHDQSKSRNLLPYLSIKKGIFKILPILDWSKDKIKDYLKENNLDTHPLYNNGYSSVGDTHTTKKHMPGMLEEETRFFGLKRECGLHEN

SEQ ID NO: 6006 - DNA, 768 bp, Deinococcus radiodurans
  CDS (1)..(768): transl_table=11
gtgatgaccgctgaagtaagaactcccgaacagggcggcgggcctctaacgactgagccgcgcgcgccccgcagcgcaccgggacatgccgacgcttcggcccccgcttttggccccgaaaccgacccgcgcgacatcatccgctgggcgctggccgcgcaccccgacctgctgatgccgagtgcgttcaacctcaacggcgtggtgctgctcgacctcgcggcgcaggcgggctaccggggcgaagtcgtctttgtggacaccggctaccactttcccgaaacgctggcgacccgtgaccggctggaaagccgctaccctgagctgaccttcgtgaccctgaacgcgggcgcctcgccggatgacggacagacgccccccgatctctacgccagcgaccccgatgcctgttgcgcggcccgcaaggtggaccccttgcagcgctacttgaaggagcaaggtccctcggcgctcctcaacgcccgcagccgcgatcaggcgagcacccgcgccgacatcccctttgtggaggaaggcggcgcccggcgccgggtcaacccgctggcccactggacccgcgagcagctcgaggcctacgccgccgagcacgacctgccggtcaacccgctgtacttcgacggctttctgagcatcggctgctggccctgcacccgcgccgtgaaacccggcgaagatgcccgcgccggacgctgggcaggcaaaggcaagaccgaatgcggactgtggcagggcgagaacaagttgtaa

SEQ ID NO: 6007 - protein, 255 aa, Deinococcus radiodurans
MMTAEVRTPEQGGGPLTTEPRAPRSAPGHADASAPAFGPETDPRDIIRWALAAHPDLLMPSAFNLNGVVLLDLAAQAGYRGEVVFVDTGYHFPETLATRDRLESRYPELTFVTLNAGASPDDGQTPPDLYASDPDACCAARKVDPLQRYLKEQGPSALLNARSRDQASTRADIPFVEEGGARRRVNPLAHWTREQLEAYAAEHDLPVNPLYFDGFLSIGCWPCTRAVKPGEDARAGRWAGKGKTECGLWQGENKL

SEQ ID NO: 6008 - DNA, 735 bp, Escherichia coli O157
  CDS (1)..(735): transl_table=11
atgtccaaactcgatctaaacgccctgaacgaactgccgaaggtagatcgcattctggcgctggcggaaactaacgcccaactggaaaaactggacgctgaaggccgcgtagcctgggcgctggataatctgcccggtgaatatgtactttcttccagctttggcattcaggcggcggtgagcctgcatctggtgaatcaaattcgcccggatattccggtgatcctcaccgatacgggttacttgttcccggaaacctaccgctttattgacgagttaacggacaaactcaagctcaacctgaaagtgtaccgtgctaccgaaagcgcagcctggcaggaagcacgctacggaaaactgtgggaacagggcgttgaaggcattgaaaagtacaatgacatcaacaaagtcgaaccgatgaaccgggcgctgaaagaacttaacgcgcaaacctggtttgctggcctgcgccgtgaacaatccggcagtcgcgccaatttaccggtgctggcaattcagcgtggcgtatttaaagtgctgccgattatcgactgggataaccgaacgatatatcagtatctgcaaaagaatggcctgaaatatcacccattatgggacgaaggatatttatcggtgggcgatacccatacaacccgtaaatgggaacccggcatggcggaagaagaaacgcgtttctttggcttaaaaagggaatgtgggttacacgaagggtaa

SEQ ID NO: 6009 - protein, 244 aa, Escherichia coli O157
MSKLDLNALNELPKVDRILALAETNAQLEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKNGLKYHPLWDEGYLSVGDTHTTRKWEPGMAEEETRFFGLKRECGLHEG

SEQ ID NO: 6010 - DNA, 735 bp, Escherichia coli O6
  CDS (1)..(735): transl_table=11
atgtccaaactcgatctaaacgccctgaacgaactgccaaaggtagaccggattctggcgctggcggaaactaacgcccaactggaaaaactggacgctgaaggccgcgtagcctgggcgctggataatctgcccggtgaatatgtactttcttccagctttggcattcaggcggcggtgagtctgcatctggtgaatcagattcgcccggatattccagtgatcctcaccgataccggctatctgttcccggaaacctaccgctttattgacgagttaacggacaaactcaagctcaacctgaaagtgtaccgtgctaccgaaagcgccgcctggcaggaagcacgctacggcaaactgtgggagcagggcgttgaaggcattgaaaagtacaatgacatcaacaaagtcgaaccgatgaaccgggcgctgaaagaactgaatgcgcaaacctggtttgctggcctgcgccgtgaacaatccggcagtcgcgccaatttaccggtgctggcaattcagcgtggcgtatttaaagtgctgccgattatcgactgggataaccgaactatttatcagtacctgcaaaaacatggcctgaaatatcacccattatgggatgaaggatatttatcggtgggcgatacccatacaacccgtaaatgggaacccggcatggcggaagaagaaacgcgtttctttggcttaaaaagggaatgtggattacacgaagggtaa

SEQ ID NO: 6011 - protein, 244 aa, Escherichia coli O6
MSKLDLNALNELPKVDRILALAETNAQLEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 6012 - DNA, 735 bp, Escherichia coli
  CDS (1)..(735): transl_table=11
atgtccaaactcgatctaaacgccctgaacgaactgccgaaggtagatcgcattctggcgctggcggaaactaacgccgaactggaaaaactggacgctgaaggccgcgtagcctgggcgctggataatctgcccggtgaatatgtactttcttccagctttggcattcaggcggcggtgagcctgcatctggtgaatcaaattcgcccggatattccggtgatcctcaccgatacgggttacttgttcccggaaacctaccgctttattgacgagttaacggacaaactcaagctcaacctgaaagtgtaccgtgctaccgaaagcgcagcctggcaggaagcacgctacggaaaactgtgggagcagggcgttgaaggcattgaaaagtacaatgacatcaacaaagtcgaaccgatgaaccgggctctgaaagaactgaatgcgcaaacctggtttgctggcctgcgccgtgaacaatccggcagtcgtgccaatttaccggtgctggcaattcagcgtggcgtatttaaagtgctgccgattatcgactgggataaccgaactatttatcagtacctgcaaaaacatggcctgaaatatcacccattatgggatgaaggatatttatcggtgggcgatacccatacaacccgtaaatgggaacccggcatggcggaagaagaaacgcgtttctttggcttaaaaagggaatgtgggttacacgaagggtaa

SEQ ID NO: 6013 - protein, 244 aa, Escherichia coli
MSKLDLNALNELPKVDRILALAETNAELEKLDAEGRVAWALDNLPGEYVLSSSFGIQAAVSLHLVNQIRPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 6014 - DNA, 735 bp, Photorhabdus luminescens subsp
  CDS (1)..(735): transl_table=11
atgagccaattcagcttatctcaatgtgttagtatgactgctgaacaacaagagcaatcactggctgagattaatcttcggcttgaaatgatggatgctcaccagagagtaaactgggcattggaaaatttgccaggggagtttgttctttcctccagttttggtattcaggcggcggtatgtcttcatttagtgacacaagaatatcctgatattccggtcatacttactgataccggttatctattccctgaaacttatcaattcatagataaactcacaacgcaactgaaactgaatttgcaagtattcagtgctgagcattccccggcctggcaggaagctcgctatgggaaattgtgggagcaaggcgtagagggaatagagcgttacaatcagattaataaggttgaaccaatgaatcgggctttgaaaaatctgagagcacaaagttggtttgctggtttacgccgtcagcaatctgaaagtcgatcaaaattaccggttttagctgtacagcggggagtatttaagattttgccgattatcgactgggataaccggcgtgtgcatcaatatctgacaaaacatggcttggaatatcatccattatgggaacagggttatctctctgttggtgacatccatacaactcaaaaatgggaaccgggcatgagtgaagaacaaacccgtttttttggcttgaagcgagaatgtgggttacatgagaattaa

SEQ ID NO: 6015 - protein, 244 aa, Photorhabdus luminescens subsp
MSQFSLSQCVSMTAEQQEQSLAEINLRLEMMDAHQRVNWALENLPGEFVLSSSFGIQAAVCLHLVTQEYPDIPVILTDTGYLFPETYQFIDKLTTQLKLNLQVFSAEHSPAWQEARYGKLWEQGVEGIERYNQINKVEPMNRALKNLRAQSWFAGLRRQQSESRSKLPVLAVQRGVFKILPIIDWDNRRVHQYLTKHGLEYHPLWEQGYLSVGDIHTTQKWEPGMSEEQTRFFGLKRECGLHEN

SEQ ID NO: 6016 - DNA, 765 bp, Rhizobium loti
  CDS (1)..(765): transl_table=11
atgctggcgaaaccaaggccgcttgaccatatcggcgatgcagatgacggcgtcgccgccaaggcggcggggctcgatgcgctgtacggccatctgaagccgctcgagatcatcgaacgctcggcccgcgaactgtttcacgacgagatcgctgccgtgtcgtccttcggggcggattcggcggtgctgctgcacatgattgccgagatcgaccgcacgctgccggtcatcttcctcgacaccggcaagcatttcgaggagacgctcggctatcgcgacgcgcttgtcgctgatttcgggctgaccaacatccaggtcatcaagcccgaggaagccgcgctcgcgcggatcgacccgacgggcaatctgcaccagagcaacaccgatgcctgctgcgacgtgcgcaaggtcgagccgctggcacggggcgtggcgccgttccgtgcctggttcaccggccgcaagcgttttcaggcctcgacgcgggcagcgctgccggtgttcgaggcggtcggcgcgcgcatccgcatcaatccgctggcgcactggacgacatcggaccaggccgactacatgcgggcgcatgcgctgcgcgagaatccgctggtcgcctatggctatctgtcgatcggctgtttcccgtgcacgcaaccggtgcagccgggcgaggatgcgcgcagcggacgctgggccggtcatgccaagaccgaatgcggcattcacctgtcggggctggaagtgtcgctgaccgacgcatcactatag

SEQ ID NO: 6017 - protein, 254 aa, Rhizobium loti
MLAKPRPLDHIGDADDGVAAKAAGLDALYGHLKPLEIIERSARELFHDEIAAVSSFGADSAVLLHMIAEIDRTLPVIFLDTGKHFEETLGYRDALVADFGLTNIQVIKPEEAALARIDPTGNLHQSNTDACCDVRKVEPLARGVAPFRAWFTGRKRFQASTRAALPVFEAVGARIRINPLAHWTTSDQADYMRAHALRENPLVAYGYLSIGCFPCTQPVQPGEDARSGRWAGHAKTECGIHLSGLEVSLTDASL

SEQ ID NO: 6018 - DNA, 735 bp, Salmonella typhi
  CDS (1)..(735): transl_table=11
atgtcccaactcgatctcaacgcattgaatgaactgccaaaagtcgatcgcgtactggcgttggcggaaaccaacgctcaactggaaacgctgactgccgaagaacgcgtggcttgggcgctggaaaatctgcccggcgaatacgtgctctcctcaagctttggtatccaggcggcggtgagcctgcacctggtgaaccagattcgcccggatatcccggtgatcctcaccgataccggctatttgttcccggaaacctatcagtttattgatgagctaacggacaaactcaaactcaacctgaaagtttaccgcgcgggcgaaagtccggcctggcaggaagcgcgctacggcaagctgtgggagcagggcgttgagggcattgagaaatacaatgagatcaacaaagtcgagccgatgaaccgggcgctcaaagagttaaacgcgcagacctggtttgcgggtctgcgtcgcgagcagtccggtagccgcgcgcatttacccgttctcgctatccagcgcggcgtgtttaaagtgctaccgattatcgactgggataaccgcacggtttaccagtatctgcaaaagcacggtctgaaataccatccgctgtgggctcagggctatctgtcggtgggcgatacgcacaccacccgcaaatgggagccgggtatggcggaagaagagacacgcttcttcggactgaaacgtgagtgcgggctgcatgaagggtaa

SEQ ID NO: 6019 - protein, 244 aa, Salmonella typhi
MSQLDLNALNELPKVDRVLALAETNAQLETLTAEERVAWALENLPGEYVLSSSFGIQAAVSLHLVNQIRPDIPVILTDTGYLFPETYQFIDELTDKLKLNLKVYRAGESPAWQEARYGKLWEQGVEGIEKYNEINKVEPMNRALKELNAQTWFAGLRREQSGSRAHLPVLAIQRGVFKVLPIIDWDNRTVYQYLQKHGLKYHPLWAQGYLSVGDTHTTRKWEPGMAEEETRFFGLKRECGLHEG

SEQ ID NO: 6020 - DNA, 735 bp, Salmonella typhimurium
  CDS (1)..(735): transl_table=11
atgtcccaactcgatctcaacgcattgaatgaattgccaaaagtcgatcgcgtaatggctctggcggaaaccaacgcccaactggaaaaactgagcgccgaagaacgcgtggcctgggcgctggaaaatctgcccggcgaatacgtgctctcctcaagctttggcatccaggcggcggtgagcctgcacctggtgaaccagattcgcccggatatcccggtgatcctcaccgataccggctatttgttcccggaaacctaccagtttattgatgagctaacggacaaactcaaactcaacctgaaagtttaccgcgcgggcgaaagtccggcctggcaggaagcgcgctacggcaagctgtgggagcagggcgttgagggcattgagaaatacaatgagatcaacaaagtcgagccgatgaaccgggcgctaaaagagctgaaagcgcagacgtggtttgcgggtctgcgtcgcgagcagtccggcagccgcgcgcatttacccgttctcgctatccagcgcggcgtgtttaaagtgctaccgattatcgactgggataatcgcaccgtttaccagtacctgcaaaagcatggcctgaaataccatccgctgtgggatcagggctatctgtcggtgggcgatacgcacaccacccgcaaatgggagccgggtatggcggaagaagagacacgcttcttcgggctgaagcgcgagtgcgggctgcatgaagggtaa

SEQ ID NO: 6021 - protein, 244 aa, Salmonella typhimurium
MSQLDLNALNELPKVDRVMALAETNAQLEKLSAEERVAWALENLPGEYVLSSSFGIQAAVSLHLVNQIRPDIPVILTDTGYLFPETYQFIDELTDKLKLNLKVYRAGESPAWQEARYGKLWEQGVEGIEKYNEINKVEPMNRALKELKAQTWFAGLRREQSGSRAHLPVLAIQRGVFKVLPIIDWDNRTVYQYLQKHGLKYHPLWDQGYLSVGDTHTTRKWEPGMAEEETRFFGLKRECGLHEG

SEQ ID NO: 6022 - DNA, 738 bp, Shewanella oneidensis
  CDS (1)..(738): transl_table=11
gtgagcagtagcgaacttaaggcgctgctaacggcgcctaagagcgttcagcaagcagaacttgaacgcattaatcgtttcttagccggattaacggctcaagagcgagtgctctggggcttggcctatttgcccggtaatcacgcgctgtcatccagttttgggatccaagcggcggtgatgctgcatatggtgagtcaggtgcaatcggatattccggtgatcttaacggatactggctatttatttcccgagacgtatcagtttattgaccagttgaccgagcgattatccttaaatcttaaggtttaccaagcacctattacctcggcatggcaggaggcgcgctttggccaattgtgggaacaaggggtagagggtcttgaacgttataatcggctgaataaggtggagccaatgcagcgcgccttggccgagcttgaagtcggaacttggtttgctggactacgccgcagccagtcgagcactcgcgaagagttaccgatattggctatccatggttctcgcttcaagttgctgccgattatcgaatggtcgaacaaagatgtgcatctgtatctgacgcaatttgacttgccttatcatcctttatgggagcaaggttatgtttctgttggggatactcattcgagcaaacccttagaattaggtatgacagaggaagaaacgcgctttaatggcttaaaacgtgagtgcggtttgcattacgaaatatag

SEQ ID NO: 6023 - protein, 245 aa, Shewanella oneidensis
MSSSELKALLTAPKSVQQAELERINRFLAGLTAQERVLWGLAYLPGNHALSSSFGIQAAVMLHMVSQVQSDIPVILTDTGYLFPETYQFIDQLTERLSLNLKVYQAPITSAWQEARFGQLWEQGVEGLERYNRLNKVEPMQRALAELEVGTWFAGLRRSQSSTREELPILAIHGSRFKLLPIIEWSNKDVHLYLTQFDLPYHPLWEQGYVSVGDTHSSKPLELGMTEEETRFNGLKRECGLHYEI

SEQ ID NO: 6024 - DNA, 735 bp, Shigella flexneri
  CDS (1)..(735): transl_table=11
atgtccaaactcgatctaaacgccctgaacgaactgccgaaggtagatcgcattctggcgctggcagaaactaacgccgaactggaaaaactggacgctgaaggccgcgttgcctgggcgctggataatctgcccggtgaatatgtactttcttccagctttggcattcaggcggcggtgagcctgcatctggtgaatcagattcacccggatattccggtgatcctcaccgacaccggctatctgttcccggaaacctaccgctttattgacgagttaacggacaaactcaagctcaacctgaaagtgtaccgcgctaccgaaagcgccgcctggcaggaagcacgctacggcaaactgtgggaacagggcgttgaaggcattgaaaagtacaatgacatcaacaaagtcgaaccgatgaaccgggcgctgaaagaactgaatgcgcaaacgtggtttgctggcctgcggcgtgaacaatccggcagccgtgccaatttaccggtgctggcaattcagcgtggcgtatttaaagtgctgccgattatcgactgggataaccgaactatttatcagtacctgcaaaaacatggcctgaaatatcacccattatgggacgaaggatatttatcggtgggcgatacccatacaacccgtaaatgggaacccggcatggcggaagaagaaacgcgtttctttggcttaaaaagggaatgtggattacacgaagggtaa

SEQ ID NO: 6025 - protein, 244 aa, Shigella flexneri
MSKLDLNALNELPKVDRILALAETNAELEKLDAEGRVAWALDNLPGEYVLSSSFGIQAAVSLHLVNQIHPDIPVILTDTGYLFPETYRFIDELTDKLKLNLKVYRATESAAWQEARYGKLWEQGVEGIEKYNDINKVEPMNRALKELNAQTWFAGLRREQSGSRANLPVLAIQRGVFKVLPIIDWDNRTIYQYLQKHGLKYHPLWDEGYLSVGDTHTTRKWEPGMAEEETRFFGLKRECGLHEG

SEQ ID NO: 6026 - DNA, 732 bp, Staphylococcus epidermidis
  CDS (1)..(732): transl_table=11
atgtctatagaaagaattacttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtcaaattctagtaagactgaatgcgggttacatgtaactgataaaccataa

SEQ ID NO: 6027 - protein, 243 aa, Staphylococcus epidermidis
MSIERITYDNFQNDPFINELDINDETKGAYEILKWAYQTYENDIVYSCSFGAESMVLIDLISQIKPDAQIVFLDTDLHFQETYDLIDRVKDKYPQLRIKMKKPELTLEEQGEKYNPALWKNDPNQCCYIRKIKPLEDVLSGAVAWISGLRRAQSPTRAHTNFINKDERFKSIKVCPLIYWTEEEVWSYIRDKDLPYNELHDQNYPSIGCIPCTSPVFDSNDSRAGRWSNSSKTECGLHVTDKP

SEQ ID NO: 6028 - DNA, 732 bp, Staphylococcus epidermidis
  CDS (1)..(732): transl_table=11
atgtctatagaaagaattacttatgacaattttcaaaacgatccatttataaatgaattagatattaatgatgagacaaaaggcgcttatgagattttaaaatgggcatatcaaacttatgaaaatgatattgtttattcttgcagttttggtgctgagagtatggttttgattgacttgatttctcaaattaaacccgacgcacaaattgtatttttagacactgatttacattttcaagaaacatatgacttaatagatagggtgaaagataaatatccgcaattacgcattaaaatgaaaaaaccggaacttacgttagaggaacaaggtgagaaatataatcctgctttatggaagaatgatcctaaccaatgttgctacatacgcaagattaaaccactagaagacgtattatctggtgctgtagcttggatatcaggtcttagacgagcacaatcaccaacacgagcacatacaaatttcattaacaaagatgaaagatttaagtcaattaaagtgtgtcccttaatctattggacagaagaagaagtatggtcttatatacgtgataaggacttaccttataatgaattacatgatcaaaattatccaagtattggttgcattccatgtacatcacccgtatttgattctaatgattcacgtgctggtcgttggtcaaattctagtaagactgaatgcgggttacatgtagctgataaaccataa

SEQ ID NO: 6029 - protein, 243 aa, Staphylococcus epidermidis
MSIERITYDNFQNDPFINELDINDETKGAYEILKWAYQTYENDIVYSCSFGAESMVLIDLISQIKPDAQIVFLDTDLHFQETYDLIDRVKDKYPQLRIKMKKPELTLEEQGEKYNPALWKNDPNQCCYIRKIKPLEDVLSGAVAWISGLRRAQSPTRAHTNFINKDERFKSIKVCPLIYWTEEEVWSYIRDKDLPYNELHDQNYPSIGCIPCTSPVFDSNDSRAGRWSNSSKTECGLHVADKP

SEQ ID NO: 6030 - DNA, 750 bp, Synechocystis sp
  CDS (1)..(750): transl_table=11
atgtcccatactctgactaagctcgatctacccaccttacaaacggagctggaaaatgccaccgcccaacagatcattacctgggcggcccaaacctttggccctggcttggtgatgagtactagttttggcattcaggcggcggtgatgctccatttagtgactagcattgtgcccaatattcctgttatctggattgacacgggctatttaccgctggaaacctatcaatttgcggatcagttgaccggacggctacagctaaatttaaaggtttaccaatctcccctcagcccagctcgcatggaagctctgtacggcaagctctggcaacaaaaagacgtggaatccctcaaccgttatgatcaaatccgcaaagttgaaccgatgcagagggcattaaaagaactagaggcgatcgcctggttgacggggttaaggagggatcaaactcggcaccgccagaatttgaaaccagtggatctccagggtaatcagtataaagttctccccattttggactggaattctaagatggtttacgaatatctcaccgcccacgatttaccctaccatccgttttttgaccagggttacgtctctgtgggggattggcattctagccggcccctgatggcccacgatgaagatgaaagggatacccgtttccacggcctcaaacaggaatgtggtttacatttacccctgtccccggaagctggccagagtttggattccagtgctttgtag

SEQ ID NO: 6031 - protein, 249 aa, Synechocystis sp
MSHTLTKLDLPTLQTELENATAQQIITWAAQTFGPGLVMSTSFGIQAAVMLHLVTSIVPNIPVIWIDTGYLPLETYQFADQLTGRLQLNLKVYQSPLSPARMEALYGKLWQQKDVESLNRYDQIRKVEPMQRALKELEAIAWLTGLRRDQTRHRQNLKPVDLQGNQYKVLPILDWNSKMVYEYLTAHDLPYHPFFDQGYVSVGDWHSSRPLMAHDEDERDTRFHGLKQECGLHLPLSPEAGQSLDSSAL

SEQ ID NO: 6032 - DNA, 762 bp, Vibrio cholerae
  CDS (1)..(762): transl_table=11
atgcctaatcgtaccgttccaacactagaagagttactaacgttaaataaggtgcagcaaacgctgcgcctaacggaagtcaatcagcatctggaatccctcactgcgcaagagcgcgtcgtctggggtctagaaaatctgcagggcaatcatgcactgtcatcgagctttggtatccaagccgcagtgatgcttcatttattaacttcagtgaagagtgacattcctgtcgttttaaccgataccggctatctgttcccagaaacctatcagtttatcgatgagttgactgagcggctcaatctgaacttaaaagtttactccgcgcctgtatcagcggcttggcaagaagctcgctacggaaaactgtgggaacaaggtgttgaaggaatcgaacgctacaaccagattaataaagtagaaccgatgcgtagagcattagatgaactcaacattggcacttggttctcgggcttacgacgtgaacagtcacaatcacgagcaagcctaccgattctatcggtacaaaatggcgtgtttaaattcctgccagtgatcgattggaccaataaagaggtgcactattatctcaaggataacgatctaccttatcacccactttgggaacaaggttatctttcggttggtgatacacacaccacacagaaatggcagccgggaatgaatgaagagcaaactcgcttctttggtttaaagcgtgagtgtgggttacacgaagatcataacgatacacatcaataa

SEQ ID NO: 6033 - protein, 253 aa, Vibrio cholerae
MPNRTVPTLEELLTLNKVQQTLRLTEVNQHLESLTAQERVVWGLENLQGNHALSSSFGIQAAVMLHLLTSVKSDIPVVLTDTGYLFPETYQFIDELTERLNLNLKVYSAPVSAAWQEARYGKLWEQGVEGIERYNQINKVEPMRRALDELNIGTWFSGLRREQSQSRASLPILSVQNGVFKFLPVIDWTNKEVHYYLKDNDLPYHPLWEQGYLSVGDTHTTQKWQPGMNEEQTRFFGLKRECGLHEDHNDTHQ

SEQ ID NO: 6034 - DNA, 780 bp, Vibrio parahaemolyticus
  CDS (1)..(780): transl_table=11
atgcttgattctgtggcttccaaaccggagctggcggagttactgacattaacaaagacggagcaaatactccgtcttgcacaaatcaatgtcgaacttgaaccgctgtcggcacaagagcgagtaaagtgggctttggaaaatctggatggagagtttgcggtatcctcaagctttggtatccaagccgctgtcatgcttcatcttgtgactcaagaaaaacctgacatcccaattattcttacggataccggatatctgtttgcagaaacgtatcgctttattgatgagttgacagaaaaactcaaccttaatctaaaagtttatcgagcggagcaaagtgctcaatggcaagaagcacgttatggcaaattatgggagcagggcgttgaggggatcgagaagtacaacaaaataaataaagtcgagccaatgcgtcgtgcattgaaagaacttaatgttggaacatggttttcaggtttacgtagagagcaaagtaaatcacgagcgggtttaccgatactgtcgattcaaaatggcgtgtttaagtttctgcccgtaatcgattggacgaataaagatgttcactactacctcgagcaacatggtcttacctatcacccactttgggaagaaggttacttgtctgttggggatacacatacgacacgtaaatgggagccaggaatgtcagaggaagagactcgcttctttggtttaaagcgtgaatgtggacttcatgaagatgatggtaatgaacaagatggttcaggtatctag

SEQ ID NO: 6035 - protein, 259 aa, Vibrio parahaemolyticus
MLDSVASKPELAELLTLTKTEQILRLAQINVELEPLSAQERVKWALENLDGEFAVSSSFGIQAAVMLHLVTQEKPDIPIILTDTGYLFAETYRFIDELTEKLNLNLKVYRAEQSAQWQEARYGKLWEQGVEGIEKYNKINKVEPMRRALKELNVGTWFSGLRREQSKSRAGLPILSIQNGVFKFLPVIDWTNKDVHYYLEQHGLTYHPLWEEGYLSVGDTHTTRKWEPGMSEEETRFFGLKRECGLHEDDGNEQDGSGI

SEQ ID NO: 6036 - DNA, 777 bp, Vibrio vulnificus
  CDS (1)..(777): transl_table=11
atgcttgattctgttgcttcaacgctgcagctatcagaattactctcgttaaccaaggcggagcaaagtatccgccttgccgaaatcaacgttgagttagagatgctgtcagctcaagagagggtcgcttgggctctgcaaaatttggaaggggcacacgctgtttcgtcgagttttgggattcaagcggctgtcatgctgcatttggtatcgaagcagcaagccgatattcccgtcattttgaccgatacgggctacctatttcctgaaacgtatcaatttattgatgagttaactaaatctctaaacctaaaccttaaagtataccgagcgaatgagagtgcaaactggcaggaagctcgatacggtaaactgtgggagcaaggtatagaaggaatagaaaaatacaacaagcttaataaagtcgaacctatgcgtcgtgcactgaatgagcttaatgttaaaacctggttttccggattacgccgagagcaatctcagtcccgagcaggcctacctattctgtcgatacaaaatggagtgtttaaattcttgcctgtagttgattggagtaacaaagacgtacactactatttaaaagaacatggtctttcatatcatcccctttgggagcagggctatctttctgtaggagatacgcatacaactcaaaaatgggagccagggatgagtgaagaagaaactcgtttctttggcttgaagcgtgagtgtggacttcacgaagaagataatgaacaagatggttctggtatttaa

SEQ ID NO: 6037 - protein, 258 aa, Vibrio vulnificus
MLDSVASTLQLSELLSLTKAEQSIRLAEINVELEMLSAQERVAWALQNLEGAHAVSSSFGIQAAVMLHLVSKQQADIPVILTDTGYLFPETYQFIDELTKSLNLNLKVYRANESANWQEARYGKLWEQGIEGIEKYNKLNKVEPMRRALNELNVKTWFSGLRREQSQSRAGLPILSIQNGVFKFLPVVDWSNKDVHYYLKEHGLSYHPLWEQGYLSVGDTHTTQKWEPGMSEEETRFFGLKRECGLHEEDNEQDGSGI

SEQ ID NO: 6038 - DNA, 726 bp, Xanthomonas axonopodis pv
  CDS (1)..(726): transl_table=11
atgaccgcgctgcctgctgcatcgatcacttcttccgcgttcgacgatctggacgcgctcaatgcgcagctggaagggctgcgtgccgatcaacgcgtggcctgggcgctgcagcacggcccgcagaacgcggccttgtcgtccagcttcggcgcgcaatcggcggttaccttgcatctgctcagtcagcaacgtccggacatcccggtaatcctgatcgacaccggttatctgtttccggaaacctaccgttttgccgatgccttgaccgagcgactcaagctcaatctcaaggtctatcgcccgctggtcagccgcgcctggatggaagcgcgccacggccgcctgtgggagcaaggcatggtcggcatcgatcaatacaacaatctgcgcaaggtcgaaccgatgcgccgggccttgaacgaactcgacgtgggcacctggtttaccggcctgcgccgcagccagtccggcggccgcgcgcagacgccgatcatgcagaagcgcggcgagcgttacaaaatcagcccgatcgccgactggaccgatcgcgatgtgtggcaatacctgcaagcgcacgacctgccgtatcacccgctctgggaacaaggctacgtgtccatcggcgatttccacaccacgcgtcgctgggagcccggcatgcgcgaagaagacacgcgcttttacggtctcaagcgcgagtgcggcatccacgaagatatctag

SEQ ID NO: 6039 - protein, 241 aa, Xanthomonas axonopodis pv
MTALPAASITSSAFDDLDALNAQLEGLRADQRVAWALQHGPQNAALSSSFGAQSAVTLHLLSQQRPDIPVILIDTGYLFPETYRFADALTERLKLNLKVYRPLVSRAWMEARHGRLWEQGMVGIDQYNNLRKVEPMRRALNELDVGTWFTGLRRSQSGGRAQTPIMQKRGERYKISPIADWTDRDVWQYLQAHDLPYHPLWEQGYVSIGDFHTTRRWEPGMREEDTRFYGLKRECGIHEDI

SEQ ID NO: 6040 - DNA, 726 bp, Xanthomonas campestris pv
  CDS (1)..(726): transl_table=11
atgaccgcgctgcctgccacatcgatcgccgctccttcgctggacgacctggacgcgctcaacgcgcacctggagacgctgcgcgccgacgaacgcgttgcctgggcgctgcagcacggcccgcagcaggcggcgctgtcgtccagcttcggcgcgcagtcggcggtgacgctgcacctgctcacccagcagcgcccggacatcccggtgatcctgatcgacaccggctacctgttcccggagacctaccgctttgccgatgcattgaccgaacgcctttcgctcaacctgcaggtgtatcgcccgctggtcagccgcgcctggatggaggcacgccatggccgtctgtgggaacagggcatggtgggcatcgaccagtacaacaacctgcgcaaggtcgaaccgatgcgccgcgcactggacgaactcaacgtcggcacctggttcaccggcctacgccgcagccagtccggtgggcgtgcgcagacgccgatcgtgcagaagcgcggggaccgctacaagatcagcccgatcgccgactggaccgaccgcgacgtctggcaatacctgcaggcgcacgcactgccgtatcacccgctgtgggaacagggctatgtgtcgattggtgacttccacaccacccgtcgctgggagccgggcatgcgcgaagaagacacgcgcttctttgggctcaagcgcgagtgcggcatccacgaagacatctga

SEQ ID NO: 6041 - protein, 241 aa, Xanthomonas campestris pv
MTALPATSIAAPSLDDLDALNAHLETLRADERVAWALQHGPQQAALSSSFGAQSAVTLHLLTQQRPDIPVILIDTGYLFPETYRFADALTERLSLNLQVYRPLVSRAWMEARHGRLWEQGMVGIDQYNNLRKVEPMRRALDELNVGTWFTGLRRSQSGGRAQTPIVQKRGDRYKISPIADWTDRDVWQYLQAHALPYHPLWEQGYVSIGDFHTTRRWEPGMREEDTRFFGLKRECGIHEDI

SEQ ID NO: 6042 - DNA, 714 bp, Xylella fastidiosa
  CDS (1)..(714): transl_table=11
atgaccgtacttcccgccttacctcctctggacgatctggaaacgctcaacgtccacctagaaacgctgagtgctgaaaatcgcgtgtgctgggcactggagcgcggtcctgaccaccctgcactgtcttccagcttcggcgcgcaatcggccgtcatgctgcatctactcacccggtttgcaccggatattccggtgatcctggtcgacaccggctatcttttcccagaaacctaccgtttcgccgacacgctgaccgaacgactcaagctcaatctgaaggtataccagccgctgcgtagcggcgcttggacggaagcccgtcatggtcgactatgggaacaagggatcgacggaattaatcaatacaacaccctgcacaaggtcgaaccgatgcgcagggcattagaggaattgcaagtcggcacctggtttaccggcctacgtcgcggacaatccagtacccgtacccaaacatcaatcgtgcaacagcgtgacgagcggtacaaaatcagcccaattgcagactggaccgaccgcgatatctgggaatacatgaaacaccatgatctgccctatcacccgctttgggaacagggctacgtttcaatcggcgacattcacacgacacgccccttggaaccaggcatgcgcgaagaagacacacgcttcttcggattcaaacgtgaatgcgggattcacgagaacatctaa

SEQ ID NO: 6043 - protein, 237 aa, Xylella fastidiosa
MTVLPALPPLDDLETLNVHLETLSAENRVCWALERGPDHPALSSSFGAQSAVMLHLLTRFAPDIPVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQQRDERYKISPIADWTDRDIWEYMKHHDLPYHPLWEQGYVSIGDIHTTRPLEPGMREEDTRFFGFKRECGIHENI

SEQ ID NO: 6044 - DNA, 714 bp, Xylella fastidiosa
  CDS (1)..(714): transl_table=11
atgaccgtacttcccgccttacctcctctggacgatctggaaacgctcaacgtccacctagaaacgctgagtgctgaaaatcgcgtgtgctgggcactggagcacggtcctgaccaccctgcactgtcttccagcttcggcgcgcaatcggccgtcatgctgcatctactcacccggtttgcaccggatattacggtgatcctggtcgacaccggctatcttttcccagaaacctaccgtttcgccgacacgctgaccgaacgactcaagctcaatctgaaggtataccagccgctgcgtagcggcgcttggacggaagcccgtcatggtcgactatgggaacaagggatcgacggaattaatcaatacaacaccctgcacaaggtcgaaccgatgcgcagggcattagaggaattgcaagtcggcacctggtttaccggcctacgtcgcggacaatccagtacccgtacccaaacatcaatcgtgcaacgacgtgacgagcggtacaaaatcagtccaattgccgactggaccgaccgtgatatctgggaatacatgaaacaccatgatctgccctatcacccgctttgggaacagggctacgtttcaatcggtgacattcacacgacacgccccttggaaccagacatgcgcgaggaggacacacgcttcttcggattcaaacgtgagtgcgggattcacgagaacatctaa

SEQ ID NO: 6045 - protein, 237 aa, Xylella fastidiosa
MTVLPALPPLDDLETLNVHLETLSAENRVCWALEHGPDHPALSSSFGAQSAVMLHLLTRFAPDITVILVDTGYLFPETYRFADTLTERLKLNLKVYQPLRSGAWTEARHGRLWEQGIDGINQYNTLHKVEPMRRALEELQVGTWFTGLRRGQSSTRTQTSIVQRRDERYKISPIADWTDRDIWEYMKHHDLPYHPLWEQGYVSIGDIHTTRPLEPDMREEDTRFFGFKRECGIHENI

SEQ ID NO: 6046 - DNA, 801 bp, Schizosaccharomyces pombe
  CDS (1)..(801)
atgagctcaatcgatacgcctgctaataaattgcaagcgaaaaccttgtttcacccagaacatctcgaatacatcaacaagcagttatcggagcttagtcctcaagatatcttaaaatggtgccgttggacacttccttctttgtttcaaacatctgcgttaggactgtccgggcttgttattatggacatgttatcgaaaatggatatgaatgttcctctgatttttatcaacacacttcatcatttcccagaaacactggatcttcttgaaaaagtcaaaactaagtatcctaacgtgcctgttcacgtctatcgttgtgctgaagcagccaacgaaaaggaatttgctcagaagtttggtgagaagctttgggagacagatgaatctcggtatgactttttagtcaaagtggaaccagcaagtcgtgcttattctgacttaaatgtacttgctgtgtttactggccgccgccgtagtcaaggtggagagcgcggatctttgcccattgttcagctggatggaccagtattaaagatcaaccccttggctaactggtcttttactgaagttcataattatattattacaaacaacgttccatataatgaacttctgaacaagggttacagatcagttggtgactggcactctactcaaccagttagagaaggtgaagatgaacgtgccggacgttggcgcggtcgagagaaaacagaatgtggattacacagtcatcctcaaagtaaattcgcacaatatatggcggagcttaaaaagaaggagacggctgatcagtga

SEQ ID NO: 6047 - protein, 266 aa, Schizosaccharomyces pombe
MSSIDTPANKLQAKTLFHPEHLEYINKQLSELSPQDILKWCRWTLPSLFQTSALGLSGLVIMDMLSKMDMNVPLIFINTLHHFPETLDLLEKVKTKYPNVPVHVYRCAEAANEKEFAQKFGEKLWETDESRYDFLVKVEPASRAYSDLNVLAVFTGRRRSQGGERGSLPIVQLDGPVLKINPLANWSFTEVHNYIITNNVPYNELLNKGYRSVGDWHSTQPVREGEDERAGRWRGREKTECGLHSHPQSKFAQYMAELKKKETADQ

SEQ ID NO: 6048 - DNA, 1395 bp, Brassica napus
  CDS (1)..(1395)
atggcactagcaatcaacgtttcttcatcttcttctgcgatctcaacctctagcttcccttcttcagacctcaaagctccacaaatcggttcgttgaggttatcagatcgtatcaatgtctcatcagcgtctctaggtctatccgggaaacgatcctcggtgaaagctctgaacgtgcagtcaatcacaaaggaatctacggttcctcctcaagcagcatccatggttgcctctgagattagagagaaagtagatgtgatcgaagtggaagactttgaggagctagcaaagaagctagagaccgcttctcctcttgaaatcatggacaaggctcttgaaaaattcggaaacgatattgcaattgcctttagtggagctgaagatgttgctcttattgagtatgctcatttaacaggaagaccttacagagtattcagcttagacacagggagattgaatccagaaacatacagactcttcgacaccgtggagaaacactacggtattcgaatcgagtacatgtttcctgacgcagttgaggttcaagctttggttagaaacaaaggtctgttctctttctacgaagacggtcaccaagagtgttgccgcatcagaaaagtgagaccgttgaggcgtgctttaaaaggtttacgcgcttggatcacgggacaaagaaaagatcaatcaccagggacaagatcagagatccccgtcgttcaagtcgatccagtgtttgaaggactagacggtggagttggcagtttggtgaagtggaacccggttgcgaacgtagaagggaacgatgtttggagctttttgaggactatggatgttcccgtcaacacgctgcacgctgcggggtatgtttccatagggtgcgagccgtgcacgagggcggttttgccaggtcagcacgagagggaagggaggtggtggtgggaagacgctaaggctaaagagtgtggacttcacaaagggaacatcaaagagagtaacgcaacggttaatgtcaatggaacaacatcaacggtcgatgatattttcagaagcgagaacgttgtgagcttgagcaggcaagggattgagaatctgatgaagctggagaacaggaaggaggcgtggatcgttgtgctttatgcgccttggtgcccgttttgccaagcgatggaggcttcgtttgatgagttggcggataagttgaagggaggagatggcgtgaaggtggctaagtttagagcggatggtgagcaaaaggagtttgctaagagtgagttgcagctagggagctttccgacgatacttgtgttcccaaagaactcttcaagacctatcaagtatccatctgagaagagggatgttgattctttgacatctttcttgaatcttgttaggtaa

SEQ ID NO: 6049 - protein, 464 aa, Brassica napus
MALAINVSSSSSAISTSSFPSSDLKAPQIGSLRLSDRINVSSASLGLSGKRSSVKALNVQSITKESTVPPQAASMVASEIREKVDVIEVEDFEELAKKLETASPLEIMDKALEKFGNDIAIAFSGAEDVALIEYAHLTGRPYRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGVGSLVKWNPVANVEGNDVWSFLRTMDVPVNTLHAAGYVSIGCEPCTRAVLPGQHEREGRWWWEDAKAKECGLHKGNIKESNATVNVNGTTSTVDDIFRSENVVSLSRQGIENLMKLENRKEAWIVVLYAPWCPFCQAMEASFDELADKLKGGDGVKVAKFRADGEQKEFAKSELQLGSFPTILVFPKNSSRPIKYPSEKRDVDSLTSFLNLVR

SEQ ID NO: 6050 - DNA, 27 bp, Artificial sequence
  primer
atgaagacctatcatttgaataatgat

SEQ ID NO: 6051 - DNA, 25 bp, Artificial sequence
  primer
ctaggcatcttgctttaaaaattgc

SEQ ID NO: 6052 - protein, 228 aa, Artificial sequence
  consensus sequence
  Variant (2)..(18): Xaa in position 2 to 18 is any amino acid
  Variant (19)..(30): Xaa in position 19 to 30 is any or no amino acid
  Variant (33)..(37): Xaa in position 33 to 37 is any amino acid
  Variant (40)..(68): Xaa in position 40 to 68 is any amino acid
  Variant (69)..(76): Xaa in position 69 to 76 is any or no amino acid
  Variant (78)..(91): Xaa in position 78 to 91 is any amino acid
  Variant (92)..(95): Xaa in position 92 to 95 is any or no amino acid
  Variant (97)..(98): Xaa in position 97 to 98 is any amino acid
  Variant (100)..(109): Xaa in position 100 to 109 is any amino acid
  Variant (110)..(111): Xaa in position 110 to 111 is any or no amino acid
  Variant (113)..(114): Xaa in position 113 to 114 is any amino acid
  Variant (116)..(116): Xaa in position 116 is any amino acid
  Variant (118)..(119): Xaa in position 118 to 119 is any amino acid
  Variant (121)..(123): Xaa in position 121 to 123 is any amino acid
  Variant (124)..(124): Xaa in position 124 is any or no amino acid
  Variant (126)..(137): Xaa in position 126 to 137 is any amino acid
  Variant (138)..(148): Xaa in position 138 to 148 is any or no amino acid
  Variant (150)..(151): Xaa in position 150 to 151 is any amino acid
  Variant (153)..(155): Xaa in position 153 to 155 is any amino acid
  Variant (157)..(163): Xaa in position 157 to 163 is any amino acid
  Variant (165)..(174): Xaa in position 165 to 174 is any amino acid
  Variant (176)..(178): Xaa in position 176 to 178 is any amino acid
  Variant (181)..(181): Xaa in position 181 is any amino acid
  Variant (183)..(183): Xaa in position 183 is any amino acid
  Variant (185)..(188): Xaa in position 185 to 188 is any amino acid
  Variant (189)..(190): Xaa in position 189 to 190 is any or no amino acid
  Variant (192)..(199): Xaa in position 192 to 199 is any amino acid
  Variant (200)..(209): Xaa in position 200 to 209 is any or no amino acid
  Variant (211)..(216): Xaa in position 211 to 216 is any amino acid
  Variant (217)..(223): Xaa in position 217 to 223 is any or no amino acid
  Variant (227)..(227): Xaa in position 227 is any amino acid
VXXXXXXXXXXXXXXXXXXXXXXXXXXXXXDTXXXXXETXXXXXXXXXXXXXXXXXXXXXXXXXXXXXXXXXXXXXGXXXXXXXXXXXXXXXXXXKXXPXXXXXXXXXXXXWXXGXRXXQXXXXRXXXXXXXXXXXXXXXXXXXXXXXKXXPXXXWXXXXXXXYXXXXXXXXXXLXXXGYXSXGXXXXXXTXXXXXXXXXXXXXXXXXXRXXXXXXXXXXXXXECGXH

SEQ ID NO: 6053 - protein, 19 aa, Artificial sequence
  protein pattern
  Variant (2)..(4): Xaa in position 2 to 4 is any or no amino acid
  Variant (6)..(6): Xaa in position 6 is any amino acid
  Variant (7)..(7): Xaa in position 7 is Ala, Asp, Glu or Ser
  Variant (8)..(8): Xaa in position 8 is any amino acid
  Variant (9)..(9): Xaa in position 9 is Asp, Gly, Asn or Gln
  Variant (10)..(10): Xaa in position 10 is Phe or Tyr
  Variant (11)..(11): Xaa in position 11 is any amino acid
  Variant (12)..(12): Xaa in position 12 is Ser or Thr
  Variant (13)..(13): Xaa in position 13 is Ile, Leu, Met or Val
  Variant (15)..(15): Xaa in position 15 is Cys or Asp
  Variant (16)..(18): Xaa in position 16 to 18 is any amino acid
  Variant (19)..(19): Xaa in position 19 is Asn, Ser or Thr
PXXXLXXXXXXXXGXXXXX

SEQ ID NO: 6054 - DNA, 8659 bp, Artificial sequence
  plasmid pMTX155
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacagggtaccctggaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6055 - DNA, 9469 bp, Artificial sequence
  plasmid VC-MME354-1QCZ
  5'UTR (2130)..(2294)
  transit_peptide (2295)..(2402)
  CDS (2295)..(2402)
  transit_peptide (2480)..(2548)
  CDS (2480)..(2548)
  CDS (2549)..(2566): adapter
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattcgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctctgaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6056 - protein, 65 aa, Artificial sequence
  Synthetic Construct
MTTAVTAAVSFPSTKTTSLSARSSSVISPDKISYKKVPLYYRNVSATGKMGPIRAQIASEFQLTT

SEQ ID NO: 6057 - DNA, 9129 bp, Artificial sequence
  plasmid VC-MME356-1QCZ
  transit_peptide (2128)..(2208)
  CDS (2128)..(2208)
  CDS (2209)..(2226): adapter
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattcatgcagaggtttttctccgccagatcgattctcggttacgccgtcaagacgcggaggaggtctttctcttctcgttcttcggaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6058 - protein, 33 aa, Artificial sequence
  Synthetic Construct
MQRFFSARSILGYAVKTRRRSFSSRSSEFQLTT

SEQ ID NO: 6059 - DNA, 8585 bp, Artificial sequence
  plasmid VC-MME301-1QCZ
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcataccattaattaagaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6060 - DNA, 9010 bp, Artificial sequence
  plasmid pMTX461korrp
  5'UTR (1673)..(1837)
  transit_peptide (1838)..(1945)
  CDS (1838)..(1945)
  transit_peptide (2023)..(2091)
  CDS (2023)..(2091)
  CDS (2092)..(2109): adapter
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcataccattaattaagaattcgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctctgaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6061 - protein, 65 aa, Artificial sequence; identical to SEQ ID NO: 6056
  Synthetic Construct

SEQ ID NO: 6062 - DNA, 8674 bp, Artificial sequence
  plasmid VC-MME462-1QCZ
  transit_peptide (1673)..(1753)
  CDS (1673)..(1753)
  CDS (1754)..(1771): adapter
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcataccattaattaagaattcatgcagaggtttttctccgccagatcgattctcggttacgccgtcaagacgcggaggaggtctttctcttctcgttcttcggaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6063 - protein, 33 aa, Artificial sequence; identical to SEQ ID NO: 6058
  Synthetic Construct

SEQ ID NO: 6064 - DNA, 9045 bp, Artificial sequence; identical to SEQ ID NO: 1
  plasmid VC-MME220-1qcz

SEQ ID NO: 6065 - DNA, 9466 bp, Artificial sequence
  plasmid VC-MME432-1qcz
  5'UTR (2125)..(2289)
  transit_peptide (2290)..(2397)
  CDS (2290)..(2397)
  transit_peptide (2475)..(2543)
  CDS (2475)..(2543)
  CDS (2544)..(2552): adapter
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6066 - protein, 62 aa, Artificial sequence
  Synthetic Construct
MTTAVTAAVSFPSTKTTSLSARSSSVISPDKISYKKVPLYYRNVSATGKMGPIRAQIASCSS

SEQ ID NO: 6067 - DNA, 9137 bp, Artificial sequence
  plasmid VC-MME431-1qcz
  transit_peptide (2125)..(2214)
  CDS (2125)..(2214)
  CDS (2215)..(2223): adapter
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccaaacatgcagaggtttttctccgccagatcgattctcggttacgccgtcaagacgcggaggaggtctttctcttctcgttcttcgtctctcctttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6068 - protein, 33 aa, Artificial sequence
  Synthetic Construct
MQRFFSARSILGYAVKTRRRSFSSRSSSLLCSS

SEQ ID NO: 6069 - DNA, 8885 bp, Artificial sequence
  plasmid VC-MME221-1qcz
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6070 - DNA, 9303 bp, Artificial sequence
  plasmid pMTX447korr
  5'UTR (1964)..(2128)
  transit_peptide (2129)..(2236)
  CDS (2129)..(2236)
  transit_peptide (2314)..(2382)
  CDS (2314)..(2382)
  CDS (2383)..(2391): adapter
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6071 - protein, 62 aa, Artificial sequence; identical to SEQ ID NO: 6066
  Synthetic Construct

SEQ ID NO: 6072 - DNA, 8975 bp, Artificial sequence
  plasmid VC-MME445-1qcz
  transit_peptide (1964)..(2053)
  CDS (1964)..(2053)
  CDS (2054)..(2062): adapter
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccaaacatgcagaggtttttctccgccagatcgattctcggttacgccgtcaagacgcggaggaggtctttctcttctcgttcttcgtctctcctttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6073 - protein, 33 aa, Artificial sequence; identical to SEQ ID NO: 6068
  Synthetic Construct

SEQ ID NO: 6074 - DNA, 8588 bp, Artificial sequence
  plasmid VC-MME289-1qcz
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccacccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6075 - DNA, 9007 bp, Artificial sequence
  plasmid VC-MME464-1qcz
  5'UTR (1666)..(1830)
  transit_peptide (1831)..(1938)
  CDS (1831)..(1938)
  transit_peptide (2016)..(2084)
  CDS (2016)..(2084)
  CDS (2085)..(2093): adapter
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccacccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6076 - protein, 62 aa, Artificial sequence; identical to SEQ ID NO: 6066
  Synthetic Construct

SEQ ID NO: 6077 - DNA, 8678 bp, Artificial sequence
  plasmid VC-MME465-1qcz
  transit_peptide (1666)..(1755)
  CDS (1666)..(1755)
  CDS (1756)..(1764): adapter
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagactgcagcaaatttacacattgccactaaacgtctaaacccttgtaatttgtttttgttttactatgtgtgttatgtatttgatttgcgataaatttttatatttggtactaaatttataacaccttttatgctaacgtttgccaacacttagcaatttgcaagttgattaattgattctaaattatttttgtcttctaaatacatatactaatcaactggaaatgtaaatatttgctaatatttctactataggagaattaaagtgagtgaatatggtaccacaaggtttggagatttaattgttgcaatgctgcatggatggcatatacaccaaacattcaataattcttgaggataataatggtaccacacaagatttgaggtgcatgaacgtcacgtggacaaaaggtttagtaatttttcaagacaacaatgttaccacacacaagttttgaggtgcatgcatggatgccctgtggaaagtttaaaaatattttggaaatgatttgcatggaagccatgtgtaaaaccatgacatccacttggaggatgcaataatgaagaaaactacaaatttacatgcaactagttatgcatgtagtctatataatgaggattttgcaatactttcattcatacacactcactaagttttacacgattataatttcttcatagccacccaaacatgcagaggtttttctccgccagatcgattctcggttacgccgtcaagacgcggaggaggtctttctcttctcgttcttcgtctctcctttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6078 - protein, 33 aa, Artificial sequence; identical to SEQ ID NO: 6068
  Synthetic Construct

SEQ ID NO: 6079 - DNA, 9043 bp, Artificial sequence
  plasmid VC-MME489-1QCZ
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 6080 - DNA, 29 bp, Artificial sequence
  amplification of the targeting sequence of the gene IVD from Arabidopsis thaliana to generate targeting vectors
atagaattcatgcagaggtttttctccgc

SEQ ID NO: 6081 - DNA, 29 bp, Artificial sequence
  amplification of the targeting sequence of the gene IVD from Arabidopsis thaliana to generate targeting vectors
atagaattccgaagaacgagaagagaaag

SEQ ID NO: 6082 - DNA, 31 bp, Artificial sequence
  amplification of the targeting sequence of the gene IVD from Arabidopsis thaliana to generate targeting vectors
atagtttaaacatgcagaggtttttctccgc

SEQ ID NO: 6083 - DNA, 36 bp, Artificial sequence
  amplification of the targeting sequence of the gene IVD from Arabidopsis thaliana to generate targeting vectors
ataccatggaagagcaaaggagagacgaagaacgag

SEQ ID NO: 6084 - DNA, 81 bp, Arabidopsis thaliana
atgcagaggtttttctccgccagatcgattctcggttacgccgtcaagacgcggaggaggtctttctcttctcgttcttcg

SEQ ID NO: 6085 - DNA, 89 bp, Arabidopsis thaliana
atgcagaggtttttctccgccagatcgattctcggttacgccgtcaagacgcggaggaggtctttctcttctcgttcttcgtctctcct

SEQ ID NO: 6086 - DNA, 894 bp, Escherichia coli
  CDS (1)..(894): transl_table=11
atgaaacagcagggaactaccctgccagctaataatcacactctaaaacaatatgcattttttgcagggatgttgtcgtccctgaaaaagcaaaaatggagaaaaggaatgagtgaatcattacatctgacccgcaatggatcaattctggaaattacccttgatcgtccaaaagcgaatgctattgatgcaaaaaccagctttgaaatgggcgaagtatttctaaatttccgtgacgatccgcaattacgtgtcgccattattaccggtgccggagagaagttcttttccgcgggctgggatttaaaagcggcagcagaaggcgaagcaccggatgctgactttggtccgggtggttttgcgggattaaccgaaattttcaatctcgacaaaccggttatcgcagctgtgaacggctatgcctttggcggcggctttgaactggcgctggcggcagattttattgtttgtgccgataacgccagcttcgccctgccggaagccaaactgggcatcgttcctgacagcggcggtgtgctgcgtctgccgaagatcctgccgcctgccatcgtcaatgaaatggtgatgaccggcagacgaatgggcgcagaagaggcgctgcgttgggggatagtcaaccgcgtggttagccaggcggaactgatggataacgcccgcgaactggctcagcagctggttaacagcgccccgctggcgattgcggcgctgaaagagatctaccgcaccaccagcgaaatgccggtagaagaagcgtatcgctatattcgcagcggcgtgttgaaacactatccatcggttctgcattcggaagatgccattgaagggccgctggcgtttgccgagaagcgcgatccggtgtggaaaggacgttaa

SEQ ID NO: 6087 - protein, 297 aa, Escherichia coli
MKQQGTTLPANNHTLKQYAFFAGMLSSLKKQKWRKGMSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPAIVNEMVMTGRRMGAEEALRWGIVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 6088 - DNA, 846 bp, Oryza sativa
  CDS (1)..(846)
atggcagcagatggcgccgtcgagccgacatctgccacgtcaacttggagggcggcaggcatgcgcatcctccggggaatcctcgccgtctccggccacctcgccggccgccgcgcgccggcgaacaacgcccacctggcactcttctcccgcgccctccaaatcctcgcccagcaggagcccgtccgcctccagaagctctcggcgcccgactccgggatcgtggagatgaggctggagcggccggaggccaggaacgccatcgggagggagatgctccaggggttgcggagcgcgatcgagaaggtgaaggctgacgcgacggcgaaagtcgtgctgctggcgagctccgtcccgaaggttttctgcgctggcgctgatctcaaggcattgtcaattcctacaattgccattgttgagggagctgcttttggcggggaaaatgcaacatttagcttgccagaaactggccttgctattattcctggagctgggggaacgcagcgtcttcctaggattgttggaaagtccagagcaaaggaattaatattcactggtcgtagattcgatgcagtagaagctgtaaccatgggagtagtaaactactgtgttcccgctggggaggcttataaaagggctcttgaacttgcccaggagataaatcagaaaggtccgttagcgataagaatggctaagaaggccatcaatcaaggcatggaggtagatctgtccgccggattggctgtcgaagaagaatgctacgagcaagttctgcacactcaagatcgtcttgaaggtctagctgcatttgctgagaaaaggaaacctgtatacacagggaaataa

SEQ ID NO: 6089 - protein, 281 aa, Oryza sativa
MAADGAVEPTSATSTWRAAGMRILRGILAVSGHLAGRRAPANNAHLALFSRALQILAQQEPVRLQKLSAPDSGIVEMRLERPEARNAIGREMLQGLRSAIEKVKADATAKVVLLASSVPKVFCAGADLKALSIPTIAIVEGAAFGGENATFSLPETGLAIIPGAGGTQRLPRIVGKSRAKELIFTGRRFDAVEAVTMGVVNYCVPAGEAYKRALELAQEINQKGPLAIRMAKKAINQGMEVDLSAGLAVEEECYEQVLHTQDRLEGLAAFAEKRKPVYTGK

SEQ ID NO: 6090 - DNA, 777 bp, Chloroflexus aurantiacus; identical to SEQ ID NO: 2566
  CDS (1)..(777): transl_table=11

SEQ ID NO: 6091 - protein, 258 aa, Chloroflexus aurantiacus; identical to SEQ ID NO: 2567

SEQ ID NO: 6092 - DNA, 888 bp, Proteus mirabilis
  CDS (1)..(888): transl_table=11
ttgctcaggcaaagtgatcaaaaagcatttgcaataagccataagtgggttttcgtgacagttaattataactgcttatttttattgaaaaaggaatatgacatgagccaatcattacatctaacaacacgtggttcagtgcttgaaattatattagatagaccgaaagccaatgcaattgatgccaaaaccagtcatgaaatgggtgaggtatttatgcgttttcgtgatgatcctagtttacgcgttgccattattacaggtgctggcgaacgattcttttgtgccggctgggatttgaaagccgcagctgaaggagaagcccctgatgcagactttggtgctggtggctttgcgggcttaacggaattatttgatcttaataaacctgtcattgctgccattaacggctatgcttttgggggtggctttgaattagcactggcagccgacatgataatttgttcagacaatgcttcttttgccttgccagaagcacaattaggtattgtccctgacagtggcggtgttttacgtttacctaaacgcttacctcctgcaattgtcaatgaaatgctcatgactggccgtcgtatgaatgcacaagaggcgctacgctggggcattgctaaccgcgttgtcagtacgactgaactgatggatagcgcccgtgaattagccgatcaaatcgccaacagtgcgccacttgcagtcgctgcattaaaagagatctaccgtgccactagcgagctttcgattgaagaaggctacaaattaatgcgcagtggtgttctaaaatattacccaagtgttttacattcagaagatgcactcgaaggcccgctagcctttgccgaaaaacgctcacctgaatggaaaggacggtaa

SEQ ID NO: 6093 - protein, 295 aa, Proteus mirabilis
LLRQSDQKAFAISHKWVFVTVNYNCLFLLKKEYDMSQSLHLTTRGSVLEIILDRPKANAIDAKTSHEMGEVFMRFRDDPSLRVAIITGAGERFFCAGWDLKAAAEGEAPDADFGAGGFAGLTELFDLNKPVIAAINGYAFGGGFELALAADMIICSDNASFALPEAQLGIVPDSGGVLRLPKRLPPAIVNEMLMTGRRMNAQEALRWGIANRVVSTTELMDSARELADQIANSAPLAVAALKEIYRATSELSIEEGYKLMRSGVLKYYPSVLHSEDALEGPLAFAEKRSPEWKGR

SEQ ID NO: 6094 - DNA, 813 bp, Aspergillus fumigatus
  CDS (1)..(813)
atgtcaacagaagcacatccaacagtacaaggatgcctcgtctcgtttccaacacctcacattctcctcctcacactcaaccgcccagagaaaaggaattgcatatccctcgccacgagcgccgagatacagcgcctatggacatggttcgacacacaacctgctctatatgtggccattattaccggcacgggcgagtccttttgtgcgggcgctgacctcaaggaatggaacgacctcaacgcgcgtggtatcaccaacgaaatgacagcccccgggttagccggcctccctcgccgacgaggcagcaaaccaatcattgctgccgtcaacggatactgtctcgggggcggcttcgagatggtagccaactgcgatatcgtggtggccagcgagaacgccacctttggtctccccgaagtgcaacgaggaatcgccgccgtcgcaggctcgctccctcggctggtccgcgtgctgggaaaacagcgagcagccgagatcgctctgagcgggttgagcttttctgcgtcccagctcgagcggtgggggctggtgaaccgcgtggtggagcatgaccagttattggcgacagcggtggagattgcaaccgctatctctaggaatagtccggacagtgtgcgtgtgacgatggaagggctgcattacgggtgggaaatggccagtgtagaagaggctagcagtgcactggttgaccagtggtatgcaaagctcatggctggagaaaatttccacgagggagtacgagcatttgtggagaagcgaaagccacagtggaggccgtctaagttgtga

SEQ ID NO: 6095 - protein, 270 aa, Aspergillus fumigatus
MSTEAHPTVQGCLVSFPTPHILLLTLNRPEKRNCISLATSAEIQRLWTWFDTQPALYVAIITGTGESFCAGADLKEWNDLNARGITNEMTAPGLAGLPRRRGSKPIIAAVNGYCLGGGFEMVANCDIVVASENATFGLPEVQRGIAAVAGSLPRLVRVLGKQRAAEIALSGLSFSASQLERWGLVNRVVEHDQLLATAVEIATAISRNSPDSVRVTMEGLHYGWEMASVEEASSALVDQWYAKLMAGENFHEGVRAFVEKRKPQWRPSKL

SEQ ID NO: 6096 - DNA, 996 bp, Oryza sativa (japonica cultivar-group); identical to SEQ ID NO: 2798
  CDS (1)..(996)

SEQ ID NO: 6097 - protein, 331 aa, Oryza sativa (japonica cultivar-group); identical to SEQ ID NO: 2799

SEQ ID NO: 6098 - DNA, 810 bp, Oryza sativa (japonica cultivar-group)
  CDS (1)..(810)
atgcggcgcctcctcgccgcctccggccgctgcgctccggcgacccgcacccaccatgggctcttcgcgcgcgccatccagatcttggcgccgccggatcccgtcagtctccacaagctctcggcacccgactgcgaaatcgtagagctgaggctggagcgtccggaggtcaagaacgccatcaactgggaagccatgaggctgctgcggggtgtggtcgagaaggttgaggctgacgacaccgtgaaggtcgtcctggtcacgagctccgtgcctggagttttctgcgcaggcgccgatctcaaggcactatctattccaacaattgctgtcattgaaggagctgctttgggtggtgggctagaactggcactttcatgcgacctgcgtatatgtggagaaaatgcaactcttggactgccagagacaggacttgctatcattcctggagctgggggcacacagcgtcttcctaggattgttggaaggtccagagcgaaggagatgatattcaccggccgtagatgtaatgcaactgaagctgtaatgatgggactcgcaaactactgcgttccagcaggggaggctcatgaaaaagcccttgaacttgcccgcgagatagcccagaaagggcctctggggataagaatggccaagaaggccattgatcaagggatgcaggcagcagacatgccgtccgcgttggccgtcgaaggggagtgctacgagcagctgctgcacacggaggatcgccttgagggcctagccgcattcgccgagaggaggaaacctgtatactcaggaaagtag

SEQ ID NO: 6099 - protein, 269 aa, Oryza sativa (japonica cultivar-group)
MRRLLAASGRCAPATRTHHGLFARAIQILAPPDPVSLHKLSAPDCEIVELRLERPEVKNAINWEAMRLLRGVVEKVEADDTVKVVLVTSSVPGVFCAGADLKALSIPTIAVIEGAALGGGLELALSCDLRICGENATLGLPETGLAIIPGAGGTQRLPRIVGRSRAKEMIFTGRRCNATEAVMMGLANYCVPAGEAHEKALELAREIAQKGPLGIRMAKKAIDQGMQAADMPSALAVEGECYEQLLHTEDRLEGLAAFAERRKPVYSGK

SEQ ID NO: 6100 - DNA, 771 bp, Archaeoglobus fulgidus DSM 4304; identical to SEQ ID NO: 2568
  CDS (1)..(771): transl_table=11

SEQ ID NO: 6101 - protein, 256 aa, Archaeoglobus fulgidus DSM 4304; identical to SEQ ID NO: 2569

SEQ ID NO: 6102 - DNA, 828 bp, Mesorhizobium loti MAFF303099
  CDS (1)..(828): transl_table=11
gtgcctggatcgccgacgcgctgctggtgctcggagaaaacaagaatgtctgacgtcatttcgacccgccgcgaaggctcgattctcgaggtcacgctcgaccggcccaaggccaacgccatcgacctgaagacctcgcggctgatggggcaaaccttcaaggcgttccgcgacgatccggaactgcgcgtcgccatcgtcaagacatcaggcgacaagttcttctgcgccggctgggacctgaaggccgccgccggcggcgacgcggtcgacggcgactacggcgtcggcggcttcgccggcctgcaggaattgcgcgacttgaacaagccggtcatcgcttgcgtaaacggcatggcggtgggcggcggcttcgaactggcgctgtcctgcgatctcatctacgcctccgaccactcctccttcgcgctgcccgaaattcgcgccggcacgctggccgacgcggcgacgatcaagctgccgaagcgcattccctaccatgtcgccatggacctcctgctcaccggccgctggatggatgtcgcggaggcacatcgctggggcctggtcaacgaggtgctgcccaaggaaaagctcgaggaccgcgtctgggagatcgcccgcctgctcgccagcggcccgccgctggtctttgccgcgatcaaggagaccgcgcgggtggccgaagcgctgaccttccaggacgccatgaacagggtaacgcgccgccagttggcgacggtcgatgcgctctacggctccgaggacaatatggaagggttccgcgccttcgccgaaaagcgcgatccggtgtggaagggaaagtga

SEQ ID NO: 6103 - protein, 275 aa, Mesorhizobium loti MAFF303099
MPGSPTRCWCSEKTRMSDVISTRREGSILEVTLDRPKANAIDLKTSRLMGQTFKAFRDDPELRVAIVKTSGDKFFCAGWDLKAAAGGDAVDGDYGVGGFAGLQELRDLNKPVIACVNGMAVGGGFELALSCDLIYASDHSSFALPEIRAGTLADAATIKLPKRIPYHVAMDLLLTGRWMDVAEAHRWGLVNEVLPKEKLEDRVWEIARLLASGPPLVFAAIKETARVAEALTFQDAMNRVTRRQLATVDALYGSEDNMEGFRAFAEKRDPVWKGK

SEQ ID NO: 6104 - DNA, 774 bp, Mesorhizobium loti MAFF303099; identical to SEQ ID NO: 2574
  CDS (1)..(774): transl_table=11

SEQ ID NO: 6105 - protein, 257 aa, Mesorhizobium loti MAFF303099; identical to SEQ ID NO: 2575

SEQ ID NO: 6106 - DNA, 774 bp, Mesorhizobium loti MAFF303099
  CDS (1)..(774): transl_table=11
ttgtcagaccaaccattgctcgtcgaaaaacggcgggacatcactctcatatccttgaaccggcccgaacgtcggaatgccgtcgacggcaagctgagccgcgctctgcgagaagcgttcgaccacttcgaggcggacccgtcagcgtcggttgctatcatcaacggtcagggtgccgcgttctgctcagggatggacctgaaagcgttccttgacggcgaggcggacgacattctgtttggggaaggacgtctcggaggactcgtcagtcgaaatctgacgaagcctctcgtcgccgctgtccacggcgtggcggtggcaggaggttttgaattgatgttggcctgtgacctcgtcgtttctgcggacacgtgcaggttcgggcttcctgaggcgaagcgaggtctggttgcgggtgccggaggagccttccggctcggggaaatactcccgccagtcattgccgcggaaatccttctgactggtgaattgttcggcgcgcagcgggcctacgaacttggcctcgtcaatcggatcgttcccgagtccgaagtattagaaactgcgttgatgatggccagagcaattgcactgaatgccccgatgtcccggaaggcaagcctcgatctggcgagggcgtcgttggcgactggccgtagcctgcgatgggcgatgaacgacgacttattgaagactctcatcgcttcagaagacgcagtcgaaggagctgcagccttcaatgaaaagcgtcccccggtgtggcgtggcgtctga

SEQ ID NO: 6107 - protein, 257 aa, Mesorhizobium loti MAFF303099
MSDQPLLVEKRRDITLISLNRPERRNAVDGKLSRALREAFDHFEADPSASVAIINGQGAAFCSGMDLKAFLDGEADDILFGEGRLGGLVSRNLTKPLVAAVHGVAVAGGFELMLACDLVVSADTCRFGLPEAKRGLVAGAGGAFRLGEILPPVIAAEILLTGELFGAQRAYELGLVNRIVPESEVLETALMMARAIALNAPMSRKASLDLARASLATGRSLRWAMNDDLLKTLIASEDAVEGAAAFNEKRPPVWRGV

SEQ ID NO: 6108 - DNA, 798 bp, Mesorhizobium loti MAFF303099
  CDS (1)..(798): transl_table=11
gtgcaacttggaggattttttgaattgtcgaacgagccagtttccttcgagacccgtgacaacatcgctatcatagcgataaaccgtccggatcggcgaaatgcaatcgatgagcgaactagcccacagctgcgtattgcagtggatcggttcgagagcgacgaccatcttgcggttggcattcttcgcggtgaaggacctgttttctgttcaggaatggaccttcaagcgttcgtcgatggggaagcggaagaaatactgtttggagacgggcatttgggcggcttggtaagccgggcacgaacgaaacctgttttagccgctgttcagggtgcagcgatcgccggcggatttgaactcatgctggcctgcgatctcgtagtgtcgactgaaaactgtaagtttggcttacctgaagcaaagcgcggtctagtggcaggcgctggtggggcgcttcggctgggtgagatgttaccgccggtacttgccaacgagatactccttaccggcctcctttttgaggctccccgagcatatcagcttggtcttgtcaatcggctggtgccggaacatttcctattagaggccgcgatgagtctggctgattccatcgctcaaaatgcacccctttcagtgcgggcgagcctcgcactggtaaaagctcagagcgaaaaagcccgaaattcgctttggacactgaatgacgagttgttacgcgagctcatgcgatcaaatgacgcgttagagggtgctactgcgtacaaagccaagcgcaggccgatctggcgtggcgactaa

SEQ ID NO: 6109 - protein, 265 aa, Mesorhizobium loti MAFF303099
MQLGGFFELSNEPVSFETRDNIAIIAINRPDRRNAIDERTSPQLRIAVDRFESDDHLAVGILRGEGPVFCSGMDLQAFVDGEAEEILFGDGHLGGLVSRARTKPVLAAVQGAAIAGGFELMLACDLVVSTENCKFGLPEAKRGLVAGAGGALRLGEMLPPVLANEILLTGLLFEAPRAYQLGLVNRLVPEHFLLEAAMSLADSIAQNAPLSVRASLALVKAQSEKARNSLWTLNDELLRELMRSNDALEGATAYKAKRRPIWRGD

SEQ ID NO: 6110 - DNA, 1014 bp, Arabidopsis thaliana; identical to SEQ ID NO: 2794
  CDS (1)..(1014)

SEQ ID NO: 6111 - protein, 337 aa, Arabidopsis thaliana; identical to SEQ ID NO: 2795

SEQ ID NO: 6112 - DNA, 837 bp, Arabidopsis thaliana
  CDS (1)..(837)
atgacaatggagtcatacaaaaccctagaaatcattcgcaagaacactgattcctccgtatttcatctcatcatcaacagaccatcacatctcaacgccttatctctcgatttcttcatcgaattccccaaagctctctcatctctcgaccaaaatccagatgtctccgtcatcatcctctccggcgccggaaaacacttctgctccggtatcgatctcaattccctctcttcaatctcgacacaatcctcctccggtaacgacagaggacgatctagcgagcagctacgccgtaagatcaagtcgatgcaagcggcgattacagcgattgaacaatgccggaaacctgtaatcgccgctattcacggcgcgtgtatcggtggcggtgttgatctgattaccgcttgtgatattaggtattgctctgaggatgcgtttttctcgattaaagaggttgatctagcgattgttgcggatcttggtacacttcagcgattaccgagtatcgttgggtatgctaacgccatggaattggctttaactgctcggagattctctggaagtgaagcaaaggatcttggtttggtttctaaagttttcggatctaaatcggagcttgataatggcgtcactacaatcgccgaaggaataggaggcaagtctcctttagctgtgacagggacaaaggcagtgttattaagaagcagagaggtgagtgtagaacaaggacttgactatgtagcaacttggaactcggctatgcttatatcagatgatctcaacgaagctgtttctgctcagatgatgaaaagaaaacctcggtttgctaaactttga

SEQ ID NO: 6113 - protein, 278 aa, Arabidopsis thaliana
MTMESYKTLEIIRKNTDSSVFHLIINRPSHLNALSLDFFIEFPKALSSLDQNPDVSVIILSGAGKHFCSGIDLNSLSSISTQSSSGNDRGRSSEQLRRKIKSMQAAITAIEQCRKPVIAAIHGACIGGGVDLITACDIRYCSEDAFFSIKEVDLAIVADLGTLQRLPSIVGYANAMELALTARRFSGSEAKDLGLVSKVFGSKSELDNGVTTIAEGIGGKSPLAVTGTKAVLLRSREVSVEQGLDYVATWNSAMLISDDLNEAVSAQMMKRKPRFAKL

SEQ ID NO: 6114 - DNA, 894 bp, Escherichia coli O157:H7 EDL933
  CDS (1)..(894): transl_table=11
atgaaacggcagggaactaccctgccagctaataatcacgctctaaaacaatatgcattttttgcagggatgttgtcgtccctgaaaaagcaaaaatggagaaaaggaatgagtgaatcattacatctgacccgcaatggatcaattctggaaattactcttgatcgcccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggtggttttgcgggattaaccgaaattttcaatctcgacaaaccggttatcgcagctgtgaacggctacgcctttggcggcggtttcgaactggcgctggcggcagattttattgtttgtgccgataacgccagcttcgccctgccggaagccaaactgggcatcgttcctgacagcggcggtgtgctgcgtctgccgaagatcctgccgcctgccatcgtcaatgaaatggtgatgaccggcagacgaatgggcgcagaagaggcgctgcgttgggggatagtcaaccgcgtggttagccaggcggaactgatggataacgcccgcgaactggctcagcagctggttaacagcgccccgctggcgattgcggcgctgaaagagatctaccgcaccaccagcgaaatgccggtagaagaatcgtatagctatattcgcagcggcgtgttgaaacactatccatcggttctgcattcggaagatgccattgaagggccgctggcgtttgccgagaagcgcgatccggtgtggaaaggacgttaa

SEQ ID NO: 6115 - protein, 297 aa, Escherichia coli O157:H7 EDL933
MKRQGTTLPANNHALKQYAFFAGMLSSLKKQKWRKGMSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPAIVNEMVMTGRRMGAEEALRWGIVNRVVSQAELMDNARELAQQLVNSAPLAIAALKEIYRTTSEMPVEESYSYIRSGVLKHYPSVLHSEDAIEGPLAFAEKRDPVWKGR

SEQ ID NO: 6116 - DNA, 909 bp, Deinococcus radiodurans R1
  CDS (1)..(909): transl_table=11
gtgggtggcgtttttcaggacagcccatctcttgattctctgttttttcctcagcctctcccctccgccgccaagtcatgtcaccatgcaggtatgacttacagcgacgacgacctgcgcctcgacgagatggaattcgagaacatcaccattgaccagcatggccccatcgcggtgctgaccgtgaaccgtcccaaggcgctcaacgccctaaacgggaccaccctcagcgagctggcaatggccgccgacctgatcgccaacgaccccgaggtgggcgccctgatcgtgaccggcgcgggcgacaaggcgttcgtggcgggggccgatatcagcgaactggcggggctggaagggccgttcgctgggcgcgacatgtcgctgctgggccaggacgcgatgacgcagctcagcaacctgccgattccggtgattgcggccataggcggctacgcactcggcggcgggttggaactcgcgctgtgctgcgatatccgcatcgcttcgccgcgcgcccgcatggggctgcccgaagtgacgctggggctgctgcccggctttgcgggcacccagcgcctcccccgcctgatcggggcgggccgcgccctggacctgatgctgaccgcccggcagatcggcgccgaggaagccctgagcatgggcctggtcaactacgtggccgacgacccactgcaaaaggcccgcgaagtggccgagcagatcgtgaaaaatgggccgctcgccatctcgctcgtcaaggaagcagtcaggcggggcctcgccaccgacctcgaagcggggatggaaatcgaggccgacctcttcgggctggcctttgccaccagcgacttcaaggaaggcactaaagcgttcctagaaaagcgcccggcggagtttaagggagagtaa

SEQ ID NO: 6117 - protein, 302 aa, Deinococcus radiodurans R1
MGGVFQDSPSLDSLFFPQPLPSAAKSCHHAGMTYSDDDLRLDEMEFENITIDQHGPIAVLTVNRPKALNALNGTTLSELAMAADLIANDPEVGALIVTGAGDKAFVAGADISELAGLEGPFAGRDMSLLGQDAMTQLSNLPIPVIAAIGGYALGGGLELALCCDIRIASPRARMGLPEVTLGLLPGFAGTQRLPRLIGAGRALDLMLTARQIGAEEALSMGLVNYVADDPLQKAREVAEQIVKNGPLAISLVKEAVRRGLATDLEAGMEIEADLFGLAFATSDFKEGTKAFLEKRPAEFKGE

SEQ ID NO: 6118 - DNA, 867 bp, Agrobacterium tumefaciens str. C58; identical to SEQ ID NO: 2586
  CDS (1)..(867): transl_table=11

SEQ ID NO: 6119 - protein, 288 aa, Agrobacterium tumefaciens str. C58; identical to SEQ ID NO: 2587

SEQ ID NO: 6120 - DNA, 798 bp, Agrobacterium tumefaciens str. C58
  CDS (1)..(798): transl_table=11
atgagcgaaaaaatgacagaagaatttgtctcttacgaattgcggggtgacatcgcccttgttggcctcaacaggccacaaaagcgcaacgccatcagtgaccgtttcgttgaggctattgccgccgccgccgcgcgggcggaaaacgaagcccgtgccgccgtcattttcggtcatggcgatcatttctgcgccggtctcgatcttggcgaacatatccacaagacgccgatcgaaggcgtgcgcggctcccgccgctggcacgccgtgttctcgcagatcgagcatggcaccataccgtgggtttccgccctgcatggcgcggtcgtcggcggtgggttggagctggccgcctcgacccatctgcgggttgccgacgaaagcgccttctttgcgttgcccgagggccaacgcggcattttcgttgggggaggcggatccgtccgcatcgcgcggctgctgggggtcgcccgcatgagcgacatgatgctgactggacgggtcgcttcgtccgccgaagccgaacgctggaaccttgtgcaatatgctgtgccgcgcggcgaagcgcttgcgaaggcgcaggagctcgccaccattgcagcgtccaatgcacctttgtccaactatgccgttatcaacgcgcttccccgcattcaggatatggccaaggaggacgggctgttcgtcgagtccttcatttcctccttcacggcggccagccccgaagccgaagaacgcctgcgcgcctttcttgaaaaacgcgctacgcggctgaaagcaccggacacgacggcctga

SEQ ID NO: 6121 - protein, 265 aa, Agrobacterium tumefaciens str. C58
MSEKMTEEFVSYELRGDIALVGLNRPQKRNAISDRFVEAIAAAAARAENEARAAVIFGHGDHFCAGLDLGEHIHKTPIEGVRGSRRWHAVFSQIEHGTIPWVSALHGAVVGGGLELAASTHLRVADESAFFALPEGQRGIFVGGGGSVRIARLLGVARMSDMMLTGRVASSAEAERWNLVQYAVPRGEALAKAQELATIAASNAPLSNYAVINALPRIQDMAKEDGLFVESFISSFTAASPEAEERLRAFLEKRATRLKAPDTTA

SEQ ID NO: 6122 - DNA, 843 bp, Agrobacterium tumefaciens str. C58
  CDS (1)..(843): transl_table=11
ttggcaggccgaatgcggcgcgcgccggaaaagcgctgcttgctgcaaaacaggagggagacctgcatggcggatgaactgctgcacgaggcgcgccaagatgttctatggctgacgctcaaccggccggaggtacacaacgccctcaatgccgcgatgacggaggcactcacggatgcgatccgcgctgcatccggcgatggcagcctgcgtgccgtggtgataacggcagccggagaccgcagcttctgttcgggagccgatctgaaggaaagtgccggcggcatgttcctctcgcccaacgggacgaaccccattgccaacgtgatgcgcgcgatagagagctgcgacaagcccgtcattgcccgcatcaatggccgggttctggccggcgggctcggccttgtcgccacctgcgatcttgcctatgccgccgatcatgccgaattcggcctgccggaagtgcgggtcgggcttttcccgaccatggtggcggcgaagttgctggcaaaaatgcctttgggcgggcttcaggaaatggcctatctcggccagccgatcaccgctgcggaggcaaaaggtctcggcctcgtcaatcgcacggcgccgctggctgaactcgatggccttatcgaagaggttctcgcaaagctgcgacagaacgcgccgggcgccatcgccgcgggaaaggcggccctgctggcgatgcgcgacatgccatcggatgaacggcttgcctttgcggaagacgccatagcagccatcagcggcagcgacgaagcgcgcgaagggcggcaggcttttgcagaaaagcgccctcccaaatggatcggcagatcctga

SEQ ID NO: 6123 - protein, 280 aa, Agrobacterium tumefaciens str. C58
MAGRMRRAPEKRCLLQNRRETCMADELLHEARQDVLWLTLNRPEVHNALNAAMTEALTDAIRAASGDGSLRAVVITAAGDRSFCSGADLKESAGGMFLSPNGTNPIANVMRAIESCDKPVIARINGRVLAGGLGLVATCDLAYAADHAEFGLPEVRVGLFPTMVAAKLLAKMPLGGLQEMAYLGQPITAAEAKGLGLVNRTAPLAELDGLIEEVLAKLRQNAPGAIAAGKAALLAMRDMPSDERLAFAEDAIAAISGSDEAREGRQAFAEKRPPKWIGRS

SEQ ID NO: 6124 - DNA, 765 bp, Sulfolobus tokodaii str. 7
  CDS (1)..(765): transl_table=11
atgattaaggttgaggtaaataaagagaataaaataggtaaaatattaatagatagacaagaaaaaatgaacgcaataaccgttgagatgagaaaagaaataggagagaaaataatagaattagacaaagatccgagcgtaagagtaataattatagaaggtgtaggtggaaaagcatttagttctggaggagatataagtgaattcctatcattaaacccagagactttactagattggggagaagatctatcaacaagtgaaagaataactaagccagtaatagctgcaataaacggatacacatttggtgcaggcttagaattagcattatcttgtgatataagaatagccacacctaaaagtgaatttagctttccagaaataagactaggaatggtacctgcaagtggaggagtaactaggatagtaaaaatgttaggtgtatctagagctacttatatgctaatgttaggaaagagaatagacgcacaaactgctcttcagtggggtatagtacatgagattgttgatgaagataaactagaaggaagagcattagaaatagctaaagatctagctagcctatcacccttagccctcaaagcgttaaagaaaataataagagaggttgcagattcaccattttacgcaggatttgatattgaaaggaaaactttcggcttacttagatatagtgaagacttcagagaaggcgtagagtccttcttaaataagaggaagcctaattttaacggtaggtaa

SEQ ID NO: 6125 - protein, 254 aa, Sulfolobus tokodaii str. 7
MIKVEVNKENKIGKILIDRQEKMNAITVEMRKEIGEKIIELDKDPSVRVIIIEGVGGKAFSSGGDISEFLSLNPETLLDWGEDLSTSERITKPVIAAINGYTFGAGLELALSCDIRIATPKSEFSFPEIRLGMVPASGGVTRIVKMLGVSRATYMLMLGKRIDAQTALQWGIVHEIVDEDKLEGRALEIAKDLASLSPLALKALKKIIREVADSPFYAGFDIERKTFGLLRYSEDFREGVESFLNKRKPNFNGR

SEQ ID NO: 6126 - DNA, 792 bp, Sinorhizobium meliloti 1021
  CDS (1)..(792): transl_table=11
atgacgcccatgaccggaccgatccttacgcgccgcgaaggcggcattctcgaagtcacgatcgaccggccgaaggccaatgccatcgacctgaagaccagccgcgtcatgggcgagatcttccgcgatttccgggacgacccggagcttcgggtcgcgatcatcaccggcgccggcgagaaattcttctgccccggctgggacctgaaggcggcggcggaaggcgaccctgtcgatggagattacggcgtcggcggtttcggcggcatgcaggagctgcgcgacctcaacaagccgatcatcgcggccgtcaacggcatctgttgcggtggcggcctggagatcgcgctttcgaccgacatcatcctcgcagccgaacatgcgagtttcgcactcccggaaatccgctcgggtacgctcgccgatgccgcttcgatcaagctgccgaagcgcatcccctaccatatcgccatggacatgctgctcaccggccgctggctcgacgtggtcgaagcgaaccgctggggcttcgtcaacgagatcctgccggccggacggctgatggaccgcgcgtgggaactggcgcgcctgctcgaaagcggcccgccgctcgtctatgccgcaatcaaggaagtggtccgtgatgccgagggccgggacttccagacgaccatgaacaaggtcacccgtcgccagttcaggacagttgatgtcctctattcgagcgaggaccagctcgagggcgcccgcgcctttgcggagaagcgcgacccggtctggaagggacgctga

SEQ ID NO: 6127 - protein, 263 aa, Sinorhizobium meliloti 1021
MTPMTGPILTRREGGILEVTIDRPKANAIDLKTSRVMGEIFRDFRDDPELRVAIITGAGEKFFCPGWDLKAAAEGDPVDGDYGVGGFGGMQELRDLNKPIIAAVNGICCGGGLEIALSTDIILAAEHASFALPEIRSGTLADAASIKLPKRIPYHIAMDMLLTGRWLDVVEANRWGFVNEILPAGRLMDRAWELARLLESGPPLVYAAIKEVVRDAEGRDFQTTMNKVTRRQFRTVDVLYSSEDQLEGARAFAEKRDPVWKGR

SEQ ID NO: 6128 - DNA, 762 bp, Agrobacterium tumefaciens str. C58; identical to SEQ ID NO: 2596
  CDS (1)..(762): transl_table=11

SEQ ID NO: 6129 - protein, 253 aa, Agrobacterium tumefaciens str. C58; identical to SEQ ID NO: 2597

SEQ ID NO: 6130 - DNA, 777 bp, Agrobacterium tumefaciens str. C58
  CDS (1)..(777): transl_table=11
atggcggatgaactgctgcacgaggcgcgccaagatgttctatggctgacgctcaaccggccggaggtacacaacgccctcaatgccgcgatgacggaggcactcacggatgcgatccgcgctgcatccggcgatggcagcctgcgtgccgtggtgataacggcagccggagaccgcagcttctgttcgggagccgatctgaaggaaagtgccggcggcatgttcctctcgcccaacgggacgaaccccattgccaacgtgatgcgcgcgatagagagctgcgacaagcccgtcattgcccgcatcaatggccgggttctggccggcgggctcggccttgtcgccacctgcgatcttgcctatgccgccgatcatgccgaattcggcctgccggaagtgcgggtcgggcttttcccgaccatggtggcggcgaagttgctggcaaaaatgcctttgggcgggcttcaggaaatggcctatctcggccagccgatcaccgctgcggaggcaaaaggtctcggcctcgtcaatcgcacggcgccgctggctgaactcgatggccttatcgaagaggttctcgcaaagctgcgacagaacgcgccgggcgccatcgccgcgggaaaggcggccctgctggcgatgcgcgacatgccatcggatgaacggcttgcctttgcggaagacgccatagcagccatcagcggcagcgacgaagcgcgcgaagggcggcaggcttttgcagaaaagcgccctcccaaatggatcggcagatcctga

SEQ ID NO: 6131 - protein, 258 aa, Agrobacterium tumefaciens str. C58
MADELLHEARQDVLWLTLNRPEVHNALNAAMTEALTDAIRAASGDGSLRAVVITAAGDRSFCSGADLKESAGGMFLSPNGTNPIANVMRAIESCDKPVIARINGRVLAGGLGLVATCDLAYAADHAEFGLPEVRVGLFPTMVAAKLLAKMPLGGLQEMAYLGQPITAAEAKGLGLVNRTAPLAELDGLIEEVLAKLRQNAPGAIAAGKAALLAMRDMPSDERLAFAEDAIAAISGSDEAREGRQAFAEKRPPKWIGRS

SEQ ID NO: 6132 - DNA, 900 bp, Drosophila melanogaster
  CDS (1)..(900)
atgtcaatgttaataaaaagagcgtctggtttagctcgacagttagcccggccacttgttgcatcacgtaatttggcgtcggcagcgccctatggcgatggaactgaagttctcgtggagcgtttggatggagctcggcagggtatctcagttattggcctaaaccgaccagcagcaaagaattcctttagccggggaatggtggagaccttcaacgatgtcctggaagatataaagaaggataatggatcgagggtggttgtattgaggagtctgagccctggaatcttctgtgccggagcggatttgaaagagcgaaaaggcatgactcccgaggaagccaccgaatttgtaaaagagctcaggggactgcttattgccattgagcagctgcccatgccggtaatcgccgctgtggatggagctgctctcggcggaggtctggaaatggctctggcctgtgacatccggactgctgctagcgacacgaagatgggtctggtggagacaaggttagccatcataccaggagctggtggcacccaaagactgccccgcattctgtcccctgctctggccaaagaactcattttcacggcacgagtgtttaacggagcagaggcgaaagatctgggtctggttaaccatgtagtgaaacagaacgaaacccaggatgccgcctatcagcaggcacttaaattggcagaggaaattctcccgaatgggccagtgggcgtgcgaatggccaaactggccattgacaagggcatgcaggtggacctggccaccggctactccatcgaagagatctgctactcgcaggtgatacccactaaggatcgtttggagggactcgctgcctttgccgagaagcggaagcccgtctacaagggggagtaa

SEQ ID NO: 6133 - protein, 299 aa, Drosophila melanogaster
MSMLIKRASGLARQLARPLVASRNLASAAPYGDGTEVLVERLDGARQGISVIGLNRPAAKNSFSRGMVETFNDVLEDIKKDNGSRVVVLRSLSPGIFCAGADLKERKGMTPEEATEFVKELRGLLIAIEQLPMPVIAAVDGAALGGGLEMALACDIRTAASDTKMGLVETRLAIIPGAGGTQRLPRILSPALAKELIFTARVFNGAEAKDLGLVNHVVKQNETQDAAYQQALKLAEEILPNGPVGVRMAKLAIDKGMQVDLATGYSIEEICYSQVIPTKDRLEGLAAFAEKRKPVYKGE

SEQ ID NO: 6134 - DNA, 888 bp, Drosophila melanogaster
  CDS (1)..(888)
atggccaacattgctaagatcttcgctagccgcgcccagtgcgtcctgcaggcagccgcccgtcagccacaggtggccacccgtttcagcagctcctccaccaacaacaactgggagtacatcaagaccgaagtggccggcgagggcaagaacgtaggcgtgatcaccctgaaccgccccaaggccctgaatgccctctgcaatggcctgatgaaggagctgtccaccgcattgcagcaattcagcaaggataagaccatctccgccatcgttttgacgggcagcgagaaggccttcgccgctggcgctgatattaaggagatggtgggcaacacctactcgcagtgcatccagggcaacttcttgaacgactggacagaggtggcccgcacccagaagcccatcattgctgccgtgaatggttacgccttgggcggtggctgtgagctggccatgatgtgcgacatcatatatgccggtgacaaggccaagtttggtcagcctgaaattgccctgggcaccattcccggtgccggtggcacccagcgtctgacccgcgtcgttggcaagtccaaggccatggaaatgtgcctcaccggcaatatgatcggcgcccaggaggctgagaagctgggtctggccagcaaggtggtgcccgccgaccagttattgggcgaggccgtcaagctgggcgagaagatcggcacccactccaatctgatcgtgcagctgtgcaaggaggcggttaacacggcttacgagaccactctccaagagggcctgaagttcgagcgtcgcaccttccatgccacgttctccacggccgatcgcaaggagggcatgaccgctttcgccgagaagcgccctgccaagtttaccaacgagtaa

SEQ ID NO: 6135 - protein, 295 aa, Drosophila melanogaster
MANIAKIFASRAQCVLQAAARQPQVATRFSSSSTNNNWEYIKTEVAGEGKNVGVITLNRPKALNALCNGLMKELSTALQQFSKDKTISAIVLTGSEKAFAAGADIKEMVGNTYSQCIQGNFLNDWTEVARTQKPIIAAVNGYALGGGCELAMMCDIIYAGDKAKFGQPEIALGTIPGAGGTQRLTRVVGKSKAMEMCLTGNMIGAQEAEKLGLASKVVPADQLLGEAVKLGEKIGTHSNLIVQLCKEAVNTAYETTLQEGLKFERRTFHATFSTADRKEGMTAFAEKRPAKFTNE

SEQ ID NO: 6136 - DNA, 858 bp, Drosophila melanogaster
  CDS (1)..(858)
atgttgcgtattttaaacaactccttaaaaatatcaaaatatgcaacaggttgcgtgcaacaggtcattcgctttaccagcaatggacccagtgatttggtcctggtcaaggagcataacggagtgcgagagataacgctgaatcatccaaaaactctgaattccctatcactggacatgatgtgtgcccttcaggacgccctgctaaaagataaagacaacttggatctgagatgcgtggtcctgacggcccaaggaaagatctggtcggcaggtcacaatctcaaggagttgcacaatgaccccaagatacaggcttgtgtgttccagaagctaaccgatgttataaacgacatccaaagactgccggtgcccgtactaggaaaagtcaatggctatgcggctgctgcaggctgccaactggtggtgtcatgtgacatggtagtctgcaccaagaacagcaagttctctactccaggggctggagtcggagttttttgctcaacacccggagtcgcagttgcccggattatgtcgcgtccaaagtccgcctatatgctaatgaccggtcttcccgttactggtgaagaagcctacatatcgggaatggtcaccaaagctgttcctgcagaggaactagataaggagatcgaggaaatcaccaatgccataaaggcaaaaagtcgtgccgtcatctctctgggaaaagagttctactacaagcaactggccatgtcccaagcggaagccttttcggctgcgcaggagaagatgtgcgaaaatttccagctgggcgacaccaaagagggcattgctagcttcttcgagaagcgcccacccaactggaagcaccagtaa

SEQ ID NO: 6137 - protein, 285 aa, Drosophila melanogaster
MLRILNNSLKISKYATGCVQQVIRFTSNGPSDLVLVKEHNGVREITLNHPKTLNSLSLDMMCALQDALLKDKDNLDLRCVVLTAQGKIWSAGHNLKELHNDPKIQACVFQKLTDVINDIQRLPVPVLGKVNGYAAAAGCQLVVSCDMVVCTKNSKFSTPGAGVGVFCSTPGVAVARIMSRPKSAYMLMTGLPVTGEEAYISGMVTKAVPAEELDKEIEEITNAIKAKSRAVISLGKEFYYKQLAMSQAEAFSAAQEKMCENFQLGDTKEGIASFFEKRPPNWKHQ

SEQ ID NO: 6138 - DNA, 783 bp, Thermoanaerobacter tengcongensis MB4; identical to SEQ ID NO: 2606
  CDS (1)..(783): transl_table=11

SEQ ID NO: 6139 - protein, 260 aa, Thermoanaerobacter tengcongensis MB4; identical to SEQ ID NO: 2607

SEQ ID NO: 6140 - DNA, 807 bp, Streptomyces coelicolor A3(2)
  CDS (1)..(807): transl_table=11
atgagcgacactggccacctcccgccgcccgacctcggcaccgacctcgtcctgctggacgtcaccgaccgggtcgccatcctcaccctgaaccggcccgccaagctcaacgccgtcacccccggcatgtcccgggccctggtgcgggccatcgagtggtgcgacacgaccgacgaggtccgggcactcgtcgtcacgggggcgggcgaacgctccttcagcgtcggctcggacatcggcgcactcgaccagtacgccaccccgtgggacttccgcaaccgcgtcgactactgcgacgccatccgcgccgcccgcaccccgaccgtcgccgcggtcgggggatacgccctgggcggagggctggagaccgccctgtcctgcgacatccggctcgccgcggacaccgcgtccttcggcgcaccggagatcacgctcggctggatcgggggcggcggcatgaccgccttcctcagccgcgcggccggcccgggcaacgcggcactgatgctgctcaccggcgaacgcatcgacgccgaacgggcgttggcctggcatctggtgagcgaggtcgtgccccgcgccggtctgctcgaccgggcccgcgccctcgccgccgtgatcgcctcccgcgccccggtggcggccgagacggcgaagatcaacctgcgggccgccggaaacctgcccgaggaccaggcgctcgcctacgagcgcgacctgcagaccatctgcttcgccaccgaggacgcggcggagggcaggcgcgcgttcgccgagaagcgctcccccgtcttccacaagcgctga

SEQ ID NO: 6141 - protein, 268 aa, Streptomyces coelicolor A3(2)
MSDTGHLPPPDLGTDLVLLDVTDRVAILTLNRPAKLNAVTPGMSRALVRAIEWCDTTDEVRALVVTGAGERSFSVGSDIGALDQYATPWDFRNRVDYCDAIRAARTPTVAAVGGYALGGGLETALSCDIRLAADTASFGAPEITLGWIGGGGMTAFLSRAAGPGNAALMLLTGERIDAERALAWHLVSEVVPRAGLLDRARALAAVIASRAPVAAETAKINLRAAGNLPEDQALAYERDLQTICFATEDAAEGRRAFAEKRSPVFHKR

SEQ ID NO: 6142 - DNA, 801 bp, Streptomyces coelicolor A3(2)
  CDS (1)..(801): transl_table=11
atgagcgaggagcggttcggagagttcgtcctggtgcggcggcgcggggaggggcatgtcgcggaactcgcgctcgaccggccgaaggccatgaacgccgtgtcgaccgcgatggcccgttccgtgggcgcggcctgcgcggcgctgggcgaggaccggagcgtgcgggtggtggtgctgacctcgacgcacgagcgggcgttctgcgtgggtgcggacctgaaggagcgcaactccttcaccgacgccgatctgctgcggcagcggccggtgacgcgcggggcgtacaccgcggtgctggagctgccggtgccgacggtcgcggccgtgcatgggttcgcgctgggtggcgggttcgagctggcgctgtcgtgcgacgtgatcgtggccgaccccacggccgtggtggggctgccggaggtgtcggtgggggtgatcccgggcggcggcggtacgcagctgctgccgcgccgggtgggtgcggcgcgagcggccgagctggtgttcacggcacggcgggtggcggccgaggaggcacgcgagctggggctcgtggaccagctggtgccggaggggcgggaccgggaggaggcgctggagctggccgcccggatggccgcgaactcgcccgtgggcctgcgcgcggccaagcgcgcgctgcgcctggggcacggactggacctgcgcgcgggactcgaggtcgaggacgcggcgtggcgttcggtggcgttctcgggggaccgcgccgagggagtggcggcgttcaacgagaagcgggcgccgcggtggccgggcgagtga

SEQ ID NO: 6143 - protein, 266 aa, Streptomyces coelicolor A3(2)
MSEERFGEFVLVRRRGEGHVAELALDRPKAMNAVSTAMARSVGAACAALGEDRSVRVVVLTSTHERAFCVGADLKERNSFTDADLLRQRPVTRGAYTAVLELPVPTVAAVHGFALGGGFELALSCDVIVADPTAVVGLPEVSVGVIPGGGGTQLLPRRVGAARAAELVFTARRVAAEEARELGLVDQLVPEGRDREEALELAARMAANSPVGLRAAKRALRLGHGLDLRAGLEVEDAAWRSVAFSGDRAEGVAAFNEKRAPRWPGE

SEQ ID NO: 6144 - DNA, 804 bp, Streptomyces coelicolor A3(2)
  CDS (1)..(804): transl_table=11
atggccgacaccgtgctctacgaagtgagcgacgggctcgcgacgatcacgctgaaccgccccgaggcgatgaacgcgctgaacatcgagaccaaggtcgcgctccgggacgcggtgcgctccgcggcggcggacgacgccgtacgggcggtgctgctgaccgcggccggggaccgggcgttctgtgtcggccaggacctcaaggagcacatcgggctgctggccgccgaccgggagacgggctcggggcagacgatgagcacggtgcgcgagcactacaacccgatcgtccgggcgctggccggcgcggagaagccggtggtcgccgccgtgaacggcgtggcggccggcgcggggctcggtttcgcgctcgccgcggactaccggatcgtcgcggacacggcggcgttcaacacgtccttcgcgggcgtggcgctcaccgcggactccggcatctcctggacgctgccgcgcgtcgtcggccccggccgcgccgccgacctgctgctcttcccgcgcagcatccgcgcgcaggaggcgtacgagctgggcatcgccacccgtgtcgtccccgccgccgacctgcgcgccgaggccgagaagacggcgcgggcgctggccgaggggccgacggtggcgtacgcggcgctgaaggaggcgatggcgtacgggctgacgcactcgctgtccgagacgctggacaaggaggacgagcttcagtcccgggcgggcgcctccgaggaccacgcgatcgcggtgcgcgcgttcgtcgagaaggggaagccgaagtatctgggccggtag

SEQ ID NO: 6145 - protein, 267 aa, Streptomyces coelicolor A3(2)
MADTVLYEVSDGLATITLNRPEAMNALNIETKVALRDAVRSAAADDAVRAVLLTAAGDRAFCVGQDLKEHIGLLAADRETGSGQTMSTVREHYNPIVRALAGAEKPVVAAVNGVAAGAGLGFALAADYRIVADTAAFNTSFAGVALTADSGISWTLPRVVGPGRAADLLLFPRSIRAQEAYELGIATRVVPAADLRAEAEKTARALAEGPTVAYAALKEAMAYGLTHSLSETLDKEDELQSRAGASEDHAIAVRAFVEKGKPKYLGR

SEQ ID NO: 6146 - DNA, 768 bp, Streptomyces coelicolor A3(2)
  CDS (1)..(768): transl_table=11
atgaccgtacatctcgaagtcgccgagggcgtcggcacgctgcgcctggaccgtccgcccatgaacgcactggacgtcgccacccaggaccggctgaaggagctggccgaggagatcacccggcgcgaggacgtgcgcgccgtggtgatccacggcggtgagaaggtgttcgcggcgggcgcggacatcaaggagatgcaggtgatggaccacgcggcgatgatcgcgcggtcttgcgccctgcaggactccttcaccgcggtggcccgcatccccaagccggtggtcgcggcggtgaccggctacgcgctgggcggcggctgcgaactcgccctgtgcgccgacttccgcatcgcgggggagaacgccaagctgggccagcccgagatcctgctcggcctgatccccggcgcgggcggcacccagcggctgtcccggctgatcggcccctccaaggccaaggacctgatcttcacgggccgtcaggtgaaggccgacgaggcgctggcgctcggcctggtggaccgggtggtcccggccgccgaggtgtacgagcaggcgcacgcctgggccgcgcggctcgccaagggccccgccatcgcactgcgcgcggcgaaggaggcgatcgacacgggtctggagacggacatcgagaccggcctcgccgtcgagcgcaactggttcgcgggcctgttcgccaccgaggaccgcgagcgcgggatgcgcagcttcgtggaagagggccccggcaaggccacgttcctctga

SEQ ID NO: 6147 - protein, 255 aa, Streptomyces coelicolor A3(2)
MTVHLEVAEGVGTLRLDRPPMNALDVATQDRLKELAEEITRREDVRAVVIHGGEKVFAAGADIKEMQVMDHAAMIARSCALQDSFTAVARIPKPVVAAVTGYALGGGCELALCADFRIAGENAKLGQPEILLGLIPGAGGTQRLSRLIGPSKAKDLIFTGRQVKADEALALGLVDRVVPAAEVYEQAHAWAARLAKGPAIALRAAKEAIDTGLETDIETGLAVERNWFAGLFATEDRERGMRSFVEEGPGKATFL

SEQ ID NO: 6148 - DNA, 783 bp, Oceanobacillus iheyensis HTE831
  CDS (1)..(783): transl_table=11
gtgacaatgacatctgcggttcgttatcaaaaggaaaatcaaatagcttatatagcaatgaatcgaccagaaaaacgaaatgcattatcgatagaaatggcagaagaattaatagcagcactacatcaggcagagaaagattcagaggtgaaggtagtaattttaaccggtgaaggaaaaggtttctctgctggaggggatctacaagtactgcattcattaaataattccgctcaaattatgaattatatgaagaaagcactgcaaattattcaaacgatgcgggacttagataaatatgtaatcagtgctgtgcatggatttgcagcaggagcgggatttagcattgcaattgcagccgattttatagtagcaaagaaagatgctagttttgcttgtagttttacaaatgtaggtattatcccggatttaggtcttttaaaaggtcttgctgataaactaccaacagctgttgcaaaagagtggatttcatccggaaggcatattactgcacaagaagcttatgagcgaggaatagtaaatcgtgtagtagaaggagatctattagaagaagcgacggattttgcacaatttattgtacaaggtccgccattagctaatcaatttgttaagcacatggtgaatcatgctagtgaatacaaccaggatacgaatgatctacaagaattagcggtacaaaccttacttttacagtcagaagataataaagagggaattgcagccttctttgaaaaaagaaaacctgcttttaaagggaagtaa

SEQ ID NO: 6149 - protein, 260 aa, Oceanobacillus iheyensis HTE831
MTMTSAVRYQKENQIAYIAMNRPEKRNALSIEMAEELIAALHQAEKDSEVKVVILTGEGKGFSAGGDLQVLHSLNNSAQIMNYMKKALQIIQTMRDLDKYVISAVHGFAAGAGFSIAIAADFIVAKKDASFACSFTNVGIIPDLGLLKGLADKLPTAVAKEWISSGRHITAQEAYERGIVNRVVEGDLLEEATDFAQFIVQGPPLANQFVKHMVNHASEYNQDTNDLQELAVQTLLLQSEDNKEGIAAFFEKRKPAFKGK

SEQ ID NO: 6150 - DNA, 894 bp, Shigella flexneri 2a str. 301
  CDS (1)..(894): transl_table=11
atgaaacgtcagggaactaccctgccagctaataatcacgccctaaaacaatatgcattttttgcagggatgttgtcgtccctaaaaaagcaaaaatggagaaaaggaatgagtgaatcattacatctgacccgcaatggatcaattctggaaattacccttgatcgcccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggtggttttgcgggattaaccgaaattttcaatctcgacaaaccagttatcgcagctgtgaacggctacgcctttggcggcggtttcgaactggcgctggcggcagattttattgtttgtgccgataacgccagcttcgccctgccggaagccaaactgggcatcgttcctgacagcggcggtgtgctgcgtctgccgaagatcctgccgcctaccatcgtcaatgaaatggtgatgaccggcagacgaatgggcgcagaagaggcgctgcgttgggggatagtcaaccgcgtggttagccaggcggaactgatggataacgcccgcgaactggctcagcagctggttaacagcgccccgctggcgattgcggcgctgaaagagatctaccgcaccaccagcgaaatgccggtagaagaagcgtatcgctatattcgcagcggcgtgttgaaacactatccatcggttctgcattcggaagatgccattgaagggccgctggcgtttgccgagaagcgcgatccggtgtggaaaggacgttaa

SEQ ID NO: 6151 - protein, 297 aa, Shigella flexneri 2a str. 301
MKRQGTTLPANNHALKQYAFFAGMLSSLKKQKWRKGMSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPTIVNEMVMTGRRMGAEEALRWGIVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 6152 - DNA, 792 bp, Pseudomonas putida KT2440
  CDS (1)..(792): transl_table=11
atgactttccagcacatcctgttttccatcgaggacggcgttgccttcctttcattgaaccgccccgagcagctgaacagcttcaatacggccatgcacctggaggtgcgcgaagcgctcagacaagtgcgccagagcagtgacgcgcgggtgctgctgctgacggctgaaggccgcggcttctgcgccggccaggacctgtccgaccgcaacgttgccccaggcgccgagatgccagacctgggccagtcgatcgacaagttctacaacccgctggtgcgcaccctgcgcgacctgcctttgccggtgatatgtgcggtcaacggcgtggcggccggtgccggtgccaacattcccttggcctgcgacctggtgctggccgcccgctcggccagtttcatccaggccttctgcaagatcggcctggtgccggactccggcggtacttggctgctgccgcgcttggtcggcatggcccgggccaaggcgctggccatgctgggcgagcgccttggcgccgaacaggccgagcaatgggggctgatctaccgcgtggtggatgatgcagcgctgcgtgatgaagccctcaccctcgcccgccacctcgccgcccagcccacctacggcctgacactgatcaagcgcagcctcaatgccagtttcgacaatggttttgaggcgcagctggagctggagcgcgacctgcagcgcctggcagggcgcagcgaggactaccgcgaaggcgtgaacgccttcatgaacaaacgcacgccagccttcaaggggcgctga

SEQ ID NO: 6153 - protein, 263 aa, Pseudomonas putida KT2440
MTFQHILFSIEDGVAFLSLNRPEQLNSFNTAMHLEVREALRQVRQSSDARVLLLTAEGRGFCAGQDLSDRNVAPGAEMPDLGQSIDKFYNPLVRTLRDLPLPVICAVNGVAAGAGANIPLACDLVLAARSASFIQAFCKIGLVPDSGGTWLLPRLVGMARAKALAMLGERLGAEQAEQWGLIYRVVDDAALRDEALTLARHLAAQPTYGLTLIKRSLNASFDNGFEAQLELERDLQRLAGRSEDYREGVNAFMNKRTPAFKGR

SEQ ID NO: 6154 - DNA, 774 bp, Pseudomonas putida KT2440; identical to SEQ ID NO: 2616
  CDS (1)..(774): transl_table=11

SEQ ID NO: 6155 - protein, 257 aa, Pseudomonas putida KT2440; identical to SEQ ID NO: 2617

SEQ ID NO: 6156 - DNA, 795 bp, Pseudomonas putida KT2440
  CDS (1)..(795): transl_table=11
atgaccaccccgtcgtcgtcactgttgagcaaggtcgaagccggcgttgcctggatcaccctcaaccgccccgagcagcgcaacgcgctggacattcccaccctcaagcaactgcacgccttgctcgacagccatgccgacgaccccgccgtacgcgtggtggtgctgaccggtagcggccgcagcttctgcgctggcgccgacctggccgaatgggctgccgccgaagctgccggcaccctggaaagctatggctggaccgaaactgcccatgccctgatgctgcgcctgcacagcctcgacaaacccaccatcgccgccatcaacggcaccgccgtgggcggtggcatggacctcagcctgtgctgcgacctgcgcatcgccgccgcctcggcgcgcttcaaggccggctacaccagcatgggctacagccccgatgccggcgccagctggcacctgccacggctgatcggcagcgagcaggccaagcgcctgctgttcctcgacgagttgtggggcgccgatcgcgccctggccgccgggttggtcagcgaagtctgcgccgacgagcagttgcctgccgttgccgccgaactggccgggcgcctggccaatggcccgaccttcgcctatgcgcagaccaagcggctgatacgcgacggcgcccggcgcaccctggccgagcagctggaggccgagcgccacgccggcctgttgtgtggccgcagccaggatggcgccgaggccctgcaagcctcggtggaacgtcgcaccccccgttttaccggccagtaa

SEQ ID NO: 6157 - protein, 264 aa, Pseudomonas putida KT2440
MTTPSSSLLSKVEAGVAWITLNRPEQRNALDIPTLKQLHALLDSHADDPAVRVVVLTGSGRSFCAGADLAEWAAAEAAGTLESYGWTETAHALMLRLHSLDKPTIAAINGTAVGGGMDLSLCCDLRIAAASARFKAGYTSMGYSPDAGASWHLPRLIGSEQAKRLLFLDELWGADRALAAGLVSEVCADEQLPAVAAELAGRLANGPTFAYAQTKRLIRDGARRTLAEQLEAERHAGLLCGRSQDGAEALQASVERRTPRFTGQ

SEQ ID NO: 6158 - DNA, 843 bp, Pseudomonas putida KT2440
  CDS (1)..(843): transl_table=11
atgaacctttcaacctcaggagtgctgcccgtgaccgagtacagtgcattcaaggtcgaactgaccgacagcgtcgcccatgttcagatcaatcgcccagagaaggtcaacgcgatgaatgcggccttctgggaggaaatcgtcgacatcttccagtggatcgatgacaccgatgccgtgcgcgtggtggtgatcagtggcgctggcaagcatttttccgccggtatcgacctgatgatgctggcctcgctggctgggcagatgggcaaggacgtgggccgcaatgcacgcttcctgcgcaagaccatccagcggctgcaggcttcgttcaccgctgtagacgcgtgccgcaaacccgtactggcggccgtgcagggctactgcatcggcggcgccatcgacctcatctcggcgtgcgacatgcgctactgcagcagagacgcgcagttctcgatcaaggaaatcgacatgggcatggctgccgatgtcggcacattgcaacgtttgccacgcatcattggcgacggcatcatgcgtgagctggcgtttaccgggcgcaatgtcgaggccgacgaggcgctgcgtatcggcctggtcaaccgagtctatgatgatcaggctgcactgatggacggcgtctttgccatcgcccgcgagattgccgcaaaatcgccgatcgccgtggccggcaccaaggaaatgctcagctacatgcgtgaccatcgcatcgacgatggcctggactacattgccacctggaacgccgcaatgctgcagtccgaagacctgcgtgtggctgtggcggcgcacatgagcaaacagaaaccgacgttcgccgactga

SEQ ID NO: 6159 - protein, 280 aa, Pseudomonas putida KT2440
MNLSTSGVLPVTEYSAFKVELTDSVAHVQINRPEKVNAMNAAFWEEIVDIFQWIDDTDAVRVVVISGAGKHFSAGIDLMMLASLAGQMGKDVGRNARFLRKTIQRLQASFTAVDACRKPVLAAVQGYCIGGAIDLISACDMRYCSRDAQFSIKEIDMGMAADVGTLQRLPRIIGDGIMRELAFTGRNVEADEALRIGLVNRVYDDQAALMDGVFAIAREIAAKSPIAVAGTKEMLSYMRDHRIDDGLDYIATWNAAMLQSEDLRVAVAAHMSKQKPTFAD

SEQ ID NO: 6160 - DNA, 834 bp, Bradyrhizobium japonicum USDA 110
  CDS (1)..(834): transl_table=11
gtgcacgctagtatgacggcaatattccttcaggagaaaaagcgggagcgagcgatggagctaaaattttccaaggtggaacgcaagggaccgatcacgatcgtcacgctgtcgcggcccgaggtctacaatgcgctgcataccgacgcgcatttcgagctccagaaggtgttcgacgatttctcggccgatgccgagcaatgggtcgcgatcgtcacgggcgccggcgacaaggcgttctgcgccggcaacgacctgaagtggcaggcggccggcggcaaacgcggctgggacaagggcggttttgccggcctcacctcgcgcttcgactgcgacaagccgatcattgccgccgtcaacggcgttgcgatgggcggcggcttcgagatcgcgctggcctgcgacctgatcatcgccgcggagaacgcgaccttcgccttgcccgagccgcgcgtgggccttgccgccctcgccggcggcctgcaccggctgccgcgccagatcggcctgaagcgcgccatgggcatgatcctcaccgcgcgccatgtcagcgccaaggagggtcacgagctcggcttcgtcaacgaggtggtgccgcagggcgaggcgctgacggcggcgctacgctgggcggagatgatcaccaagaactcaccgatgtcgatccgggcttcaaagcaggcgatccagaaggggcttggcgtctcgctggagcaggcgatcgaggagcagcgcgaatatccggcggtgaaggcgatggtggcctcgcaggactacatcgagggcccgaaggcgttttcggagaagcggccgccgaaatgggtggggaagtaa

SEQ ID NO: 6161 - protein, 277 aa, Bradyrhizobium japonicum USDA 110
MHASMTAIFLQEKKRERAMELKFSKVERKGPITIVTLSRPEVYNALHTDAHFELQKVFDDFSADAEQWVAIVTGAGDKAFCAGNDLKWQAAGGKRGWDKGGFAGLTSRFDCDKPIIAAVNGVAMGGGFEIALACDLIIAAENATFALPEPRVGLAALAGGLHRLPRQIGLKRAMGMILTARHVSAKEGHELGFVNEVVPQGEALTAALRWAEMITKNSPMSIRASKQAIQKGLGVSLEQAIEEQREYPAVKAMVASQDYIEGPKAFSEKRPPKWVGK

SEQ ID NO: 6162 - DNA, 777 bp, Clostridium tetani E88
  CDS (1)..(777): transl_table=11
atgaaaaacattattttaaaaaaggagaatggtatagtagaaataactatcaacagacctaaatctcttaacgctttaaatagtgaaactttaaacgaattaggagcagctataaaagacatctctgaaagtgatgatgttaaggttgtaataataactggagcaggcgaaaaagcatttgttgcaggagcagatataactgaaatgcaaaatctaaatgcaaaacaaggaagagctttagcaagacttgctcaaaaagtattctctgatattgagcatatgcctcaaatagtaatagctgctgttaatggatatgcactaggtggtggatgtgaattatgtatggcttgtgatataagacttgcttctaaaaatgcaaaatttggacaaccagaagtaaacttaggaataacacctggatttgcaggtacccaaaggcttccaagattagttggcaaaggaactgccaaagaacttatatttactactgatatgatagatgctaatgaagcttatcgtatacaacttgtcaacaaagtctatgaagctgatgaattaatagacaaagcaagagaattagctaaaaaaataatgagtaaagcaccatatgctgttagcttagcaaaagcagctataaatgatggtatgaatatggatacagaatcagcctataaatatgaagcggatatatttgggttatgttttgcaacagaagaccaaaaagaaggtatgaaggcctttctagaaaagagaaaatctaattttaaaaattgctag

SEQ ID NO: 6163 - protein, 258 aa, Clostridium tetani E88
MKNIILKKENGIVEITINRPKSLNALNSETLNELGAAIKDISESDDVKVVIITGAGEKAFVAGADITEMQNLNAKQGRALARLAQKVFSDIEHMPQIVIAAVNGYALGGGCELCMACDIRLASKNAKFGQPEVNLGITPGFAGTQRLPRLVGKGTAKELIFTTDMIDANEAYRIQLVNKVYEADELIDKARELAKKIMSKAPYAVSLAKAAINDGMNMDTESAYKYEADIFGLCFATEDQKEGMKAFLEKRKSNFKNC

SEQ ID NO: 6164 - DNA, 783 bp, Streptomyces avermitilis MA-4680
  CDS (1)..(783): transl_table=11
atgagcacggcgcccgaagctgccgacttggtgctccacgagcgtcacggcggcgtactgaccatcaccatcaaccgccccgcgcagaagaacgccgtcgaccacgaggccgcggtacagctcgcggcggccgtggatctgctcgacgcggacccggagctgtcggtcggcgtcctcacgggcgcgggcggggtgttcagcgcgggcatggacctgaaggcgttcgccaagggcgagctgcccttgctgcccagccggggcctgggcgggctcacccgcgcgtcggtgcgaaagccgctggtcgccgcggtcgagggctgggcgctcggcggtggcttcgagctggtcctcgcctgcgacctgatcgtcgccgcggaggacgcccgcttcgggtttcccgaggtcatgcgtggtctcgtggcggcggagggcggactggtcaggctgccgcgccgacttccgtaccacgtcgccgcgcgcgtactgctgacgggcgagccgctgaccgccgtcgaagccaaggagtacgggctcgtcaatgagctgaccccgcccggcgccgcgctggacgcggcccgggagctcgcgggccgcgtcgcgcggaacgcaccgcttgcactggcggccgtcaaggaggtcctgcgcgagacacagggcctgaaggagagcgacgcgttcagacgccaggacgagctcacgagcggactggccgccagcgaggacgcgcgggaaggcgcacaggcgttcgccgagaaacgcgccccggtctggcacggccgctga

SEQ ID NO: 6165 - protein, 260 aa, Streptomyces avermitilis MA-4680
MSTAPEAADLVLHERHGGVLTITINRPAQKNAVDHEAAVQLAAAVDLLDADPELSVGVLTGAGGVFSAGMDLKAFAKGELPLLPSRGLGGLTRASVRKPLVAAVEGWALGGGFELVLACDLIVAAEDARFGFPEVMRGLVAAEGGLVRLPRRLPYHVAARVLLTGEPLTAVEAKEYGLVNELTPPGAALDAARELAGRVARNAPLALAAVKEVLRETQGLKESDAFRRQDELTSGLAASEDAREGAQAFAEKRAPVWHGR

SEQ ID NO: 6166 - DNA, 771 bp, Streptomyces avermitilis MA-4680
  CDS (1)..(771): transl_table=11
atgcacagcaccaccgaggtgcggaccgagaccatcggttcgtccctgctcatcaccatcgaccggccgaaggcgcgcaacgcggtcaacgccgccgtagccactcaacttgctttcgccatagaccagttggaggcggaccccgccctgcgcgcagcggtgctcaccggcgcccagggcacgttcagcgccgggatggacctcaaggccgcgctggccggtgaatcgcccgagatcccggggcgcggcttcggcgggctcacccgggcgcggaccaccaagccgctgatcgcggccgtcgagggctgggcgatgggcggcggattcgaactggccctgggctgcgatctgatcgtcgccgcggacgacgccaggttcggtctgccggaggtcggccgcgggctgatcgcggcgggcggcggagtgatccggctgcccaagcgcatcccgtaccacctggcgatggaactgctgctcaccggcgagccggtctccggcgaacgggccggacagctcggcatcgccaaccgtgtggtcgcggcgggggagaccgtcgccaccgcactgcacctggccgagcggatcgcgcagaacgccccgctggccctggccgccgtcaagaacctcgtccgcgccgcggacggcgcgcccgaggaggaggcgttcgccgtacaggggcggctgatggccactctcgcggcctccgccgacgtgcgcgagggcatgaccgccttcaccgagcgccgctccccggtctggcagggccggtag

SEQ ID NO: 6167 - protein, 256 aa, Streptomyces avermitilis MA-4680
MHSTTEVRTETIGSSLLITIDRPKARNAVNAAVATQLAFAIDQLEADPALRAAVLTGAQGTFSAGMDLKAALAGESPEIPGRGFGGLTRARTTKPLIAAVEGWAMGGGFELALGCDLIVAADDARFGLPEVGRGLIAAGGGVIRLPKRIPYHLAMELLLTGEPVSGERAGQLGIANRVVAAGETVATALHLAERIAQNAPLALAAVKNLVRAADGAPEEEAFAVQGRLMATLAASADVREGMTAFTERRSPVWQGR

SEQ ID NO: 6168 - DNA, 786 bp, Bordetella pertussis Tohama I
  CDS (1)..(786): transl_table=11
atgagcgaacaaagcatactcaccgaagtccgcgaccacgtcggcatcatcaccatcaaccgtcccaagctgcacaacgcgctggacacgccgaccctgctcgaactggagcgcgcgctgaccacgctggaggccgacgccgagtgccgcgtcatcgtcgtgaccggcgcgggcgagaagtcgttcgtggccggcggcgacctggtcgacctgaattcgcgccagggcctggcccactaccaggagttcgccgaggacatccatcacgtgttccgccgcttcgagaccagcgacaagcccaccatcgccgcggtcaacggctgggcgctgggcggcggcaccgagctgctcctgtgcctggacctgcgcatcgtggccgataacgccgccatcgcgttgaccgaagtgaacctgggcctgttcccgggcgcgggcggcacgcagcgcatcatccgccagatctcgccgtgccaggccaaggaaatgatgttcaccggcgggcgcatcagcgccgccgacgccgtgcgcatcggcctggccaaccgcgcggtgccggcggccgacctgatggccgaaacgctggcgctggccgggcagatcgccgccaagtcgccgctggtgctcaagctgctcaagcgcaccttgcgcgacggcgccgacatgccgctggccaacgcgctggcgcacgagcaggccatgatcggcctggtgctggatacgcgcgacgcccacgaaggcatcggcgccttcctcgaaaagcgcgccgcgcgctttaccggacagtag

SEQ ID NO: 6169 - protein, 261 aa, Bordetella pertussis Tohama I
MSEQSILTEVRDHVGIITINRPKLHNALDTPTLLELERALTTLEADAECRVIVVTGAGEKSFVAGGDLVDLNSRQGLAHYQEFAEDIHHVFRRFETSDKPTIAAVNGWALGGGTELLLCLDLRIVADNAAIALTEVNLGLFPGAGGTQRIIRQISPCQAKEMMFTGGRISAADAVRIGLANRAVPAADLMAETLALAGQIAAKSPLVLKLLKRTLRDGADMPLANALAHEQAMIGLVLDTRDAHEGIGAFLEKRAARFTGQ

SEQ ID NO: 6170 - DNA, 783 bp, Bordetella pertussis Tohama I
  CDS (1)..(783): transl_table=11
atgagcgcgcaaacccccgatgccgcggaagtcctcgtcgaccgcgccgacggcattctcaccattaccatcaaccgcccgcaggcccgcaacgcgatcaacctggcggtggcgcgcggcatcgccgcggcggtggacgagctggacgccagcgacgacctgcgcatcggcatcctgaccggcgccggcggctcgttctgcgccggcatggatctcaagggctttctgcgcggcgagcggcccagcatcgaggggcgcggctttggcggactgaccgcccggccgccgcgcaagccgctgatcgcggcggtggagggctatgcgctggccggcggcttcgaactggtgctggcctgcgacctggtggtggcggccgacaatgcgcagttcggcgtgcccgaggtcaagcgcgggctggcggccacggccggcggcctggtgcgcctgcagcgccagctgccctaccgcatcgcgctggagctggcgctgaccggcgacatgttcccggcccggcgcgcccacggctatggcctgatcaaccagctgaccgaacccggccaggcgctggaggccgcgcccgaactggcgcggcgcatcgtcgccaacggaccgctggccgtggccgccagcaagcgggtggtggtcgagtcgcaggactggccggccgacgaggtgtgggagcgccaggcggcgctgaccgaccatgtgttcgagtcggccgacgcgcgcgagggctcggcggccttcgcggagaagcgccagcccgtgtggcaggggaagtag

SEQ ID NO: 6171 - protein, 260 aa, Bordetella pertussis Tohama I
MSAQTPDAAEVLVDRADGILTITINRPQARNAINLAVARGIAAAVDELDASDDLRIGILTGAGGSFCAGMDLKGFLRGERPSIEGRGFGGLTARPPRKPLIAAVEGYALAGGFELVLACDLVVAADNAQFGVPEVKRGLAATAGGLVRLQRQLPYRIALELALTGDMFPARRAHGYGLINQLTEPGQALEAAPELARRIVANGPLAVAASKRVVVESQDWPADEVWERQAALTDHVFESADAREGSAAFAEKRQPVWQGK

SEQ ID NO: 6172 - DNA, 828 bp, Bordetella pertussis Tohama I; identical to SEQ ID NO: 2624
  CDS (1)..(828): transl_table=11

SEQ ID NO: 6173 - protein, 275 aa, Bordetella pertussis Tohama I; identical to SEQ ID NO: 2625

SEQ ID NO: 6174 - DNA, 774 bp, Bordetella pertussis Tohama I
  CDS (1)..(774): transl_table=11
atggcgcgggcggacgacatcgaggtacgcgtggccgaccaggtggcctgggtcaccatcaaccggccgcagcgcatgaacgcgctggcccgcgccaccttcgcgcaactggtcgaggtctcgctcgaactggaccaggaccctggcgtcaaggtggtggtctataccggcgcgggcgagcgcgccttctcggccggcgtggacctcaaggagctggacgcggccggccgcatgacccatcccatgggcggcctggcacgcaatctcaacgaggtcgtgctggaaatggccacgccgaccatcgcggccatcaatggcgtggccgccggcggcgggtgcgagctggccctggcctgcgacatccgcgtggccgcgtccaccgcgcgcatcggcctgccggaagcccgggtcggcatgggcgccaatttcggcagcgtggtgctgccccagctgataccgcgcggcgtggcgctggaactgctttataccggcgagctgatcgacatggcgctggcgcaccggttggggctggtcaaccacgtgttcgagccggccgagctgatggcgcagaccgccggcctggcgcgccgcatcgccgacaacgccccgctgtcggtgcagcgcatgaaggccatggcgttcaagagcatcggcctgcccaccgcggcggccctgcggctgtcggtcggccccgacccctacaacagcgaagacaggctggaaggcgcgcgcgccttcgtggaaaagcgcaagccgcgcttccagggccgatag

SEQ ID NO: 6175 - protein, 257 aa, Bordetella pertussis Tohama I
MARADDIEVRVADQVAWVTINRPQRMNALARATFAQLVEVSLELDQDPGVKVVVYTGAGERAFSAGVDLKELDAAGRMTHPMGGLARNLNEVVLEMATPTIAAINGVAAGGGCELALACDIRVAASTARIGLPEARVGMGANFGSVVLPQLIPRGVALELLYTGELIDMALAHRLGLVNHVFEPAELMAQTAGLARRIADNAPLSVQRMKAMAFKSIGLPTAAALRLSVGPDPYNSEDRLEGARAFVEKRKPRFQGR

SEQ ID NO: 6176 - DNA, 786 bp, Bordetella parapertussis 12822
  CDS (1)..(786): transl_table=11
ttgagacggagcgcgcccaagaccttattcaagttcgacagggggaaacacatggaagtcacttaccagtcgctcgaccgggttgcgctggtcacgatcaaccgtccgcagcgggggaattcgatgaacccggcggtggtcagggaactggcccaggcctgggaacgattcagcggcggggacgacctggtcgcggtgatcacgggcgcgggcaacgatgcgttctgtaccggggcggacctcaaggagttgcccggcgaggtatggcgcgcgctgcccaacttcgccgtgcccaccgacaagccggtcattgccgccgtgagcggccgtgccgtggggggcggctgcaccctggcgctctacgcggacatgatcgtcgccagcgagtcggcgcaattcatctatccggaggcgaagatcggcatcttccagggcatcatggggggctttcccagaaagctgccttatgcagccgggttggagtggatcacgaccggcgatcccatgtccgcgcagcgcgcctacgaactgggtttcgtgaacaaggtatgcaagacaggcgagcaggtcgaggcggcgctggagatggcccgcaagatcgccgccagcgcgccactggttgtccaggccatgaagcatctggcgctcaagaccttgcccgccaaccccatggaaacgttctatccgcaaaagggcatgctcgaggcgatcgccaggagccaggatgccgaggagggcctgcaggcgctgcgcgacaagcgcgatccggtattcaagggctgctag

SEQ ID NO: 6177 - protein, 261 aa, Bordetella parapertussis 12822
MRRSAPKTLFKFDRGKHMEVTYQSLDRVALVTINRPQRGNSMNPAVVRELAQAWERFSGGDDLVAVITGAGNDAFCTGADLKELPGEVWRALPNFAVPTDKPVIAAVSGRAVGGGCTLALYADMIVASESAQFIYPEAKIGIFQGIMGGFPRKLPYAAGLEWITTGDPMSAQRAYELGFVNKVCKTGEQVEAALEMARKIAASAPLVVQAMKHLALKTLPANPMETFYPQKGMLEAIARSQDAEEGLQALRDKRDPVFKGC

SEQ ID NO: 6178 - DNA, 801 bp, Bordetella parapertussis 12822
  CDS (1)..(801): transl_table=11
atgacccggtttctagaagtggagcggcgtggccgcgtttgtatcgtcaggatgaatcggcccgaggcgcgcaatgcgctgaccgatgccgagcagttccaggagttcgaggacctggtgcgcgagctcaacgcggacctggatgtgcgggcggccatcctgaccggcaacggcccgtcgttttgcgcgggcggcaatgtcaagaagatgctggcggactacggcccggacagcggaccggcggcgcgcattcccgcgaagtacagcacgggcatccagcgcattcccatggccctggcgcagcttgacgtgccgctgatcgcggcggtcaacggcgcggccatcggcgcgggctgcgacctggcctgcatgtgcgatatccgcatcgccgccgacgatgcgcgattcgccgagagtttcgtcaagctgggcatcatccccggcgatggcgggtcgtggttcctgccgcgcatcatcgggctggcgcgcacctacgagatggcgtttaccggcgatacgctggacgcggccaccgcgttgcaatggaacctggtgtccagcgtcgtgccggcggcgcagctcatggacgccgcctgccagctggccgagcggatcgccgtcaatccgccgcagcaggtgcgcttcgccaagcggctgatccgcgaaggcctgcaccagcggctggaggccatgctggagttctccaggctgtatcaaaccctgtcgcaccgcaccgcggaccaccaggagggcattgcggccttgctggaaaagcgcccgcctgtctttcacggacgctga

SEQ ID NO: 6179 - protein, 266 aa, Bordetella parapertussis 12822
MTRFLEVERRGRVCIVRMNRPEARNALTDAEQFQEFEDLVRELNADLDVRAAILTGNGPSFCAGGNVKKMLADYGPDSGPAARIPAKYSTGIQRIPMALAQLDVPLIAAVNGAAIGAGCDLACMCDIRIAADDARFAESFVKLGIIPGDGGSWFLPRIIGLARTYEMAFTGDTLDAATALQWNLVSSVVPAAQLMDAACQLAERIAVNPPQQVRFAKRLIREGLHQRLEAMLEFSRLYQTLSHRTADHQEGIAALLEKRPPVFHGR

SEQ ID NO: 6180 - DNA, 759 bp, Bordetella parapertussis 12822
  CDS (1)..(759): transl_table=11
atgaacacatccccgaccgtaagattcgaaacgcgcgaacagatcgcgatcatcacgctgaaccggcccgacaaacgcaacgccatcaacctggagatgcggcaggcgctgattgccgcctgggagcggttcgagaacgatgcggcgctgcgggtcgcgatcctcaccggcgcgggcgaacgcagcttcagcgccggacgcgacctgtccgagaacacggacctcagccagaagacgttcctgcccatactcggcgacaacgtccaggcaagcaagcctgtcatcgcggcggtcaatggcgccgcactgggcggcggctggttcttcacgcaaatgtgcgacctggtggtggccgcggaccatgccgtgttcggcatgccggaatccaaggtcggccgggcgccggcctgggcggtctggttgcagggggtgatcccgcagaagctggtgctggagctgctgctgaccggcaatcccatcagcgcgcagcgggccgccgagatcggcttcgtcaatcatgtggtgcccgccgcgcagctgatggacaaggccatggagctggcgcgcgccatcgtggccacggcgccgctgagcgcggcggcctgcaaggagatggtctatgccgcggccgagatggagcggggcgcggccctgcggacggctttccatatcctggagccgctataccgctcggaagacgcgcgggaaggcgcgctggcgtttcgcgagaagcgcgcgccgcgctggagcggacgatga

SEQ ID NO: 6181 - protein, 252 aa, Bordetella parapertussis 12822
MNTSPTVRFETREQIAIITLNRPDKRNAINLEMRQALIAAWERFENDAALRVAILTGAGERSFSAGRDLSENTDLSQKTFLPILGDNVQASKPVIAAVNGAALGGGWFFTQMCDLVVAADHAVFGMPESKVGRAPAWAVWLQGVIPQKLVLELLLTGNPISAQRAAEIGFVNHVVPAAQLMDKAMELARAIVATAPLSAAACKEMVYAAAEMERGAALRTAFHILEPLYRSEDAREGALAFREKRAPRWSGR

SEQ ID NO: 6182 - DNA, 768 bp, Bordetella parapertussis 12822
  CDS (1)..(768): transl_table=11
atgtcagaactggtcaaggtggaaatcgccgacggcatccagatcatcacggtcaaccgtcccgaagccaggaacgccatcaatttcgaaacggcgcaggccatggccgccgcgctggaccaactcgatgagcgcgacgacgtgcgtatcggcatcctgaccggcgcgggcggcacgttctcggccggcatggacttgaaggcgttcgcccggaccggacagcgcccgtcgctacccgagcgtggctttgccgccctgaccgaacgcccgccgaagaaaccgctgatcgcggcggtcgagggctatgcgctggccggtggctgcgaaatggccctgagctgcgatctgctggtggccgccgacaatgccaagttcggcctgcccgaagtcaagcgcggcctggtgccgggcgccggcggcatgctgcgcctgccgcgccggctgccgtaccacatcgccatggaaatcatcctgacgggcgatttcctggatgcgtcgcgcgcccatgcgctgggcctggtcaaccgcctgacggcggccggcggcgcgctggaaggcgcgctggcgctggcccgcgtcatcgtcgagaacggcccgctggcggtgcaggttgccaagagcatcgtcgcgcaatcgggcgactgggaccaggaaaccatgttcgaccgccagcgtccgcaggtcaccgaaatcttcacctcggccgacgccaaggaaggcgccaccgccttcgccgagaagcgcaagcctgtctggcaaggcaaataa

SEQ ID NO: 6183 - protein, 255 aa, Bordetella parapertussis 12822
MSELVKVEIADGIQIITVNRPEARNAINFETAQAMAAALDQLDERDDVRIGILTGAGGTFSAGMDLKAFARTGQRPSLPERGFAALTERPPKKPLIAAVEGYALAGGCEMALSCDLLVAADNAKFGLPEVKRGLVPGAGGMLRLPRRLPYHIAMEIILTGDFLDASRAHALGLVNRLTAAGGALEGALALARVIVENGPLAVQVAKSIVAQSGDWDQETMFDRQRPQVTEIFTSADAKEGATAFAEKRKPVWQGK

SEQ ID NO: 6184 - DNA, 777 bp, Bordetella parapertussis 12822; identical to SEQ ID NO: 2626
  CDS (1)..(777): transl_table=11

SEQ ID NO: 6185 - protein, 258 aa, Bordetella parapertussis 12822; identical to SEQ ID NO: 2627

SEQ ID NO: 6186 - DNA, 735 bp, Bordetella bronchiseptica RB50
  CDS (1)..(735): transl_table=11
atggaagtcacttaccagtcgctcgaccgggttgcgctggtcacgatcaaccgtccgcagcgggggaattcgatgaacccggcggtggtcagggaactggcccaggcctgggaacgattcagcggcggggatgacctggtcgcggtgatcacgggcgcgggcaacgatgcgttctgtaccggggcggacctcaaggagttgcccggcgaggtatggcgcgcgctgcccaacttcgccgtgcccaccgacaagccggtcattgccgccgtgagcggccgcgccgtggggggcggctgcaccctggcgctctacgcggacatgatcgtcgccagcgagtcggcgcaattcatctatccggaggcgaagatcggcatcttccagggcatcatggggggctttcccagaaagctgccttatgcagccgggttggagtggatcacgaccggcgatcccatgtccgcgcagcgcgcctacgaactgggtttcgtgaacaaggtatgcaagacaggcgagcaggtcgaggcggcgctggagatggcccgcaagatcgccgccagcgcgccactggttgtccaggccatgaagcatctggcgctcaagaccttgcccgccaaccccatggaaacgttctatccgcaaaagggcatgctcgaggcgatcgccaggagccaggatgccgaggagggcctgcaggcgctgcgcgacaagcgcgatccggtattcaagggctgctag

SEQ ID NO: 6187 - protein, 244 aa, Bordetella bronchiseptica RB50
MEVTYQSLDRVALVTINRPQRGNSMNPAVVRELAQAWERFSGGDDLVAVITGAGNDAFCTGADLKELPGEVWRALPNFAVPTDKPVIAAVSGRAVGGGCTLALYADMIVASESAQFIYPEAKIGIFQGIMGGFPRKLPYAAGLEWITTGDPMSAQRAYELGFVNKVCKTGEQVEAALEMARKIAASAPLVVQAMKHLALKTLPANPMETFYPQKGMLEAIARSQDAEEGLQALRDKRDPVFKGC

SEQ ID NO: 6188 - DNA, 783 bp, Bordetella bronchiseptica RB50
  CDS (1)..(783): transl_table=11
atgagcgtgcaagcccccgatgccgcggaagtcctcgtcgaccgtgccgacggcattctcaccatcaccatcaaccggccgcaggcccgcaacgcgatcaacccggcggtggcgcgcggcatcgccgcggcggtcgacgagctcgacgccagcgacgagctgcgcatcggcatcctgaccggcgccggcggttcgttctgcgccggcatggatctcaagggcttcctgcgcggcgagctgcccagcatcgaggggcgcggcttcggcgggctgaccgcccggccgccgcgcaagccgctgatcgcggcggtggagggctatgcgctggccggcggcttcgaactggtgctggcctgcgacctggtggtggcggccgacaatgcgcagttcggcgtgcccgaggtcaagcgcgggctggcggccacggccggcggcctggtgcgcctgccgcgccagctgccctaccgcatcgcgctggagctggcgctgaccggcgacatgttcccggcccggcgcgcccacggctatggcctgatcaaccagctgaccgaacccggccaggcgctggacgcggcgcgcgaactggcgcggcgcatcgtcgccaacgggccgctggccgtggccgccagcaagcgcgtggtggtcgagtcgcaggactggccggccgacgaggtgtgggagcgccaggcggcgctgaccgagcatgtgttcgagtcggccgacgcgcgcgagggctcggcggccttcgcggaaaagcgccagcccgtctggcaggggaagtag

SEQ ID NO: 6189 - protein, 260 aa, Bordetella bronchiseptica RB50
MSVQAPDAAEVLVDRADGILTITINRPQARNAINPAVARGIAAAVDELDASDELRIGILTGAGGSFCAGMDLKGFLRGELPSIEGRGFGGLTARPPRKPLIAAVEGYALAGGFELVLACDLVVAADNAQFGVPEVKRGLAATAGGLVRLPRQLPYRIALELALTGDMFPARRAHGYGLINQLTEPGQALDAARELARRIVANGPLAVAASKRVVVESQDWPADEVWERQAALTEHVFESADAREGSAAFAEKRQPVWQGK

SEQ ID NO: 6190 - DNA, 780 bp, Bordetella bronchiseptica RB50
  CDS (1)..(780): transl_table=11
ttggaagaactcatcatcgaaaccaaagacggcgtgcgctggttgacgctcaaccgcccgcacgccctcaatgccctgaatgccgcgctggtggccgcgctgaccgaggccatcggccaggcgcaggccgacccgcaaatcggcgccatcgtcctgacgggcgccggccgggccttctgcgccggcgccgacctcaaggagaccgagcgccgcacccaggagcaaggcagcaatgtcgcgttcatccgcgccatcggcgcgctgaccgagctgatcgaggcgggcgccaagccggtgatcgccgccgtcaacggcatcgccgtggccggcgggctggagctggtgctggcctgcgacatcgtgctcgcggccgatagcgcgcggctgggcgatgcccacgccaactacgccatgtttcccggcggcggcgcgaccgtgcggctgccccgccgcatcggcatcggcaacgccaagtacgtgatgttcaccggccagtcgctgccggccagcgagtgggtggcgctgggcctggtggcgcgcgcggtgccggccgaccagctggccgagcacgccgcgcaactggccggccagatcgccggcaagagcccgctggtcatcgcccgcatgaaaagcgccctcaacgacgccaccgaccagcccgcgcccgtggccatgcggcgcgagcgcgaactcaaccacctgcacagcctgtcgttcgatcgcgccgaggggctggcggcattccgcgagaaacgtccgccccgcttccagggccgttga

SEQ ID NO: 6191 - protein, 259 aa, Bordetella bronchiseptica RB50
MEELIIETKDGVRWLTLNRPHALNALNAALVAALTEAIGQAQADPQIGAIVLTGAGRAFCAGADLKETERRTQEQGSNVAFIRAIGALTELIEAGAKPVIAAVNGIAVAGGLELVLACDIVLAADSARLGDAHANYAMFPGGGATVRLPRRIGIGNAKYVMFTGQSLPASEWVALGLVARAVPADQLAEHAAQLAGQIAGKSPLVIARMKSALNDATDQPAPVAMRRERELNHLHSLSFDRAEGLAAFREKRPPRFQGR

SEQ ID NO: 6192 - DNA, 759 bp, Bordetella bronchiseptica RB50
  CDS (1)..(759): transl_table=11
atgaacacatccccgaccgtaagattcgaaacgcgcgaacagatcgcgatcatcacgctgaaccggcccgacaaacgcaacgccatcaacctggagatgcggcaggcgctgattgccgcctgggagcggttcgagaacgatgcggcgctgcgggtcgcgatcctcaccggcgcgggcgaacgcagcttcagcgccggacgcgacctgtccgagaacacggatctcagccagaagacgttcctgcccatactcggcgacaacgtccaggcaagcaagcctgtcatcgcggcggtcaatggcgccgcactgggcggcggctggttcttcacgcaaatgtgcgacctggtggtggccgcggaccatgccgtgttcggcatgccggaatccaaggtcggccgggcgccggcctgggcggtctggttgcagggggtgatcccgcagaagctggtgctggagctgctgctgaccggcaatcccatcggcgcgcagcgggccgccgagatcggcttcgtcaatcatgtggtgcccgccgcgcagctgatggacaaggccatggagctggcgcgcgccatcgtggccacggcgccgctgagcgcggcggcctgcaaggagatggtctatgccgcggccgagatggggcggggcgcggccctgcggacggctttccatatcctggagccgctataccgctcggaagacgcgcgggaaggcgcgctggcgtttcgcgagaagcgcgcgccgcgctggagcggacgatga

SEQ ID NO: 6193 - protein, 252 aa, Bordetella bronchiseptica RB50
MNTSPTVRFETREQIAIITLNRPDKRNAINLEMRQALIAAWERFENDAALRVAILTGAGERSFSAGRDLSENTDLSQKTFLPILGDNVQASKPVIAAVNGAALGGGWFFTQMCDLVVAADHAVFGMPESKVGRAPAWAVWLQGVIPQKLVLELLLTGNPIGAQRAAEIGFVNHVVPAAQLMDKAMELARAIVATAPLSAAACKEMVYAAAEMGRGAALRTAFHILEPLYRSEDAREGALAFREKRAPRWSGR

SEQ ID NO: 6194 - DNA, 774 bp, Bordetella bronchiseptica RB50
  CDS (1)..(774): transl_table=11
atggcgcgggcggacgacatcgaggtacgcgtggccgaccaggtggcctgggtcaccatcaaccggccgcagcgcatgaacgcgctggcccgcgccaccttcgcgcaactggtcgaggtctcgctcgaactggaccaggaccctggcgtcaaggtggtggtctataccggcgcgggcgagcgcgccttctcggccggcgtggacctcaaggagctggacgcggccggccgcatgacccatcccatgggcggcccggcgcgcaatctcaacgaggtcgtgctggaaatggccacgccgaccatcgcggccatcaatggcgtggccgccggcggcgggtgcgagctggccctggcctgcgacatccgcgtggccgcgtccaccgcgcgcatcggcctgccggaagcccgggtcggcatgggcgccaatttcggcagcgtggtgctgccccagctgataccgcgcggcgtggcgctggaactgctttataccggcgagctgatcgacatggcgctggctcaccggctggggctggtcaaccacgtgttcgagccggccgagctgatggcgcagaccgccggcctggcgcgccgcatcgccgacaacgccccgctgtcggtgcagcgcatgaaggccatggcgttcaagagcatcggcctgcccaccgcggcggccctgcggctgtcggtcggccccgacccctacaacagcgaagacaggctggaaggcgcgcgcgccttcgtggaaaagcgcaagccgcgcttccagggccgataa

SEQ ID NO: 6195 - protein, 257 aa, Bordetella bronchiseptica RB50
MARADDIEVRVADQVAWVTINRPQRMNALARATFAQLVEVSLELDQDPGVKVVVYTGAGERAFSAGVDLKELDAAGRMTHPMGGPARNLNEVVLEMATPTIAAINGVAAGGGCELALACDIRVAASTARIGLPEARVGMGANFGSVVLPQLIPRGVALELLYTGELIDMALAHRLGLVNHVFEPAELMAQTAGLARRIADNAPLSVQRMKAMAFKSIGLPTAAALRLSVGPDPYNSEDRLEGARAFVEKRKPRFQGR

SEQ ID NO: 6196 - DNA, 786 bp, Bordetella bronchiseptica RB50
  CDS (1)..(786): transl_table=11
atgagcgaacaaagcatactcaccgaagtccgcgaccacgtcggcatcattaccatcaaccgtcccaagctgcacaacgcgctggacacgccgaccctgctcgaactggagcgcgcgctgaccacgctggaggccgaccccgagtgccgcgtcatcgtcgtgaccggcgcgggcgagaagtcgttcgtggccggcggcgacctggtcgacctgaattcgcgccagggcctggcccactaccaggagttcgccgaggacatccatcgcgtgttccgccgcttcgagaccagcgacaaacccaccatcgccgcggtcaatggctgggcgctgggcggcggcaccgagctgctgctgtgcctggacctgcgcatcgtggccgagaacgccgccatcgcgctgaccgaggtgaacctgggcctgttcccgggcgcgggcggcacgcagcgcatcatccgccagatctcgccgtgccaggccaaggaaatgatgttcaccggcgggcgcatcagcgccgccgacgccgtgcgcatcggcctggccaaccgcgcggtgccggcggccgacctgatggccgaaacgctggcgctggccgggcagatcgccgccaagtcgccgctggtgctcaagctgctcaagcgcaccctgcgcgacggcgccgacatgccgctggccaacgcgctggcgcacgagcaggccatgatcggcctggtgctggatacccgcgacgcccacgaaggcatcggcgccttcctcgaaaagcgcgccgcgcgctttaccggacagtag

SEQ ID NO: 6197 - protein, 261 aa, Bordetella bronchiseptica RB50
MSEQSILTEVRDHVGIITINRPKLHNALDTPTLLELERALTTLEADPECRVIVVTGAGEKSFVAGGDLVDLNSRQGLAHYQEFAEDIHRVFRRFETSDKPTIAAVNGWALGGGTELLLCLDLRIVAENAAIALTEVNLGLFPGAGGTQRIIRQISPCQAKEMMFTGGRISAADAVRIGLANRAVPAADLMAETLALAGQIAAKSPLVLKLLKRTLRDGADMPLANALAHEQAMIGLVLDTRDAHEGIGAFLEKRAARFTGQ

SEQ ID NO: 6198 - DNA, 771 bp, Porphyromonas gingivalis W83
  CDS (1)..(771): transl_table=11
atggaatttcacaatctgatcatccaatcgaaagatggtatcacgacgctgaccatcaacaaaccggagacactgaacgccctctcctctgaagtcctttccgaattgaagtcggccattgccgttatcgctacagaaaagcctcgagtgctgatcattaccggaagcggcaaagcatttgtcgcaggagcagacatagccgagatgcaacatctgagtgcagccgagggaaaagcctttggagggcttggagcagaggtattccgaaggatagaagaattgcctttccctgttattgcagccatcaatggctttgctttgggaggcggatgcgaattggccatggcttgtgacatccgcatagcttcggctaaagccaagtttggtcagcccgaagtcggattgggcatcacccccggattctccggtacacagcgcttgccacgccttgtcgctccgggtatagccaaagaactcatctacacggggcgtatcatcgatgcagaagaagcacttcgtattggtcttgtcaatcgggtaacaactccggaggaattattacctgccacgatggaaacggctcaactcattgcatcacgctcagcttctgccgtatcagcttcaaaagaggctatcaatcgtggtacggagatgcatattgccgaaggcattgctttggaacagaatctcttcggactgtgctttgccacagccgaccagaaggaaggcatggcagctttcctcgaaaaacgtaaaccggctttctgctga

SEQ ID NO: 6199 - protein, 256 aa, Porphyromonas gingivalis W83
MEFHNLIIQSKDGITTLTINKPETLNALSSEVLSELKSAIAVIATEKPRVLIITGSGKAFVAGADIAEMQHLSAAEGKAFGGLGAEVFRRIEELPFPVIAAINGFALGGGCELAMACDIRIASAKAKFGQPEVGLGITPGFSGTQRLPRLVAPGIAKELIYTGRIIDAEEALRIGLVNRVTTPEELLPATMETAQLIASRSASAVSASKEAINRGTEMHIAEGIALEQNLFGLCFATADQKEGMAAFLEKRKPAFC

SEQ ID NO: 6200 - DNA, 777 bp, Rhodopseudomonas palustris CGA009; identical to SEQ ID NO: 2628
  CDS (1)..(777): transl_table=11

SEQ ID NO: 6201 - protein, 258 aa, Rhodopseudomonas palustris CGA009; identical to SEQ ID NO: 2629

SEQ ID NO: 6202 - DNA, 780 bp, Rhodopseudomonas palustris CGA009
  CDS (1)..(780): transl_table=11
atggcgctgcaattttccaccgtgacccgcaagggcccgatcaccatcgtcacgctgtcgcggcccgaagtgtacaacgcgctgcataccgatgcgcattacgagctcgaaggcgtgttcaacgagttcgctgccgatcccgagcagtgggtggcgatcgtcaccggcgccggcgacaaggcgttctgcgccggcaacgatctgaagtggcaggcgagcggcggcaagcgcggctggggcgagagcggcttcggcggcctgacctcgcggttcgattgcgacaagccgattatcgctgccgtcaacggcgtcgcgatgggcggcggtttcgagatcgcgcttgcctgcgacctgatcatcgctgcggagaacgcaaccttcgcgctgccggagccgcgcgtcggcctcgcggcgctggccggcggcctgcaccgcctcccccgccagatcgggctgaagcgcgcgatgggcatgatcctcaccgcccgccacgtcaaggcgcaggaaggctatgagctcggcttcgtcaacgaagtcgtgccgcaaggcgaggcgctcgccgcggcggaacgctgggccgaaaccatctgcaccgtctcaccaatgtcgatccgcgcctcgaagcagacgctgtcgcgcggcctcgaagtgtcattgccgcaagcgatcgccgagcagcgcgactacccggcggtgaaggcgatggtggcgtcacaggactacattgaaggcccgaaggcattctcggaaaagcgcgcgccgaactggcagggcaagtag

SEQ ID NO: 6203 - protein, 259 aa, Rhodopseudomonas palustris CGA009
MALQFSTVTRKGPITIVTLSRPEVYNALHTDAHYELEGVFNEFAADPEQWVAIVTGAGDKAFCAGNDLKWQASGGKRGWGESGFGGLTSRFDCDKPIIAAVNGVAMGGGFEIALACDLIIAAENATFALPEPRVGLAALAGGLHRLPRQIGLKRAMGMILTARHVKAQEGYELGFVNEVVPQGEALAAAERWAETICTVSPMSIRASKQTLSRGLEVSLPQAIAEQRDYPAVKAMVASQDYIEGPKAFSEKRAPNWQGK

SEQ ID NO: 6204 - DNA, 783 bp, Geobacter sulfurreducens PCA
  CDS (1)..(783): transl_table=11
atgaacggataccatctgctgctggagatcagcgaaggaatcgccgccatcacgatcaacagaccgagcgccatgaacgccatgactcccgcaaccctggacgagctggccgaggcggtccggcgggtgaacggcgcccccgaggtccgggccgcgatcctgaccggcgccgggaccaaggccttcatggcgggcgccgacatcgccgccatgcgggacatgacaccggcccaggcgcgggatctggcccggcaggcccaccagatctatgccgacatcgaacggtctcccaagaccttcatcgcggcggtcaacggctacgccctgggcggcgggtgcgaactggccatggcctgcgacatccggctcgcctcggagaacgcgaaattcggccaaccggagatcaacatcggcatcatccccggcttcgggggcacccagcggcttccccggctggtgggcaaagggcgggccctggagatgatccttaccggcgagatgattgacgcccgggaggcccaccgcatcggactggtgaaccgggtggtgacccaggaagaactgccggaggaggcccggcggctggcccgcgccattgccgccaagggcatggttgccgtgggactctgcaaggaagcggtaaacaacggcctgaacatggaactgaccaaggcatgcgcctacgaggccgagctctttgcccacagcttctccacggcggaccagaaggaaggtatgagcgcctttctggagaagcgccccgccgtgtttcgcgactgctga

SEQ ID NO: 6205 - protein, 260 aa, Geobacter sulfurreducens PCA
MNGYHLLLEISEGIAAITINRPSAMNAMTPATLDELAEAVRRVNGAPEVRAAILTGAGTKAFMAGADIAAMRDMTPAQARDLARQAHQIYADIERSPKTFIAAVNGYALGGGCELAMACDIRLASENAKFGQPEINIGIIPGFGGTQRLPRLVGKGRALEMILTGEMIDAREAHRIGLVNRVVTQEELPEEARRLARAIAAKGMVAVGLCKEAVNNGLNMELTKACAYEAELFAHSFSTADQKEGMSAFLEKRPAVFRDC

SEQ ID NO: 6206 - DNA, 792 bp, Mycobacterium avium subsp. paratuberculosis K-10
  CDS (1)..(792): transl_table=11
gtgaccgacgcgccgggggccctggccgaacgccggggcaacgtgatggtgataaccatcaaccggccggaagcccgcaacgcgatcaacgccgcggtcagcatcggcgtcggggatgcgctcgaagaggcgcaacacgaccccgaggtgcgggcggtggtgctcaccggcgcgggcgacaagtcgttctgcgccggggccgacctcaaggccatcgcgcggcgggagaacctgtatcaccccgaccatcccgaatggggcttcgccggctacgtgcgtcacttcatcgacaagcccaccatcgcggcggtcaacggcaccgccctgggcgggggcaccgagctggcgctggccagcgacctggtggtggccgacgagcgggcccagttcgggctgccggaggtcaagcgcggcctgatcgccgccgccggtggggtgttccggatcgccgagcagttaccccgcaaggtggcgatgcggctgctgctgaccggcgagccgctgtccgcggccgctgcccgcgactggggcctgatcaacgaggtggtcgaggccggctcggtgctggacgcggcgctggcgctggcctcggcgatcaccgtgaacgccccgctgtcggtgcaggccagcaagcggatcgcctacggcgtcgacgacggcgtggtggtcggcgacgaacccggctgggaccgcaccatgcgcgagatgcgggccctgctcaaatcggaggacgccaaggagggcccgcgggcgttcgccgagaagcgggagccggtctggcaggcgcgctga

SEQ ID NO: 6207 - protein, 263 aa, Mycobacterium avium subsp. paratuberculosis K-10
MTDAPGALAERRGNVMVITINRPEARNAINAAVSIGVGDALEEAQHDPEVRAVVLTGAGDKSFCAGADLKAIARRENLYHPDHPEWGFAGYVRHFIDKPTIAAVNGTALGGGTELALASDLVVADERAQFGLPEVKRGLIAAAGGVFRIAEQLPRKVAMRLLLTGEPLSAAAARDWGLINEVVEAGSVLDAALALASAITVNAPLSVQASKRIAYGVDDGVVVGDEPGWDRTMREMRALLKSEDAKEGPRAFAEKREPVWQAR

SEQ ID NO: 6208 - DNA, 795 bp, Mycobacterium avium subsp. paratuberculosis K-10
  CDS (1)..(795): transl_table=11
gtgcggcacgtgagcactgggaacgaagaagccggcgaacccgaggtcctggtcgaacaacgggatcggatcctcatcatcacgatcaaccggccgaaggccaagaacgcggtcaacgccgcggtggccaacggactggccgccgccgtcgaccggctggacaacgagcccggtctgtcggtcggcgtcctgaccggggccggcggctccttctgcgcgggtatggatctgaaggccttcgcccgcggcgagctgcccatcgtcgagggccgcggcatgggtttcaccgaacgcccgccggccaagccgctgatcgcggcggtcgagggttacgcgctggccggcggcaccgagctggcgctggccaccgacctgatcgtcgcctccaaggacgcggccttcggcattccggaagtcaagcgcggcctggtcgccgggggcggcgggctgctgcggctgccgcagcgcatcccgtccgcgatcgccatggagctggcgctgaccggtgacaacctcagcgccgagcgggcgcacgcgctcggcatggtcaacgtgctggccgagccgggtgccgcgctggacgaggcgatcgcgctggccgagaagatcgcggcgaacgggccgctggcggtggccgccaccaagcggatcatcgtcgagtcccgcggctggagcccggagaccatgttcgccgagcagaacaagctgctggcccccgtgttctcctccaacgacgccaaggaaggcgccatcgcgttcgccgagaagcggccccccaagtggacgggcacctga

SEQ ID NO: 6209 - protein, 264 aa, Mycobacterium avium subsp. paratuberculosis K-10
MRHVSTGNEEAGEPEVLVEQRDRILIITINRPKAKNAVNAAVANGLAAAVDRLDNEPGLSVGVLTGAGGSFCAGMDLKAFARGELPIVEGRGMGFTERPPAKPLIAAVEGYALAGGTELALATDLIVASKDAAFGIPEVKRGLVAGGGGLLRLPQRIPSAIAMELALTGDNLSAERAHALGMVNVLAEPGAALDEAIALAEKIAANGPLAVAATKRIIVESRGWSPETMFAEQNKLLAPVFSSNDAKEGAIAFAEKRPPKWTGT

SEQ ID NO: 6210 - DNA, 798 bp, Bdellovibrio bacteriovorus HD100
  CDS (1)..(798): transl_table=11
atggcaagcaattataaaacaattcttcttgaacaaaaaacacacggggtttgggttctgacgatcaaccgtccagaatctttgaacgccctgaactccaccgtgctgaacgaaatgggtgaagcccttcgtcagatcggtgaaatggactattccgatgcgcgcgctttgattatcacgggtgctggtgaaaaagctttcgtggcgggtgccgacatcaaggaaatccatgatctggacgaagaaaaggcgctggtctttgctcagcgtggccagagcatcttccatgaactgacgcttttgaaaatcccggtgatcgctgcggtgaacggctttgccctggggggcggctgtgaactggcgctgggttgtgatttcatctatgccgctgaaaatgcgaaattcggtttgccggaagtttctttgggattgatcccaggcttcggtggcacggttcgtatggcgcgcgcggtgggttcccgtcgtgcccgtgagttgacttataccggtggcatgatcaccgcggcagaagctttgtctgcaggtctggtgaacaaagtcgttcctcaagcggaactgatgaacactgtgatgaaaactgttgaggctattttggccaaagcgccgattgccgtgggttctgcgaagttctccatcaatcaggcttgggacatggacgttgaagaagcgcagaaaaatgaagcaagaatctttgcggaacttttcacttctgaagatgttaaagaaggcacgggtgccttcatcgagaaacgcaaagctgaatttaaaggtcgataa

SEQ ID NO: 6211 - protein, 265 aa, Bdellovibrio bacteriovorus HD100
MASNYKTILLEQKTHGVWVLTINRPESLNALNSTVLNEMGEALRQIGEMDYSDARALIITGAGEKAFVAGADIKEIHDLDEEKALVFAQRGQSIFHELTLLKIPVIAAVNGFALGGGCELALGCDFIYAAENAKFGLPEVSLGLIPGFGGTVRMARAVGSRRARELTYTGGMITAAEALSAGLVNKVVPQAELMNTVMKTVEAILAKAPIAVGSAKFSINQAWDMDVEEAQKNEARIFAELFTSEDVKEGTGAFIEKRKAEFKGR

SEQ ID NO: 6212 - DNA, 888 bp, Strongylocentrotus purpuratus
  CDS (1)..(888)
atgtctgctcttcgtcaagttttcacctctgcaagccgggctttcctggtatccagcgccagaaactctccagtagctccttctgttacaagatgtcttgcaacaggagcctatgagaacatcatcgtcgaccatgttggtgaaaagaagaatgttggtttgatcaagttaaaccgacccaaggcactgaacgctcttaaagatgatctgatgaatgaattggcactggctttagatgtttttgaggctgataaaaatgtaggtgccattgtggtgacggggagtgagaaagcatttgcagctggagctgatatcaaggagatgtcaggcttgacgtttcaggagacgctgggcgcaaacttcttagaatcttggagcagactctcaaaatccaagaaacccaccattgcagctgtcaatggctttgctcttggaggaggatgtgaggttgccatgatgtgtgacatcatctatgcaggagagaaggcatcgtttggtcagccggaaattctccttggtctcatcccaggtgctggtggaacccagaggttacccagggctgtagggaagtctctggctatggagatggttctttctggtgataggatcacagctcagcaagctctacaagcaggacttgtcagcaagatctaccctgtcgaggagctactggagaaggccatcgcgctgggtgagaagatcagtaagaactctaagctcatcaactctctttgcaaggaggccgtcaacacgagctacgaactcacactcaatgaaggcatgcactttgagaagaggctcttccacgcttgctttggaacggaggatgcaagggaaggaatgggggcatttgtaggaaagagagccgctgacttcaaggacaactga

SEQ ID NO: 6213 - protein, 295 aa, Strongylocentrotus purpuratus
MSALRQVFTSASRAFLVSSARNSPVAPSVTRCLATGAYENIIVDHVGEKKNVGLIKLNRPKALNALKDDLMNELALALDVFEADKNVGAIVVTGSEKAFAAGADIKEMSGLTFQETLGANFLESWSRLSKSKKPTIAAVNGFALGGGCEVAMMCDIIYAGEKASFGQPEILLGLIPGAGGTQRLPRAVGKSLAMEMVLSGDRITAQQALQAGLVSKIYPVEELLEKAIALGEKISKNSKLINSLCKEAVNTSYELTLNEGMHFEKRLFHACFGTEDAREGMGAFVGKRAADFKDN

SEQ ID NO: 6214 - DNA, 876 bp, Magnaporthe grisea 70-15
  CDS (1)..(876)
atgaacgccttcagagctcttcggccagtcgcctcaaaaatacaggcacctaccctgccgcgaatcaccaggggatttgcagcttcttccaggctgggatatgagcacattcaggtctcggagcccaggccaggtgttggtcaagtcacgctcaacaggccaaaggcgctcaacgccctcagcaccccactgatcaaggagcttaatacggcgctgggcgactaccaaaagtcagatagcatatcggttattgtaatcacgggctctcagaaggccttcgcagcaggtgccgacatcaaggagatggcacctctgacattctccaaggcctacaccgagtcattcatcgagaactggtcagacctgaccactcaggtcaaaaagcccatcattgcagccgtttccggtcacgcgcttggtggcggctgcgagctggcccttatgtgcgactttatctactgcaccgaatcggccaactttggccagcctgagatcaaactgggcgtcattcccggcgccggcggcagtcagcgcctcaccaaggcagttggaaaggctcgtgccatggagctgatcctcacgggcaagtccatgactggcgctgaggccgcacggtggggtgttgctgccaggtcgtttgcgacgtacgaggagctgatggaggccacgctcaagacggccgagacgatcgcaagctactcaaaggtcgctgtccaggcgtgcaaagaggttgtcaacaagagccaggatctggggctgcgcgacggcgtggaatatgagcgtagggtgttccacagtctgtttggaagccaggaccagaagattgggatgacggcttttgcggagaagaagaagcccgaatggactcatcagtaa

SEQ ID NO: 6215 - protein, 291 aa, Magnaporthe grisea 70-15
MNAFRALRPVASKIQAPTLPRITRGFAASSRLGYEHIQVSEPRPGVGQVTLNRPKALNALSTPLIKELNTALGDYQKSDSISVIVITGSQKAFAAGADIKEMAPLTFSKAYTESFIENWSDLTTQVKKPIIAAVSGHALGGGCELALMCDFIYCTESANFGQPEIKLGVIPGAGGSQRLTKAVGKARAMELILTGKSMTGAEAARWGVAARSFATYEELMEATLKTAETIASYSKVAVQACKEVVNKSQDLGLRDGVEYERRVFHSLFGSQDQKIGMTAFAEKKKPEWTHQ

SEQ ID NO: 6216 - DNA, 798 bp, Magnaporthe grisea 70-15
  CDS (1)..(798)
atgacaatcacggaagcagatctggtgctgagcggcacacctagtcccggagttctagtcctgcagttgaatcggccagacaagaggaatgctctttcgcagagtcttatcaatcaattgctgggcaaacttcgtgatgcatcggtagacgaaacggtcaaggcggtcgtggtgacaggcagtgcgactttcttttgcgctggtgccgatatcaaggagatatcggctcttgacggagagggcgcgagaaagtgcaggtatctcgaggatctgtgccatggattttcgtcgtttaggaaacccatttttgctgccgtggaagggatggctctcggcggggggttcgaagttgctctcgcttgcgatctgatctttgcttctgaaagcgcaaattttgggctcccagaggttaagatcggcttgattccaggggccggtggcacccaacgcttgacaaactccatgggaaagtacctggcgatgcgcatgatattgtttggagcaacaatcacgagccaagaagcactccatcacggcttggtcgcagagatcttccctgctggatcggtgctggagggcgccgttgccaaggccgcacaggttgctggcctcagctccacggcggtgcaattggccaaagaggccatctgccggagcgataacctgggcagggacgacgagttcgagcgaagtttgtactatttctcgtacgggacggcgcacaagcgggagggcattgctgcctttcttgagaagcgcgcccctgactggcgtgaggcccctcagggttcaccctag

SEQ ID NO: 6217 - protein, 265 aa, Magnaporthe grisea 70-15
MTITEADLVLSGTPSPGVLVLQLNRPDKRNALSQSLINQLLGKLRDASVDETVKAVVVTGSATFFCAGADIKEISALDGEGARKCRYLEDLCHGFSSFRKPIFAAVEGMALGGGFEVALACDLIFASESANFGLPEVKIGLIPGAGGTQRLTNSMGKYLAMRMILFGATITSQEALHHGLVAEIFPAGSVLEGAVAKAAQVAGLSSTAVQLAKEAICRSDNLGRDDEFERSLYYFSYGTAHKREGIAAFLEKRAPDWREAPQGSP

SEQ ID NO: 6218 - DNA, 906 bp, Nasonia vitripennis
  CDS (1)..(906)
atggtattcctggtgcgtcgcgtgagcgtcagcctgctgaaggcggcctcggtgtccgtgcgagctctgtccaccaaagtccagctgaaggaggacagcagtcccgggaaggagatcgtcctgaagtacctggacggcaaggacaacggaatcgcggttctcggcctcaaccgacccgaggctcgcaacgccttcggcaagaacctcgtgagtcagctgtcggacgccgtgtcgacgatcgagcaggacaagaaagtccgcgtgctgattctgcgcagccttgtgcccaaggtcttctgcgccggagctgatctgcgagagcgcagcaagatggagccccaggaggtggctaatttcgtcagctcgctgagggacctcatgcgcgatctcgaggccctctcggcccccgtcatctcggctctcgacggagtggctcttggaggcggactggagatggctctggccagtgacatcaggacagcctcggtcgaggcgaagatgggcctcgtcgagacgaagctggctatcattcccggagccggtggtacccagagactgcccaggatcgtcggacccgctttagccaaagagctcatctacaccgcgagaattttggacggcatcgaggcgcacaaaatcggtctggtgaaccgcgtcgtggcgcagaacaaggagggagacgccgcctatcaggccgctcttcacatcgccagagagatcctgccgaatgggccgatcggtgtcaaactggccaaggtggcgatttcaaagggtatcgaagtatcgatagatgacggctttgagatcgagaaacaatgctacgctcagcttttggatacggaagacaggatcgaaggcttggcagctttcgcctcgaaacgtgtacccgtttaccgagggctgtga

SEQ ID NO: 6219 - protein, 301 aa, Nasonia vitripennis
MVFLVRRVSVSLLKAASVSVRALSTKVQLKEDSSPGKEIVLKYLDGKDNGIAVLGLNRPEARNAFGKNLVSQLSDAVSTIEQDKKVRVLILRSLVPKVFCAGADLRERSKMEPQEVANFVSSLRDLMRDLEALSAPVISALDGVALGGGLEMALASDIRTASVEAKMGLVETKLAIIPGAGGTQRLPRIVGPALAKELIYTARILDGIEAHKIGLVNRVVAQNKEGDAAYQAALHIAREILPNGPIGVKLAKVAISKGIEVSIDDGFEIEKQCYAQLLDTEDRIEGLAAFASKRVPVYRGL

SEQ ID NO: 6220 - DNA, 900 bp, Anopheles gambiae str. PEST
  CDS (1)..(900)
atggcaaacattggacgtctgcttgcttcccgtgtggcgggtcagctggtgcgcaatgtcgccaccaaccagcagcagcagcaagccaacctgctccgtttctatagcagcgccccgaaagcgtacgagttcatcaaggcggagctggcgggcgagaagaagaatgtcgccgtgatcacgctgaaccgcccgaaagcgctgaacgcactgtgcaatgggctggtggcggagattagcgacgcgctggaccggtacgaggcggacgattcgatcggtgcgatcgtgatcacgggcagcgagaaggcgttcgcggccggcgccgacatcaaggagatgcagccgaacacgtacgccaagtgcatcaacaccgacttcctggccaactggacgcgggtggccaaggcacagaagccggtcattgcggcggtgaacgggtacgcactgggcggtggctgcgagctggcgatgatgtgcgatatcatctacgcgggcgataaggcacggtttgggcagccggaaattgcgctcggaacgatccccggggcgggcggttcgcagcgtacgacccgcgcgatgggcaaatcgaaggcgatggagatgtgcctgacagggaacatgatcacggccgaggaagcggaacgatcggggctagtgagcaaggtattcccggccgaaaagctggtcgaggaggcggtcaagctgggcgagaagatttccaccttctcgccgctgatcgtgcggctgtgcaaggaggcagtcaacgcgtcgtacgagatgtcgctcaacgaggggctgcgcttcgagcggcgccacttccacgcgaccttctcgaccaaggatcggctggagggtatgacggcgttcgtggagaagcgtgcgccaaagttctcgaacgaatag

SEQ ID NO: 6221 - protein, 299 aa, Anopheles gambiae str. PEST
MANIGRLLASRVAGQLVRNVATNQQQQQANLLRFYSSAPKAYEFIKAELAGEKKNVAVITLNRPKALNALCNGLVAEISDALDRYEADDSIGAIVITGSEKAFAAGADIKEMQPNTYAKCINTDFLANWTRVAKAQKPVIAAVNGYALGGGCELAMMCDIIYAGDKARFGQPEIALGTIPGAGGSQRTTRAMGKSKAMEMCLTGNMITAEEAERSGLVSKVFPAEKLVEEAVKLGEKISTFSPLIVRLCKEAVNASYEMSLNEGLRFERRHFHATFSTKDRLEGMTAFVEKRAPKFSNE

SEQ ID NO: 6222 - DNA, 1050 bp, Magnaporthe grisea 70-15
  CDS (1)..(1050)
atgccgccagtctcaaggatactgtcgtacgccccaagggtagccatacgaccatcgagtcaattggcccgtcctgcccgcgcctttgcggtcggcactgttcgctactactcagccgagcaacccgaggagccccttatccgcgtgacggatctccccgcgcccaacagcggccacattcgagtcctcgagttgaatcgaccaaaagcacgcaatgccatctctcgcgcgctcctagcttctctaagggaagaggtccactcgattgcccggcaatacgatgctcaaaccggtgaggagatcccgacgccgtcgtggaacaagaggtttggcgggatagcaggcgacagcgaaaagggcccgacgcgcgctctggtgctcgccagtgcagtggagagcagcttttgcgctggtgctgatctcaaggagcggaggggtttcacgcaagaggagaccaacgagttcctcgccaatttacgctctacctttgccgctctcgacgctctaccaattcccaccatctccgctatatcgtcccgcgcccttggcggcggactcgaacttgccctatgcacacactttcgagtcctcacctccaacgccatcgtgtccctgcccgagactcgcctcggaatcatccccggagcgggcggcactcacaggctaccccgcctcatcggcctcggtcgggcccgcgacatgattgtgacgggccgggccgtgtcgggcgccgaagcctacttcctgggcctagccgaccgattggtcgaggtgctcccgcccgacgagcaggaggccgcagacaccacggacaaggatgcggcgctgctaagtgccgcccgcgaggctgccttgaccgaggccgtgcgcctcgcctcgcagatctgcgagggtggaccgatcgggatcagggccgccctgcaggcggtgcaggcgccgtcccaagagactgagaacaaaatgtacgagagggtgattgggaccgaggaccggaacgaggcgctcaaggcgtttgcggagaagagaaagcctgtgttcaaggggaggtaa

SEQ ID NO: 6223 - protein, 349 aa, Magnaporthe grisea 70-15
MPPVSRILSYAPRVAIRPSSQLARPARAFAVGTVRYYSAEQPEEPLIRVTDLPAPNSGHIRVLELNRPKARNAISRALLASLREEVHSIARQYDAQTGEEIPTPSWNKRFGGIAGDSEKGPTRALVLASAVESSFCAGADLKERRGFTQEETNEFLANLRSTFAALDALPIPTISAISSRALGGGLELALCTHFRVLTSNAIVSLPETRLGIIPGAGGTHRLPRLIGLGRARDMIVTGRAVSGAEAYFLGLADRLVEVLPPDEQEAADTTDKDAALLSAAREAALTEAVRLASQICEGGPIGIRAALQAVQAPSQETENKMYERVIGTEDRNEALKAFAEKRKPVFKGR

SEQ ID NO: 6224 - DNA, 777 bp, Gibberella zeae PH-1; identical to SEQ ID NO: 2636
  CDS (1)..(777)

SEQ ID NO: 6225 - protein, 258 aa, Gibberella zeae PH-1; identical to SEQ ID NO: 2637

SEQ ID NO: 6226 - DNA, 873 bp, Gibberella zeae PH-1
  CDS (1)..(873)
atggcgcaacacaccttcaacagacaaccaccaccacaaacctatggccttgtgtcattcccagcccagcatgtcatgcttgtggtctttaacagacccaaagctctcaattccatgaccagcgacggagaatatgagctggaagccctttgggagtggtacgacaacgagccctccctccgatgcgccatagtgacaggtgccgggcgtgcattctgcgcaggcatggacctcaaggaatggaaccagatcaaccagcgcaaaagagatggcatacccgagaagcgaccgatggacccgcccacgacgggatttggcggcctctcgcgtaggagcggaaagaagcccatcatcgctgctgtcaatggcttggccatgggaggcggattcgagatgattgccaacctcgacctcatcgtcgctgcgaaaagcgctgtctttgccctaccagaggccaagattggtgtcgtcgctaatgcgggttccctgccgagactagccaggaccattggccgtcacagagcgactgagatggccctgacgggacggagcatcagcactacagaagcccgcgagtttggcatcctcaacgctataaccgaagacgctccagcggactgcgacgtgctggagcgtcccgtggtgaagaaagcccttgagtacgcggcagccatcatcagcaacagtcccgacagcgtgattgcgtctcgggctggtatccttgctggctgggaacatgggagcgccgagaatgcagtgcgcgtgcatcgtcagacgtgggactctgtcatggcggatggacacaatttccatgagggcgtgcaggcctttgtggagaagaggagcccgagatgggtggacagcaagttatga

SEQ ID NO: 6227 - protein, 290 aa, Gibberella zeae PH-1
MAQHTFNRQPPPQTYGLVSFPAQHVMLVVFNRPKALNSMTSDGEYELEALWEWYDNEPSLRCAIVTGAGRAFCAGMDLKEWNQINQRKRDGIPEKRPMDPPTTGFGGLSRRSGKKPIIAAVNGLAMGGGFEMIANLDLIVAAKSAVFALPEAKIGVVANAGSLPRLARTIGRHRATEMALTGRSISTTEAREFGILNAITEDAPADCDVLERPVVKKALEYAAAIISNSPDSVIASRAGILAGWEHGSAENAVRVHRQTWDSVMADGHNFHEGVQAFVEKRSPRWVDSKL

SEQ ID NO: 6228 - DNA, 825 bp, Gibberella zeae PH-1
  CDS (1)..(825)
atgacaaagacacttacacccccagaggtccccaatgtggttctctcataccccgagcctcatatccttcttgttaggctcaatcggccggagcatctcaatgcgatgcagcgacagatgagctttgatcttgatcgtctctggaaatggtacgacaacgagccctcactacgatgcgccgtcatcacaggcactggtcgggcattctgtgccggagcagacttgaaagaatggaacgtcaagaacagcgaaagcagcacaaccaacttggacaagtgggcagacaacggtttcggaggtttgagtaacagacgaggcaagaagcccgtcatcgcggcagtcaacggtctctgtctaggtggtggaatggaaatgatacttaacctcgacatggtcattgcaagcgaaacagccaagtttggcctgcccgaagtgaagcgcggcgttgtagccatcgccggcgcgctaccacgactgattcgtaccgtgggacgtcaacgcgcatccgagattgcactgctgggacgcatgtacaccgcagagcagttcctaagctggggtgttgtgaacaaggttgtcaagctggaggaagttgtctccgaggcgctgcgatgggcggtggaaatgtctaacaattcccccgattcggttatcgtgtcgcgcgaggggttgctgggtgggtgggaagcagaagggcccaaggacagcaccaacaggattgagcatggtgtatttaagacaatggaaggcggtgacaacatgaaggagggtgtcttgagttttgtcgagaagaggagcgctgtgtggaagaacagcaagctgtag

SEQ ID NO: 6229 - protein, 274 aa, Gibberella zeae PH-1
MTKTLTPPEVPNVVLSYPEPHILLVRLNRPEHLNAMQRQMSFDLDRLWKWYDNEPSLRCAVITGTGRAFCAGADLKEWNVKNSESSTTNLDKWADNGFGGLSNRRGKKPVIAAVNGLCLGGGMEMILNLDMVIASETAKFGLPEVKRGVVAIAGALPRLIRTVGRQRASEIALLGRMYTAEQFLSWGVVNKVVKLEEVVSEALRWAVEMSNNSPDSVIVSREGLLGGWEAEGPKDSTNRIEHGVFKTMEGGDNMKEGVLSFVEKRSAVWKNSKL

SEQ ID NO: 6230 - DNA, 960 bp, Gibberella zeae PH-1
  CDS (1)..(960)
atgcgtccccgtctctctcaacccgtaacaaccctccgcgtcctccggcgttgctactcttccgccactgctgaacctctcatccgcgtaacaaacctccccgcgcctaacactggacacattcgcattctcgaattgaaccgcccctcagctcgaaatgccatctcaaaagctctcctagcaaacctacgcgccgagattgatgaattgcatagccagtatggacccaatggcgaggaattgcctcttccgcaacgctttggtggtgctgctggtgtagatgagaagggccccacgagagctgttgtcctggctagtgctgtcgacacatctttttgcgcgggcgctgatctcaaggagcgcaagggatttacccctggagaaaccgctgagtttcttacaaatcttcgcaacacctttacatcgctctccaacctccccatcccgaccatctcagccatttcctccgtcgcacttggcggcggcctcgagctcgccctctccacccacttccgagtcctcagctcgaacgcaacagtcggtcttccagagacacgcctcggcatcatccccggcgccggcggcacccatcgtctgcccgccctgatcggtctctcgcgcgcccgcgatctgatcctcaccggccgtcgagtcggagctccagaggcttacttcctcggcattgcggaccgtctggtagaagttgtgcccaaggatgagcgcgacggctctgctattctcagtgaggcgagaaaggcggctttgagcgaggctgtgagactagcgcaggaaatctgcgagggaggacctattggtgtgagagcaggacttcaggctgtcgcgtgggcgagggaagaggtggaaaataagatgtatgagcgagtcgtcaactctgaggacaggaatgaggcgctcaaggcattcggggagaagagaaagcccatcttcaccggccgataa

SEQ ID NO: 6231 - protein, 319 aa, Gibberella zeae PH-1
MRPRLSQPVTTLRVLRRCYSSATAEPLIRVTNLPAPNTGHIRILELNRPSARNAISKALLANLRAEIDELHSQYGPNGEELPLPQRFGGAAGVDEKGPTRAVVLASAVDTSFCAGADLKERKGFTPGETAEFLTNLRNTFTSLSNLPIPTISAISSVALGGGLELALSTHFRVLSSNATVGLPETRLGIIPGAGGTHRLPALIGLSRARDLILTGRRVGAPEAYFLGIADRLVEVVPKDERDGSAILSEARKAALSEAVRLAQEICEGGPIGVRAGLQAVAWAREEVENKMYERVVNSEDRNEALKAFGEKRKPIFTGR

SEQ ID NO: 6232 - DNA, 789 bp, Gibberella zeae PH-1; identical to SEQ ID NO: 2638
  CDS (1)..(789)

SEQ ID NO: 6233 - protein, 262 aa, Gibberella zeae PH-1; identical to SEQ ID NO: 2639

SEQ ID NO: 6234 - DNA, 1041 bp, Yarrowia lipolytica CLIB122; identical to SEQ ID NO: 2640
  CDS (1)..(1041)

SEQ ID NO: 6235 - protein, 346 aa, Yarrowia lipolytica CLIB122; identical to SEQ ID NO: 2641

SEQ ID NO: 6236 - DNA, 879 bp, Yarrowia lipolytica CLIB122
  CDS (1)..(879)
atgctccgaacaatctccagaacccggaccatggtccccagccgacatttgatctcatacagattcttctccgacgtgtccacgaccaagggagagacgttcactctgaccaaacactttttggatgcctccaataccgcccacattgccgtctactcgctcaaccggcccgaggccatgaactccatctccaagaagcttctggaggaatttgagacctacatcaactcgctggcagccgaaggacgtcatcagaatgtcaccaacactcgtgctctgattctgagctcggagctgcccaaggttttctgtgctggagcagatctcaaggagcgaaagacatttactgatgctgacaccgctgccttccttaacaagctcaatggcactctcgacaccatccagagcctgcacatgcccactatcactgccattcagggctttgccctcggaggaggcgctgagatctccctggccacagacttccgagttctgtctgatgtggcccaatttggtctgcccgagacccgtttggcaatcttgcctggcgctggaggaaccaagcgactccccaagctgattggatactctcgagctcttgatctggtgctcactggacgacgagtaaaggccgacgaggctctccatcttggtattgccaaccgaaccggcgagaacgccctcgagactgcccttgaaatggctaagctcatctgtgagggaggacccattgcgatcaatgcggcaaagatggctgttcgaggccagtccaaggagtgggagatcgccgcctacaacaaggtggtcaattcggaagacaagttcgaggctctgtcggcattcaaggaaaagcgaaagcccattttcaagggtcgataa

SEQ ID NO: 6237 - protein, 292 aa, Yarrowia lipolytica CLIB122
MLRTISRTRTMVPSRHLISYRFFSDVSTTKGETFTLTKHFLDASNTAHIAVYSLNRPEAMNSISKKLLEEFETYINSLAAEGRHQNVTNTRALILSSELPKVFCAGADLKERKTFTDADTAAFLNKLNGTLDTIQSLHMPTITAIQGFALGGGAEISLATDFRVLSDVAQFGLPETRLAILPGAGGTKRLPKLIGYSRALDLVLTGRRVKADEALHLGIANRTGENALETALEMAKLICEGGPIAINAAKMAVRGQSKEWEIAAYNKVVNSEDKFEALSAFKEKRKPIFKGR

SEQ ID NO: 6238 - DNA, 891 bp, Aspergillus nidulans FGSC A4
  CDS (1)..(891)
atggcccagctctcgtccatccaaagcaccaaaaccccctcaggcataacaacaattaccataaatcgccctcaccggcgcaacgccattgacggtcccactgcccagaaactcacggctgctttcctagacttcgaagccgatgcatctcagaaagtgtgtgtcttccacggcgcaaacggtaccttctgcgcggggtttgacctgcatgaggtagcgaaatacgaaccccaagctcaaagtcaagacggatccactgcaagtccgcaagacagcgcaaatgttggagacaagtacaccggccccattatgtccccgcacaaccgcgttcaaggccgcaacaccggcccaattggcccctcacgcatgataatcaccaagccggtcatcgccgcagtggctgggcatgccgttgccggtggtcttgagctctcccttcttgccgatattcgggttgtcgaagaagatgccaccttcggcgtgttttgcaggcgctttggtgtccctctcatagacggagggacagtccggcttcaggctatagttggtctgggacgtgcactcgatatgatcattaccggaaggccggttggtgcgactgaggcactgagtatggggttggcgaatcgggtcgtgcctcggggggctggggtggaagaggcgatgggaattgcgagacagatcgtgggctttccgcaggcatgtttaaacgcggatcgggcgagttgctattatgcggcgtttgaggctaagagtttcgaggatgcgttggctaacgaatttgagaagggaattcgggttctgggggatggggtgaagggggcgaggagattcagggatggggaagggagacatgggaggtttgacgatgggggtaagggaatgctttga

SEQ ID NO: 6239 - protein, 296 aa, Aspergillus nidulans FGSC A4
MAQLSSIQSTKTPSGITTITINRPHRRNAIDGPTAQKLTAAFLDFEADASQKVCVFHGANGTFCAGFDLHEVAKYEPQAQSQDGSTASPQDSANVGDKYTGPIMSPHNRVQGRNTGPIGPSRMIITKPVIAAVAGHAVAGGLELSLLADIRVVEEDATFGVFCRRFGVPLIDGGTVRLQAIVGLGRALDMIITGRPVGATEALSMGLANRVVPRGAGVEEAMGIARQIVGFPQACLNADRASCYYAAFEAKSFEDALANEFEKGIRVLGDGVKGARRFRDGEGRHGRFDDGGKGML

SEQ ID NO: 6240 - DNA, 843 bp, Aspergillus nidulans FGSC A4
  CDS (1)..(843)
atggcctcaaactactcgcccaaatactttaatatcaatttcccacaagaatatgtcgcccacgtcgagatcaaccggccgaaccagctaaatgcgttcttcgaggccatgtggctcgaactcggccaactcttcgcccagctctctactgaccccgccgttcgcgcaatagtcatctccggcgctggcactaaagcattcacagccggcctcgatgtaaaagccgcgtcgcagggcctcctatcatcagactccaaggccagtgaccccgcgcgcaaggctgtgcacctccgccgcgaagtcggctcgttccaagattgcgtctcatccattgagaaatgcgagaagcccgtcatcgtcgccatgcatggtttctcactcggtctggcgattgacctctcctctgctgcggatgtgcgcttctgtgcgaaagatacgcgcttcgcggttaaagaagtggatattgggcttgcggcggacgtgggtacactaagccgactgcccaagatcgtgggtaactatggctgggtaaaggatgttgcgctgtcagcgaggttgttcggggcagaggaggcactgagcgttggctttgttagtcgtgtatttgaaacgaaggaggaggctgttaagggggcgattgagcttgcggctcttattgcaagtaagagccctgtggcggtgcaagggacgaaagagctgttgaattggtcgagggatcatacggtgcaggatggtctccgatacacagcggtatggaacagtgccgcgctgcagaccagcgacgtccaatcggcattactgtcgggtatccaaaaacggaagccaacttttgagaaactgtag

SEQ ID NO: 6241 - protein, 280 aa, Aspergillus nidulans FGSC A4
MASNYSPKYFNINFPQEYVAHVEINRPNQLNAFFEAMWLELGQLFAQLSTDPAVRAIVISGAGTKAFTAGLDVKAASQGLLSSDSKASDPARKAVHLRREVGSFQDCVSSIEKCEKPVIVAMHGFSLGLAIDLSSAADVRFCAKDTRFAVKEVDIGLAADVGTLSRLPKIVGNYGWVKDVALSARLFGAEEALSVGFVSRVFETKEEAVKGAIELAALIASKSPVAVQGTKELLNWSRDHTVQDGLRYTAVWNSAALQTSDVQSALLSGIQKRKPTFEKL

SEQ ID NO: 6242 - DNA, 918 bp, Aspergillus nidulans FGSC A4
  CDS (1)..(918)
atgcctcctcgtcttacgcgtctggcgcttccaattcgagcttcgccgaccgtctcgctgcgtgtgaaggtcgcgagatacagcaccagtcccgacgatgccgtgattcagactcaatacgtccctgcgcctggatctggaaatattcgcgtccttctcctgaacagaccgaatgctcgaaatgcactgtccaaaaaccttctgacctcgttagctcagcatgtcaattcgatctctgccgagggtggtaacgggccgactagagctttggtcatcggtagcaatgctgactccgccttttgcgcgggagctgatcttaaggagcgactgcatatgacaaaggatgaaacaaacgcattcttggccaagctgagaggcacattccgcgaccttgctgctcttccggtccctaccatctctgctgtatcttccctagccctgggtggcggtctcgagctcgccctttgcacgcatctccgcgttttcggctccaacagcaccgtcgccctacccgagacgaagctggcgatcatccctggcgcaggcggtacttatcgccttccgtcgctgattggtgtgaaccgtgcccgggacctcatacttaccggacgccgtgtgacgggacctgaggcatactttatcgggctgtgcgatcgactggttgagatccttccggaagaggagcagaaggagggtgctgcgcgtgagaaggtactgcgtgagagcatcaagcttgctctggacatctgtgacggtggtcccattgccataaagcaggcattgaaagcagtcaacgggtatgagcagggtgaggcggcagagaacgaggcgtatgatggtgttgtcgagacggaggacaggcgcgaggctctgattgcgttcgcggagaagaggaagcctgctttccggggccgataa

SEQ ID NO: 6243 - protein, 305 aa, Aspergillus nidulans FGSC A4
MPPRLTRLALPIRASPTVSLRVKVARYSTSPDDAVIQTQYVPAPGSGNIRVLLLNRPNARNALSKNLLTSLAQHVNSISAEGGNGPTRALVIGSNADSAFCAGADLKERLHMTKDETNAFLAKLRGTFRDLAALPVPTISAVSSLALGGGLELALCTHLRVFGSNSTVALPETKLAIIPGAGGTYRLPSLIGVNRARDLILTGRRVTGPEAYFIGLCDRLVEILPEEEQKEGAAREKVLRESIKLALDICDGGPIAIKQALKAVNGYEQGEAAENEAYDGVVETEDRREALIAFAEKRKPAFRGR

SEQ ID NO: 6244 - DNA, 864 bp, Aspergillus nidulans FGSC A4
  CDS (1)..(864)
atgcctgacttccaaacgcccccaccatcctcctccatcttcacactctcctttccaacgccccacatcctcctcgtcactatatcacgagagtctcgcatgaacgcgatccccacgcaaggccacaaagacggttacgcaatttggaactggtttgacgaggagccctcgctacgggtcggcataatcacaggcgcagggagcaaggcgttctcagcgggcgcggatctgctcgagcagcttgagttcaagacgaagaatgatgatgcatcttctgcttcaggtaaagggacagaaggggtgagacgggaaccaatgccaaatggctttggcgggatctcgcagcgcagaggcaagaaacctgttattgcggctgtgaacggactcgcgctgggtggggggtttgagatttgcttaaattgtgatatggtcgttgcctcaccaaccgctcaattcgccctcccagaagtccaacgcggcctctatgcgggggccggcggcctcacacgtattatccgcacagtgggaatgcaggttggcacggagctcgccctgactggacgccgcattagcgcgcaggaagcaaaatccctacggcttgtgaatcgcatctctgagacaccagagaaggttctggatgatgcgatcagtctggccaacatggtggccgacgttagtcctgacgcggtgattgtctcgaggcatggattgcgggaggcctgggagtcagggtctgtggaacagggtagtcgggcgacggcggagctttatggggcgaggttgatgaagggggataatttaaggagaggactcgaggcttttaaggagaagaggaagcctaactgggttggttcgaagctttag

SEQ ID NO: 6245 - protein, 287 aa, Aspergillus nidulans FGSC A4
MPDFQTPPPSSSIFTLSFPTPHILLVTISRESRMNAIPTQGHKDGYAIWNWFDEEPSLRVGIITGAGSKAFSAGADLLEQLEFKTKNDDASSASGKGTEGVRREPMPNGFGGISQRRGKKPVIAAVNGLALGGGFEICLNCDMVVASPTAQFALPEVQRGLYAGAGGLTRIIRTVGMQVGTELALTGRRISAQEAKSLRLVNRISETPEKVLDDAISLANMVADVSPDAVIVSRHGLREAWESGSVEQGSRATAELYGARLMKGDNLRRGLEAFKEKRKPNWVGSKL

SEQ ID NO: 6246 - DNA, 723 bp, Aspergillus nidulans FGSC A4
  CDS (1)..(723)
atgcaacacccaacagtccaaggatgtctggtctcgtttcctaccccagagatcctgcttctcacactcaacaggcccgagaagcgtaattctataccgcttgctataagcgcagacatcatacggctatgggaatggttcgatgcagagcctacattacgagccgcaatcatcactggtacaggtgaatccttctgctctggagccgatcttaaagaatggaacgaactcaatgcccgcggcaccgtcaataaaatgaccgcccccggtctcgcaggccttccccgacgccgaagcgtgaagcccatcattgccgccgtaaacggatactgtctaggcggcggcttcgagatggccgtcaattgtgacattgtgatcgcgagcgagaaggcgagcttcgggctgcccgaggtgcagagagggatcgccgcggtggcaggcgctctgcctcggctggttcgattgataggcaagcagcgcgccgccgaaatagcgctcagtgggctgccgttccctgcatcgcagctggagcgctgggggttggtgaaccgggtggtggagcacgatcagctgctagccagtgcggtggaaacagcgaaagctattgcaagaaacagtccggacagcctgcgggttacattggaaggcttgcattacgggtgggagatggccagtgtggaagaggcgagtccgccctggtcgatgagtggtatcccaaactga

SEQ ID NO: 6247 - protein, 240 aa, Aspergillus nidulans FGSC A4
MQHPTVQGCLVSFPTPEILLLTLNRPEKRNSIPLAISADIIRLWEWFDAEPTLRAAIITGTGESFCSGADLKEWNELNARGTVNKMTAPGLAGLPRRRSVKPIIAAVNGYCLGGGFEMAVNCDIVIASEKASFGLPEVQRGIAAVAGALPRLVRLIGKQRAAEIALSGLPFPASQLERWGLVNRVVEHDQLLASAVETAKAIARNSPDSLRVTLEGLHYGWEMASVEEASPPWSMSGIPN

SEQ ID NO: 6248 - DNA, 825 bp, Ustilago maydis 521
  CDS (1)..(825)
atgacggcatcagcgctggcgtatctggagcctgactcttcagcagagctgactggtgtataccacctcgtactggatcggcccgaagctcgcaatgccatttcacgatctctgttgcaagatgtgctacaatgtctacaagtgcttgtttgcaagatcactcaacctaaacaagacgagcccttacctcgcgttctgatccttcgagccaacggcccatgcttttgcgcaggagcagatctcaaggagcgaagggagatgtcggaagccgaggtcattgagtttcttcaagatctgaggcatatgctcgagcaggtcgagaagctgcccattccaactcttgctgccatcgacggaccggccttaggtggtggactggagctcgctttggcgtgtgacttccggatcgcagccgaaactgtgagcaagatcggctttcctgaagtcaagcttggtatcattccgggtgcaggaggaacacagagagcccctcggatcattggcatgcaacgggccaaagagctgatttatacaggtactcagctgaacgcgacacaagccaaagacctgggcttgattgaccatgtcgctccaggatcaacgtgtctcaagctctgccaggagctggcgcagcagatgatgccttccgctcccttggcacttcgagctgcaaagatggcgatcagtatgggcgccaatgtggagctagctcgtggactcgacctcgagtgggcctgctatgagccacttctcgaaagcaaggatcgaagagaggctttggatgctttccaacagaaacgcaaaccaatcttcactggcaaatag

SEQ ID NO: 6249 - protein, 274 aa, Ustilago maydis 521
MTASALAYLEPDSSAELTGVYHLVLDRPEARNAISRSLLQDVLQCLQVLVCKITQPKQDEPLPRVLILRANGPCFCAGADLKERREMSEAEVIEFLQDLRHMLEQVEKLPIPTLAAIDGPALGGGLELALACDFRIAAETVSKIGFPEVKLGIIPGAGGTQRAPRIIGMQRAKELIYTGTQLNATQAKDLGLIDHVAPGSTCLKLCQELAQQMMPSAPLALRAAKMAISMGANVELARGLDLEWACYEPLLESKDRREALDAFQQKRKPIFTGK

SEQ ID NO: 6250 - DNA, 951 bp, Ustilago maydis 521
  CDS (1)..(951)
atgctgcgattacgacctgttgcaacgagcgcttgctccgctgcctctctactgcatcgctctgcagcatgctatcctagaagcgcgatccgctgctactctacaagcattggcccaacacagctagtgtcgctggatactttgtccgacatcgccaaaaccgagcatgggtcggcttcgccatatgatgagcacatttcggtgctgacgctcaaccgtgcgcctgccaagaatgccatctcgaaggcacttttggcggagatggatcaacacgtcacgtcgctgctcacctcgtctacggttcgaacgctgttgatccgctcttccgtgagcggaacgttctgcgccggtgcagatctcaaggagcgcaaaggaatgtcaaaagcggaagtggatgcgttcttactgggcttgcggaaagtgttcaccaatgtgtcacgattgccgatgcctacgattgcctgtctcgatggattggctatgggcggagggctggagctcgcgctcacgtgtgatctgaggattgccggacccgcagcaacgaggctgggcttgaccgagacaaagcttggcatcattcctggcgccggcggaacgagcaggttgaccagattggtgggagctgctcgtgcaaaagagctcatcttcagtgccaaactcgttgatgcggtcgaggcaagtcgaatcgggtttgtcgacattgtcgctcaggaaggtgacgatacagctgccttcaacaagggagtacagcttgcaagatcgttcgctaagaatggaccactagcggtgcgagctgctaagcttgcgatcgacaagggcgaacagatggaccctgagacggcgcttgactttgagcgccaatgctatgagacgattcttggcaccaaggatcgtctggaagggctcaaagcgtttgctgaaaagcgggagcccgagtaccgaggcgagtag

SEQ ID NO: 6251 - protein, 316 aa, Ustilago maydis 521
MLRLRPVATSACSAASLLHRSAACYPRSAIRCYSTSIGPTQLVSLDTLSDIAKTEHGSASPYDEHISVLTLNRAPAKNAISKALLAEMDQHVTSLLTSSTVRTLLIRSSVSGTFCAGADLKERKGMSKAEVDAFLLGLRKVFTNVSRLPMPTIACLDGLAMGGGLELALTCDLRIAGPAATRLGLTETKLGIIPGAGGTSRLTRLVGAARAKELIFSAKLVDAVEASRIGFVDIVAQEGDDTAAFNKGVQLARSFAKNGPLAVRAAKLAIDKGEQMDPETALDFERQCYETILGTKDRLEGLKAFAEKREPEYRGE

SEQ ID NO: 6252 - DNA, 957 bp, Ustilago maydis 521
  CDS (1)..(957)
atgacctcctctaaaatcatgatgccgaaggtgggctcacatctgatcctcaccatccctgcacgtcatgtgcttcagatgacgctcaacagacccaaacagctcaactcgatgacggatgctatggaagaggacatctgtcgtgtgttcgattggttcgagaccgagccctctctttgggttatcatccttgcgggcaagggtagagcgttttgcgccggccaagacctcaaggattggctcagcaagaatcagacttccgatactatgacgcataccacaggagagcccatgcagtctgatgcagaggttagtaaatccattcagaggctcaagcgaggtggctttgggggtatgagttcgcgaaggagcgccaagcccatcatcgccgctgttgatggtatttgcatgggaggcggcacagagaccatcctcaattgcgacatggtggtggccagtactcgatccgtaatcggcctgcctgaggtagccaggggcgttgtggctgccatgggtggtattcctcgactcacacagctatgtggtcaccaacgtgcgtcggagcttctcctcctcggcaagcctatcagtgctaaggaagctcatgaccggtacaatatggtcaaccggctcgttgatgttgcaaagtcgacatccgaggagctcggtcaggcagcagtagataaggctgctatcgatatcgccattcagctgacccagaatagtcccgatagcgtgcttgtgacaaagtctgccttagtcatggcccgcgactcgacgaacggcgacattgatgcttcggcgcgagacaacttgttgtccgacagaagtcgattgctctatgtgggcaagaacatcaacgaaggcttagaggcattcaaagggaaacgcaacccgaaatggttcaacccacttcccctggccccgccatccagccacgcgaggtcaaagctttga

SEQ ID NO: 6253 - protein, 318 aa, Ustilago maydis 521
MTSSKIMMPKVGSHLILTIPARHVLQMTLNRPKQLNSMTDAMEEDICRVFDWFETEPSLWVIILAGKGRAFCAGQDLKDWLSKNQTSDTMTHTTGEPMQSDAEVSKSIQRLKRGGFGGMSSRRSAKPIIAAVDGICMGGGTETILNCDMVVASTRSVIGLPEVARGVVAAMGGIPRLTQLCGHQRASELLLLGKPISAKEAHDRYNMVNRLVDVAKSTSEELGQAAVDKAAIDIAIQLTQNSPDSVLVTKSALVMARDSTNGDIDASARDNLLSDRSRLLYVGKNINEGLEAFKGKRNPKWFNPLPLAPPSSHARSKL

SEQ ID NO: 6254 - DNA, 969 bp, Ustilago maydis 521
  CDS (1)..(969)
atgtcaggttggacgcccatcaacccgcatcctcgcatcagcgatatcgacgtcgccaactttgactacgccacgtatccatggcaggacatcaaagtggatctgcatcccaatggtgtcgcggtgctctacctggaccgtccgtctcagtacaacacgcttaccggtccgatgtcgtactcgatcgtctttgcgtttgagctatttgacgctgacgatcgagtcaaagtggctatcatcacgggtggcggtggcaaagtattctgcgctggcgcgtacctcgcacagggtttcggtgctattgccgatcatgcacagggacaccgcgacggtggtggacagatgggattggccatcttgcgctgcagaaaaccgtcgatcgccgctatcaacggcaacgcgattggaattggtatcaccatgacgctcagctgtgatttcaggctgatcgccgaaaacgccaaggtggccattccatttgtacaacgaggcatcgccatggaggcgtgctcttcgtacctgctacccagactcgtcggtgtatccaaagccatggacatggtcctcaccggagacgtgcgctctcccaaggacgagagttacatggcgctctggacgcgttcaccgctaccgcaagaccaggtgcttcccgaatcgctcaagctagccgaaaagctcgccaaaaacagtagcgtctcaatggcactctgcaaagcgcagctatggcgacagctgaattcgcccgaagacgcgcacctcctggagagtcaggcaatctgggaaacgtccaggctggatggcctcgagggcgtcaagagctttcttgacaagagaacgcccgagttcccgggaaccatgggcgatctccaaaggtttgccttttggccgtggtggacgcaggccgatgtgtcgctctaccctcgaggtccagagtcacttcgcgccgctgcagctaagagcaagttgtaa

SEQ ID NO: 6255 - protein, 322 aa, Ustilago maydis 521
MSGWTPINPHPRISDIDVANFDYATYPWQDIKVDLHPNGVAVLYLDRPSQYNTLTGPMSYSIVFAFELFDADDRVKVAIITGGGGKVFCAGAYLAQGFGAIADHAQGHRDGGGQMGLAILRCRKPSIAAINGNAIGIGITMTLSCDFRLIAENAKVAIPFVQRGIAMEACSSYLLPRLVGVSKAMDMVLTGDVRSPKDESYMALWTRSPLPQDQVLPESLKLAEKLAKNSSVSMALCKAQLWRQLNSPEDAHLLESQAIWETSRLDGLEGVKSFLDKRTPEFPGTMGDLQRFAFWPWWTQADVSLYPRGPESLRAAAAKSKL

SEQ ID NO: 6256 - DNA, 975 bp, Ustilago maydis 521; identical to SEQ ID NO: 2642
  CDS (1)..(975)

SEQ ID NO: 6257 - protein, 324 aa, Ustilago maydis 521; identical to SEQ ID NO: 2643

SEQ ID NO: 6258 - DNA, 852 bp, Cryptococcus neoformans var. neoformans B-3501A
  CDS (1)..(852)
atgttagctcgcactctcctcaagccttcccaatctacataccgactcactatccgcgccatgtccacctctgcagaacagctcgtcatcccctctcgttctccttcgaacaacgtagccatcttgacccttaacaggcccaaggccctcaacgcgttgagcacgcccttgttcaatgctctcaacgccgagcttgagaaggccgagacagatgagagtgtgagggctatcgtcatcaccggtggtgacaaggtgtttgctgccggtgccgacatcaaggagatgaaggacaaggaatttgctgaagcatacactagcaacttccttggatcctggaaccaaatcgcctctatccgcaagcccattgtcggtgctgtcgccggctacgccctcggaggcggatgtgagctcgccatgctctgcgacatcctcgtcgcttctccgaccgccgtctttggccaacccgagatcacacttgggattattccaggtatgggcggctcccaacgccttacttccctgattggaaaggcgagggcaatggacatggtcctcactgggaggaagattgatgcggagacggctgagagatgggggttggttagcagggttacgaaagaaggagagagtgtgactgaggaagcggtgaaggtggcagagaacgtgagcaagtttggaaaggtggctgtacaggctggtaaggaggccgttaatggatctctcgaccttcccctcgagcaaggtctaaggctcgaaaggaggctcttccagcaactcttcgcgaccaaggaccagaaggaaggtatggctgcttttgccgagaagaggaagcctacttggtccgacaagtaa

SEQ ID NO: 6259 - protein, 283 aa, Cryptococcus neoformans var. neoformans B-3501A
MLARTLLKPSQSTYRLTIRAMSTSAEQLVIPSRSPSNNVAILTLNRPKALNALSTPLFNALNAELEKAETDESVRAIVITGGDKVFAAGADIKEMKDKEFAEAYTSNFLGSWNQIASIRKPIVGAVAGYALGGGCELAMLCDILVASPTAVFGQPEITLGIIPGMGGSQRLTSLIGKARAMDMVLTGRKIDAETAERWGLVSRVTKEGESVTEEAVKVAENVSKFGKVAVQAGKEAVNGSLDLPLEQGLRLERRLFQQLFATKDQKEGMAAFAEKRKPTWSDK

SEQ ID NO: 6260 - DNA, 903 bp, Cryptococcus neoformans var. neoformans B-3501A
  CDS (1)..(903)
atgctcctcccattggtcagacacgtatccaagtcactaaccaaacaacgatgcttcgccgcatggggaaggaccatatcgaccacccccgagccccacgcctaccttcgtcccctcctctcaaccaccgcagacgccaagttgcctgagcttgacaaggttatgaccctcatgctgaatcggccggctactaaaaatgcgctgactgttcaaatggtttcggagatgcgtgaagcacttgccaccttgaatcccgcagactctcgtctacttctcatacagtcttccaacccctctcttttttgttctggcgcagacttgcgtgaacgtcgtactatgagcccgatgcaggtctcgaacttccttgacaatctcagacaattgctggccgagctagaggctttaccgatcccgactgttgctgtgattgacgggtatgctttgggaggaggggcagagctggctttggggtgtgatttgagagttggcggagacaataccaagattgctttgccggagactaagcttggcattattccaggagcgggcggcactcaacgcctcacccggatcgtaggcatggccaagtctaaggaacttatatttacagggcgtcacgttcaagggcctgaagctgaacgcatcggtcttttgaacatttacgcctcttctccttcctcccctttcgaagccgcactcattttggcccgtcagatactgacatccgctcccctggctctggcagccgcaaaacgagccatttcatcagcaccggaattgtctcttgaagccggcctcgacctggaacgagcagtctataatgggctgctggatacggatgacagacaagaagggctgaaggcttttgcagagaagagaagggcagactttcgtggacggtaa

SEQ ID NO: 6261 - protein, 300 aa, Cryptococcus neoformans var. neoformans B-3501A
MLLPLVRHVSKSLTKQRCFAAWGRTISTTPEPHAYLRPLLSTTADAKLPELDKVMTLMLNRPATKNALTVQMVSEMREALATLNPADSRLLLIQSSNPSLFCSGADLRERRTMSPMQVSNFLDNLRQLLAELEALPIPTVAVIDGYALGGGAELALGCDLRVGGDNTKIALPETKLGIIPGAGGTQRLTRIVGMAKSKELIFTGRHVQGPEAERIGLLNIYASSPSSPFEAALILARQILTSAPLALAAAKRAISSAPELSLEAGLDLERAVYNGLLDTDDRQEGLKAFAEKRRADFRGR

SEQ ID NO: 6262 - DNA, 858 bp, Strongylocentrotus purpuratus
  CDS (1)..(858)
atgtcttcaggagggctttcaaaatataattttgagtcactcgctgtgacaagtccccaggagtttatctacaaggttgaggtgaacaggccagagaaacgtaatgctatgaacaaaacattttggagagagatggtagaatgttttaataccattgcaactgacgaagactgcagagtagtactattaactggggcaggcaagacattttctgctggtatcgatctacaggataatgctgaattgatgcagggtgctattccgggatcaactgatcttgatgtatcacgtatcgcctataaactcagatcgaagatcaaggagtatcaagagtctttctttgttattgagaagtgtcctaagccagtgatagcagccgtccagggggcctgtttaggaggaggactctgtatgatctctggatgtgatattaggttgtgtactgaagatgcttggttccaaattaaggaaacagaccttggtctagctgcagatgtaggagtgcttcagtggttaccaaagaagacatctaatgacagtctgcttcgagagctctgtttcacagcaaggaagtttgattcaagtgaagccaaggaattaggtctgatcagtcgcctgtacccagaccaagaagccatgatgggtagtgctatggagctagcagcaactatcgccagtaagagtccagtggctatgcagggcactaaagttaatctgaactacagccgagatcataccgtagcagaaagcttcgagtatattgcaacgtggaacgcagcccatctacagactgaggatcttgcaaaagcagtcatggcaagcatgacaaaatcaaaggcagagttttcaaagctgtga

SEQ ID NO: 6263 - protein, 285 aa, Strongylocentrotus purpuratus
MSSGGLSKYNFESLAVTSPQEFIYKVEVNRPEKRNAMNKTFWREMVECFNTIATDEDCRVVLLTGAGKTFSAGIDLQDNAELMQGAIPGSTDLDVSRIAYKLRSKIKEYQESFFVIEKCPKPVIAAVQGACLGGGLCMISGCDIRLCTEDAWFQIKETDLGLAADVGVLQWLPKKTSNDSLLRELCFTARKFDSSEAKELGLISRLYPDQEAMMGSAMELAATIASKSPVAMQGTKVNLNYSRDHTVAESFEYIATWNAAHLQTEDLAKAVMASMTKSKAEFSKL

SEQ ID NO: 6264 - DNA, 864 bp, Tribolium castaneum
  CDS (1)..(864)
atgttcgcaataagagtggcacaaaatgtgttgcgcccccaaagacgcaaactatcgcaagtcgcccaagacctgacctacacgcaactgcaaggatctgacaccggaataaccgttttcggttttaaccgccccaaacaaaagaacgccttaagtgccaacctagtaaccgaattacagaaatctctccagaaaatcacattcgacccctcggcccgcgttttaatagtgcgaagccacgtcccgggagtcttctgtgccggagcggatcttaaagaacgcgcaacgatgcctcaagcggaagtcggtaaattcgtctcaaacctgcgaagtctcatggaccagttccacaacctccctatccccgtcatagccgccttggatggagttgctttggggggaggtctggagatatccctggcttgtgacattcgggtcgcttcaagtgactgtaaaatggggctagttgagggcaaattggccataataccgggggccggaggcacccaaagactcccccggcttatcaacccctcaatcgccaaggaattgatatacacggcgcgaacaatcgacggtggtaccgcccaccgattgggtattgtcaaccacgtggtgtcacaaaacgccaatcaggacgcagcttatttgaaatcactggagttggcgcacgaaatattaccgaatggacctgtggcggtccaaatggccaaaaaggccatcaataagggggttcaagtcgacttaagttcgggattagcgatcgaggaggcgtgctatgctcagctgataccgaccaaggacaggttagagggactacaggcgttcaaggagaagcgaaaaccgaattatattggcgaatga

SEQ ID NO: 6265 - protein, 287 aa, Tribolium castaneum
MFAIRVAQNVLRPQRRKLSQVAQDLTYTQLQGSDTGITVFGFNRPKQKNALSANLVTELQKSLQKITFDPSARVLIVRSHVPGVFCAGADLKERATMPQAEVGKFVSNLRSLMDQFHNLPIPVIAALDGVALGGGLEISLACDIRVASSDCKMGLVEGKLAIIPGAGGTQRLPRLINPSIAKELIYTARTIDGGTAHRLGIVNHVVSQNANQDAAYLKSLELAHEILPNGPVAVQMAKKAINKGVQVDLSSGLAIEEACYAQLIPTKDRLEGLQAFKEKRKPNYIGE

SEQ ID NO: 6266 - DNA, 888 bp, Tribolium castaneum
  CDS (1)..(888)
atggcagcgaaaagtttggctcggtttgtggtctccagaatttccacccccgcctccaacaaggcattccttaacaaccccaacatcaaattctacagcgttcaaaaaaacttcgaatttattaaaacgcacaaagctggggcccgcaacaatgtgggggtgattactctgaaccggccaaaggcccttaatgccctttgcaacggcttgatgcaggaagttgccgacgctttggacgtgtttgagaaggacaacgacgtgggggctatcataatcaccggtagcgaaaaggcctttgctgcaggtgccgacatcaaagaaatgcaaaacaacacttattcgcaatgcgttcggggcaactttttggcccattggaaccgcgtctctgagagcgtgaagccggtgattgctgccgtcaacggctacgctctggggggcggttgcgagctggccatgatgtgcgacatcatctacgcaggcgagaatgccaagtttgggcaaccggagatcttgattgggaccattccgggggctgggggcacccagaggttgacgagggttgtggggaagtccaaggctatggagatggtgctcacgggggatcaagtgccggcgcacgaggccgagaagatgggtctggtcagtaaagtcttcccggttgagaaactgatggacgaaacggtcaaactagcggagaaaattgcgaaaaattcgcacctagttaacggaatgtgcaaggagtcggtcaatacagcgtacgaaacgacgctcagagaggggctccacttcgagaaacggatgttccacgggaccttcgctactaaagaccgcaaagaaggaatgactgcttttattgagaaacgggccccgaatttcacaaatgaataa

SEQ ID NO: 6267 - protein, 295 aa, Tribolium castaneum
MAAKSLARFVVSRISTPASNKAFLNNPNIKFYSVQKNFEFIKTHKAGARNNVGVITLNRPKALNALCNGLMQEVADALDVFEKDNDVGAIIITGSEKAFAAGADIKEMQNNTYSQCVRGNFLAHWNRVSESVKPVIAAVNGYALGGGCELAMMCDIIYAGENAKFGQPEILIGTIPGAGGTQRLTRVVGKSKAMEMVLTGDQVPAHEAEKMGLVSKVFPVEKLMDETVKLAEKIAKNSHLVNGMCKESVNTAYETTLREGLHFEKRMFHGTFATKDRKEGMTAFIEKRAPNFTNE

SEQ ID NO: 6268 - DNA, 801 bp, Mycobacterium sp. JLS
  CDS (1)..(801): transl_table=11
atgacagacaccttgacgaaccccgcggcgctcgtcgagcggcgaggcaacgtcgccctgatcaccatcaacaggcctgaggcacgaaacgccgtcaacggcgcggtcagtacggcggtcggcgacgcgctggctgcggcccaaagcgatcccgacgtgtgggcggtggtcatcaccggtgcgggggacaagtcgttctgcgccggggcggatctgaaggccgtatcgcgtggcgagaacctctaccacgccgagcacccggaatggggcttcgccgggtatgtgcaccacttcatcgacaagccgaccatcgccgcggtgaacggcactgcgctggggggtggctccgagctggcattggccagtgatctcgtcgtcgcatgcgagagcgcgagtttcgggctaccggaggtcaagcgtggactgatggcaggggccggcggggtgttccggatcgtcgagcaactgccgcgcaaggttgcactggagttgatcttcaccggggagccgatgtcctctgccgacgcgctgcgttggggcctgatcaaccaggtagcacccgacggcgccgtggtcgaggccgcgctggcgctggccgagcggatcgccgtcaacgccccgctgtcggtccaggccagcaagcgggtggcatacggcgccgacggtgacatcatcgccaccgaggaacccaagtgggaccgcaccacacgcgaattcaccgcgttgctggaatccgaagacgccaaggaaggcccgctggccttcgcgcagaaacgtcaacccgtatggaagggacgctga

SEQ ID NO: 6269 - protein, 266 aa, Mycobacterium sp. JLS
MTDTLTNPAALVERRGNVALITINRPEARNAVNGAVSTAVGDALAAAQSDPDVWAVVITGAGDKSFCAGADLKAVSRGENLYHAEHPEWGFAGYVHHFIDKPTIAAVNGTALGGGSELALASDLVVACESASFGLPEVKRGLMAGAGGVFRIVEQLPRKVALELIFTGEPMSSADALRWGLINQVAPDGAVVEAALALAERIAVNAPLSVQASKRVAYGADGDIIATEEPKWDRTTREFTALLESEDAKEGPLAFAQKRQPVWKGR

SEQ ID NO: 6270 - DNA, 792 bp, Burkholderia vietnamiensis G4
  CDS (1)..(792): transl_table=11
atgtcatatgacgcgatccagctggagttcgatcgggccgcgaacgtggccacggtcaccctcaaccgtccggacaagctgaacagcttcacgcgcgcgatgcatcgcgaattgcagtccgcgctcgatgaggtcgagaaagccggcgcccgcgcgctgatcctgaccggcgcgggccgcggcttctgcgcgggccaggaccttgccgatctcgacttcacgcccggcgcttcgaccgatctgggcgcgctgatcgacgagcatttcaatccgctgatccgtcgcctgcagcgcatgccgattccggtcatcgcggccgtgaacggcacggccgccggcgcgggcgcgaacctggcgctcgcgtgcgacctggtgttcgccgcccgctcgagcagcttcatccaggcgttcgtgaagatcggcctcgtgcccgactcgggcggcacgtggttcctgccgcagcgcatcggcatggcgcgcgcgctcggattggcactgacaggcgacaaactcggcgccgagcaggccgagcaatggggcttgatctggcgcgcggtcgacgacgatacgcttgccgcgtcggtccgtcaggtcgctaaccagctcgcccagcagccgacgctcgcgatcgcatcgatcaagcaatcgatgcgcgacagcatcagcaacacgctcgaccagcaactcgacgtcgagcgcgacctgcagcgcaagctcggccagtcgtacgactattcggaaggcgtcaaggcgttcatcgagaagcgcgcgccgcgcttcgaggggcgttga

SEQ ID NO: 6271 - protein, 263 aa, Burkholderia vietnamiensis G4
MSYDAIQLEFDRAANVATVTLNRPDKLNSFTRAMHRELQSALDEVEKAGARALILTGAGRGFCAGQDLADLDFTPGASTDLGALIDEHFNPLIRRLQRMPIPVIAAVNGTAAGAGANLALACDLVFAARSSSFIQAFVKIGLVPDSGGTWFLPQRIGMARALGLALTGDKLGAEQAEQWGLIWRAVDDDTLAASVRQVANQLAQQPTLAIASIKQSMRDSISNTLDQQLDVERDLQRKLGQSYDYSEGVKAFIEKRAPRFEGR

SEQ ID NO: 6272 - DNA, 780 bp, Bradyrhizobium sp. ORS278
  CDS (1)..(780): transl_table=11
atggagctgaaattctcgaagatcacgcgcaagggaccggtcacgatcgtgaccctggcgcgccccgaggtctacaacgcgctgcataccgacgcccattacgagctcgaagcggtgttcgacggcttcgccgccgatcccgagcaatgggtcgcgatcgtcaccggcgagggcgacaaggcgttctgcgccggcaacgacctgaaatggcaggcggccggcggcaagcgcggctggggccgaagcggcttcggcggcctgacctcgcgcttcgactgcgacaagccgctgatcgccgccgtcaacggcgtcgcgatgggcggcggcttcgagatcgcgctggcctgcgacctgatcatcgcctctgagaatgccaccttcgcgctgcccgaaccgcgtgtcggcctcgccgcgctcgccggcggcctgcagcggctgccgcgtcagatcggcatgaagcgcgcgatgggcatgatcctgaccggccgccatgtcggcgcccgcgagggccatgagctcggcttcgtcaacgaagtggtgccgcaaggcgaagcactgtcggccgcggaacgctgggccgagaccatcgccaagaactcgccgatgtcgatccgcgcctccaagcaagcgatcgagaagggcctcgcggtctcgctggagcaggccatcaccgagcagcgcgattatcccgccgtgcaggcgatgatccattcgcaggactacatcgagggtcccaaggcgttctcggagaagcgggcgccgaactggctggggcggtaa

SEQ ID NO: 6273 - protein, 259 aa, Bradyrhizobium sp. ORS278
MELKFSKITRKGPVTIVTLARPEVYNALHTDAHYELEAVFDGFAADPEQWVAIVTGEGDKAFCAGNDLKWQAAGGKRGWGRSGFGGLTSRFDCDKPLIAAVNGVAMGGGFEIALACDLIIASENATFALPEPRVGLAALAGGLQRLPRQIGMKRAMGMILTGRHVGAREGHELGFVNEVVPQGEALSAAERWAETIAKNSPMSIRASKQAIEKGLAVSLEQAITEQRDYPAVQAMIHSQDYIEGPKAFSEKRAPNWLGR

SEQ ID NO: 6274 - DNA, 780 bp, Bradyrhizobium sp. ORS278
  CDS (1)..(780): transl_table=11
atgaccaacgacagcgtgattctcgacaggcgcgggcaggccctctggatcaccatcaaccggcccgagaagcgcaacgcgctcaatggcgacgtcatcgccgggatctcgcgcggctatcgtcaggcgcatgacgatcccgaggtgcgcgtcatcgtgctgaccggagcgggtgacaaggcgttctgcgccggcgccgacctgcagaactcgggggccgccttcgcgatggatttctcgcggcccaatgtcgactatgccgatctgctcaggctgtcgcagaacgccaccaagccggcgatcgcccgcgtgggcggcgtctgcatggcgggcggcatgggcctgttgtgcatgaccgatatggcggtcgcggccgaccacgtcgtcttcggcctgccggaggtgaaggtcggcgtgttcccgatgcaggtgctgagcctgctgcagagcatcgcgccgccacgcctcgtcaacgaatgggctttgacgggggagccgtttgatgccaaggcggcgcaggccgccggcctgctgaaccacgtcgttcccgccgccgagctcgatgccaagatcgactggctgatcggccgtttggttgacaaatcgccgacagcgatccgccgcggcaaatacgcgatgcgcgcgatcgcctcgatgtcgttcgacgagtccattgcctatctcgaaagccagatcgcattgctggcgatgaccgaggatgccaaggaagggctgaaggctttcgcagaaaagcgtaagccggtctggccggggaagtag

SEQ ID NO: 6275 - protein, 259 aa, Bradyrhizobium sp. ORS278
MTNDSVILDRRGQALWITINRPEKRNALNGDVIAGISRGYRQAHDDPEVRVIVLTGAGDKAFCAGADLQNSGAAFAMDFSRPNVDYADLLRLSQNATKPAIARVGGVCMAGGMGLLCMTDMAVAADHVVFGLPEVKVGVFPMQVLSLLQSIAPPRLVNEWALTGEPFDAKAAQAAGLLNHVVPAAELDAKIDWLIGRLVDKSPTAIRRGKYAMRAIASMSFDESIAYLESQIALLAMTEDAKEGLKAFAEKRKPVWPGK

SEQ ID NO: 6276 - DNA, 768 bp, Klebsiella pneumoniae subsp. pneumoniae MGH 78578
  CDS (1)..(768): transl_table=11
atgagtgacctgctgatccaccgtcatggccgggtgcttcagttgacgctgaaccgcccgcaggcccgcaacgcgctgaacaatgccttattaacccagattgccgaggcgctggaggccgcggcagttgatgacagcgtcggcgtctgcgttattcgcggtaacgcgcgttttttcgccgccggggctgaccttaatgaaatggcggaaaaagatctgcctgccaccctggatgatattcgcccacggttatgggggcgaattgatgcctttactaaaccgctcatcgcctcggtcaacggctacgccctcggcgccggctgcgagctggccctgctgtgcgacctgattgtcgccggggacaacgcccgctttggcctgccggaaattaccctcggcataatgccgggcgcgggcggcacccagcggctgatccgcagcgttggcaaggcgctggccagccggatggtgctgagcggcgagagtattgacgcccgccaggcgcagcaggccgggctggtcagtgatatccatccggcggcgttaaccgatgagtatgccctgaaactggcaaccaccattgcccgccattcgccgctggcgctacgggcggcaaaacagtcgctgcgcctgtcgcaggaagtcagcctgcaggctggtctgcaacaggagcgccagctgtttagcctgctgagcgccaccgaggaccgccgcgaaggcatcgacgccttcttacaaaaacgtaccccggaatttaaaggacgctaa

SEQ ID NO: 6277 - protein, 255 aa, Klebsiella pneumoniae subsp. pneumoniae MGH 78578
MSDLLIHRHGRVLQLTLNRPQARNALNNALLTQIAEALEAAAVDDSVGVCVIRGNARFFAAGADLNEMAEKDLPATLDDIRPRLWGRIDAFTKPLIASVNGYALGAGCELALLCDLIVAGDNARFGLPEITLGIMPGAGGTQRLIRSVGKALASRMVLSGESIDARQAQQAGLVSDIHPAALTDEYALKLATTIARHSPLALRAAKQSLRLSQEVSLQAGLQQERQLFSLLSATEDRREGIDAFLQKRTPEFKGR

SEQ ID NO: 6278 - DNA, 783 bp, Acinetobacter sp. ADP1
  CDS (1)..(783): transl_table=11
gtggcaatggaataccactttattcaggttgaaaaacagcaacatttaacaattattactctcaatcgtcctgcaagttttaatgcattaaatgcatctgcccatgaggagttggctcaagcttttgatcaatttcaaaatgatgatgagcaatgggttgcgattgtgacgggtgtaggggaaaaagcgttttgtgcaggtcatgatttaaaacaacaagcagcaggtggtggtctggtgacaccgcaatcaggttttgcaggtttaacagcacgtttcgatttaactaaacctgtcattgctgctgtaaatggcgtcgcaatgggtggtgggtttgagctggctttagcttgcgacttaattattgcatctgaaaatgctgtttttgccttgcctgagccaagagtcggtttggctgccttggcaggtggaatgcaacgtttacctcaagtcattgggttaaaaagaagtatgggaatgttgcttacgggacgtcgggtatcggcacaagaaggattcgagctgggttttgtcaatgaagtaaccagtggacccgtactcgaagcagcgaagagatgggcaaatgaaatcttggcatgtagtccgctatcgatacgtgctaccaaacagaccgtgttaagagggttggagagttcggttgaacaagccatgcaggagcaatggcagtacaatgcgatgcaatgcatgctgaattcagaggatgtgattgaaggaccaaaagcatttgcacagaaacgcacaccagaatggaaagggcgttaa

SEQ ID NO: 6279 - protein, 260 aa, Acinetobacter sp. ADP1
MAMEYHFIQVEKQQHLTIITLNRPASFNALNASAHEELAQAFDQFQNDDEQWVAIVTGVGEKAFCAGHDLKQQAAGGGLVTPQSGFAGLTARFDLTKPVIAAVNGVAMGGGFELALACDLIIASENAVFALPEPRVGLAALAGGMQRLPQVIGLKRSMGMLLTGRRVSAQEGFELGFVNEVTSGPVLEAAKRWANEILACSPLSIRATKQTVLRGLESSVEQAMQEQWQYNAMQCMLNSEDVIEGPKAFAQKRTPEWKGR

SEQ ID NO: 6280 - DNA, 774 bp, Acinetobacter sp. ADP1; identical to SEQ ID NO: 2646
  CDS (1)..(774): transl_table=11

SEQ ID NO: 6281 - protein, 257 aa, Acinetobacter sp. ADP1; identical to SEQ ID NO: 2647

SEQ ID NO: 6282 - DNA, 777 bp, Azoarcus sp. EbN1; identical to SEQ ID NO: 2656
  CDS (1)..(777): transl_table=11

SEQ ID NO: 6283 - protein, 258 aa, Azoarcus sp. EbN1; identical to SEQ ID NO: 2657

SEQ ID NO: 6284 - DNA, 771 bp, Azoarcus sp. EbN1; identical to SEQ ID NO: 2658
  CDS (1)..(771): transl_table=11

SEQ ID NO: 6285 - protein, 256 aa, Azoarcus sp. EbN1; identical to SEQ ID NO: 2659

SEQ ID NO: 6286 - DNA, 786 bp, Silicibacter pomeroyi DSS-3
  CDS (1)..(786): transl_table=11
atgagcgacagcccagtcagaacccgccgcgacggcgccattttcgaggtcaccctggacaggcccaaggccaatgcgatcgacctggtcaccagccggatcatgggcgaggtgttccgcgaatttcgcgacgacaccgatttgcgggtggcgatcctgaccgggggcggcgagaagttcttttgccccggctgggatctgaaagcggcggccgatggcgatgcggtcgatggcgattatggcgtcggcggctttggcggcttgcaggagctgcgcgacatgaacaagccggtgatcgcggcggtgaacggcatcgcctgcggcggcgggctggaacttgcgctgtcggcggacatgatcatcgccgccgatcacgcgacctttgcgctgcccgagattcgctcgggcacagtggccgatgcggccagcgtgaaactgcccaagcgcatcccctatcacatcgcgatggagcttttgctgaccgggcgctggtttgacgcggacgaggcgcatcgctgggggctggtgaacgagatcgtgcccggcacgcagctgatggagcgcgcctgggatctggcccgcctgctggcgagcggtccgccgctggtctatgccgcgatcaaggagatcgtgcgcgaggccgaggatgccaagtttcaggacacgatgaacaagatcaccaaacggcagctgcgcacggtggatgtgctctattcctccgacgatcagctggaaggcgcccgcgcctttgccgaaaaacgcgacccggtctggaaagggcgctga

SEQ ID NO: 6287 - protein, 261 aa, Silicibacter pomeroyi DSS-3
MSDSPVRTRRDGAIFEVTLDRPKANAIDLVTSRIMGEVFREFRDDTDLRVAILTGGGEKFFCPGWDLKAAADGDAVDGDYGVGGFGGLQELRDMNKPVIAAVNGIACGGGLELALSADMIIAADHATFALPEIRSGTVADAASVKLPKRIPYHIAMELLLTGRWFDADEAHRWGLVNEIVPGTQLMERAWDLARLLASGPPLVYAAIKEIVREAEDAKFQDTMNKITKRQLRTVDVLYSSDDQLEGARAFAEKRDPVWKGR

SEQ ID NO: 6288 - DNA, 822 bp, Silicibacter pomeroyi DSS-3
  CDS (1)..(822): transl_table=11
gtgatggaggttcccccgatgagtgagggcgtcagcacccgccgtgacggccatgttcttgaggtcacgctgtcgcgcggcaaggtcaacgccatcgacgtaccaaccagtcaggcgctggcggctgcgtttcaggaattgcacgaggacaaggaattgcgctgtgcgatcctgaccggtggcggcgacaagatcttcagcgcgggctgggatctgaaagcgctgaacgcgggcgagatgcagcttgataactggtgggagagtgacgactacggctttggcggatttaccggcctgaccgaaaactgggcgctgaacaagccggtgatcgccgcgatcaacgggttggccatcggcggcgggtttgagatggcgatggcctgcgatctgctgatcgccgccgatcacgtggagtttggcctgccggaaatgccgttgggtatcgtgccggacgcaggcgcgctgcaacgtctgccgcggcgtatcccgcacaacatcgcgatggagatgttcctgctgggccgccgcatgtccgcgaccgaggccgcccattacggtctggtcaacaaggtggttcccaaggaacaactgatggatgcggcccgcgaatgggcggcctcgatcgcctggtcggcgccgctggcgatgcaatcggtgaaagaggttcaacgcgagatcgaatgcgtgccgctggaacaggcattccacaagatgcgcaccgacccgatgccgacctatcgcaagatgctgaaatccgacgatgcggccgaaggcgtggccgccttcgtcgagaaacgcgaaccgaggttcaagggcgaatga

SEQ ID NO: 6289 - protein, 273 aa, Silicibacter pomeroyi DSS-3
MMEVPPMSEGVSTRRDGHVLEVTLSRGKVNAIDVPTSQALAAAFQELHEDKELRCAILTGGGDKIFSAGWDLKALNAGEMQLDNWWESDDYGFGGFTGLTENWALNKPVIAAINGLAIGGGFEMAMACDLLIAADHVEFGLPEMPLGIVPDAGALQRLPRRIPHNIAMEMFLLGRRMSATEAAHYGLVNKVVPKEQLMDAAREWAASIAWSAPLAMQSVKEVQREIECVPLEQAFHKMRTDPMPTYRKMLKSDDAAEGVAAFVEKREPRFKGE

SEQ ID NO: 6290 - DNA, 774 bp, Pseudomonas fluorescens Pf-5; identical to SEQ ID NO: 2670
  CDS (1)..(774): transl_table=11

SEQ ID NO: 6291 - protein, 257 aa, Pseudomonas fluorescens Pf-5; identical to SEQ ID NO: 2671

SEQ ID NO: 6292 - DNA, 765 bp, Thermobifida fusca YX
  CDS (1)..(765): transl_table=11
atggccgacgaagttctctacgaagcggcagacggggtcgccgtcatcaccatcaaccggccccaggcgaagaacgcggtgaaccgcgcggtggccgagcagatcgctgcggctttggacgacctcgactcccgcaaggacctcacggtcgggatcctcaccggggcaggcggcaccttctgcgcgggaatggacctcaaagccttcctcgccggggaggtcccgatcatcgaggggcgcgggttcggcggtttcgcccagcgtccgccgcgtaaaccgctgatcgcggcggtggaaggctatgcgctggccggagggtttgaagcggtgctcgcctgcgacctcgtggtcgccgccgaagacgcgaagttcggcatccccgaggtcaaacggggcctggtggccgccgcgggcgggctgctgcgcctgccgcagcgcatcccccgcaatatcgccatggagttcgcgctgaccggcgacttcgtggatgcgccgcgggccgctgaactggggctggtcaaccggatcacccccagtgggaaggcgctggacggggctcgggagctcgccgcgcggatcgcggagaacgcgccgctggccgtcgcggtctccaagcaggtcatcgtcgagtccgcagactggtctgctgcggagcggtggcagcgccaggatgagctcaccggcccggtcttcaccagccgggacgcggcagaaggggcggcggcgttcgcggagaagcgcaagcccgtctggaccggagagtag

SEQ ID NO: 6293 - protein, 254 aa, Thermobifida fusca YX
MADEVLYEAADGVAVITINRPQAKNAVNRAVAEQIAAALDDLDSRKDLTVGILTGAGGTFCAGMDLKAFLAGEVPIIEGRGFGGFAQRPPRKPLIAAVEGYALAGGFEAVLACDLVVAAEDAKFGIPEVKRGLVAAAGGLLRLPQRIPRNIAMEFALTGDFVDAPRAAELGLVNRITPSGKALDGARELAARIAENAPLAVAVSKQVIVESADWSAAERWQRQDELTGPVFTSRDAAEGAAAFAEKRKPVWTGE

SEQ ID NO: 6294 - DNA, 783 bp, Thermobifida fusca YX
  CDS (1)..(783): transl_table=11
atgagcaccaccaacgacgacgcacctgaggttctggtcgaagagcgcggccgggtgctcgtgatcaccatgaaccggccccgggtccgcaacgcgatgtcgcaggcgatggcctaccgcatcgcggaggccctggagacgttggacagccgccccgacttgagtgtcggcatcatcaccggggcgggcggcactttctgcgcgggcatggacctcaaggggttcgcccgcggggagcgccctgtcgtcccgggccgcgggttcgcgggactcgtgcagcagccgccgaagaagccgctgatcgcggcggtggaaggctacgccttggccgggggctttgagatcgtgcttgcctgcgacctcatcgtggcctcgcaagaggcgaagttcggcctgcccgaggtgaagcgcgggctgaccgcggcggcgggcggcctgctgcgcctgcagcaccgcatcccctaccacctcgccatggagctggtgctgaccgggaagatgtggcccgcgaccgaggccgccgaagtccacctggtcaaccggctcaccgagccgggcaaggcgttcgaggtcgcgctggagctggccgaggaggtcgccgccaacgcgccgctcgccctggccgcgtccaagcaggtgctggtccgctcggtggactggccgctggacacccagttcgagaagcaggaagagtacgtcaacccggtgcgcgagtccgaggacgccaaggaaggggcgcgcgcgttcgtggagaagcgcgagccgcgctggaccggacggtag

SEQ ID NO: 6295 - protein, 260 aa, Thermobifida fusca YX
MSTTNDDAPEVLVEERGRVLVITMNRPRVRNAMSQAMAYRIAEALETLDSRPDLSVGIITGAGGTFCAGMDLKGFARGERPVVPGRGFAGLVQQPPKKPLIAAVEGYALAGGFEIVLACDLIVASQEAKFGLPEVKRGLTAAAGGLLRLQHRIPYHLAMELVLTGKMWPATEAAEVHLVNRLTEPGKAFEVALELAEEVAANAPLALAASKQVLVRSVDWPLDTQFEKQEEYVNPVRESEDAKEGARAFVEKREPRWTGR

SEQ ID NO: 6296 - DNA, 765 bp, Ralstonia eutropha JMP134
  CDS (1)..(765): transl_table=11
atgagcgacacgctgcaacttgaaacgcgcggcaatatcctgctgatcacgatgaaccggcccgaggcgcgcaacgccatggacttcgagactgcgacggcgctggccgccgcgctcgaccagctcgagtcgcgcgacgacctgagcgtggccatcctgaccggtgcgggcggtaccttctgctccggcatggacctgaagggcttcctggccggcaagcgccccagcctgccgggccgcggctttggcggcctgaccgaagcgcagccgcgcaaggtactgatcgccgcggtggaaggctatgcactggccggtggctttgaaatggcgctggcctgtgacctgatcgtggcctcgaaggcggccaagttcggcctgcccgaagtcaagcgcggcctggtggctgccgctggcggcctgatgcgcctgccgagccggatcccgtaccacatcgccatggaatacgcgctgaccggcaatatgctcggcgccgaacaggcgcatacgtacgggctggtcaatcgcctgaccgagccgggccaggcactggaagccgcgatcgcgctggccgaggaagtcggtgccaatggtccgatggccgtggcggtcagcaagcagatcgtcagcgagtccgctgactggtcggcggccgagatgttcgagcgccagcgtccgcttgtcgccccggtgttcacgtcatccgatgcccgcgagggcgccgctgcgtttgccgagaagcgcaaacctgtgtggaccggcaagtaa

SEQ ID NO: 6297 - protein, 254 aa, Ralstonia eutropha JMP134
MSDTLQLETRGNILLITMNRPEARNAMDFETATALAAALDQLESRDDLSVAILTGAGGTFCSGMDLKGFLAGKRPSLPGRGFGGLTEAQPRKVLIAAVEGYALAGGFEMALACDLIVASKAAKFGLPEVKRGLVAAAGGLMRLPSRIPYHIAMEYALTGNMLGAEQAHTYGLVNRLTEPGQALEAAIALAEEVGANGPMAVAVSKQIVSESADWSAAEMFERQRPLVAPVFTSSDAREGAAAFAEKRKPVWTGK

SEQ ID NO: 6298 - DNA, 777 bp, Ralstonia eutropha JMP134; identical to SEQ ID NO: 2682
  CDS (1)..(777): transl_table=11

SEQ ID NO: 6299 - protein, 258 aa, Ralstonia eutropha JMP134; identical to SEQ ID NO: 2683

SEQ ID NO: 6300 - DNA, 774 bp, Pseudomonas fluorescens PfO-1; identical to SEQ ID NO: 2684
  CDS (1)..(774): transl_table=11

SEQ ID NO: 6301 - protein, 257 aa, Pseudomonas fluorescens PfO-1; identical to SEQ ID NO: 2685

SEQ ID NO: 6302 - DNA, 768 bp, Burkholderia sp. 383
  CDS (1)..(768): transl_table=11
atgaacgaacctctcgtattgaccgaacgccgcggcccgatcctgatcgtgacgatcaaccggccgcaagcgaagaacgcgtgcgatgcggccaccgcgcgcgcgatgaacgacgcggccgacctgctcgatgccgacgactcgctgttcgtcggcatcgtgaccggcgcgggcggcactttttccgccggcgccgacctgcgtgcggtcgcacgcggcgaagcggcgtcgacgccggagcgaggcggcttcggcatcttccggcggccgccgtcgaaaccggtgatcgcagccgtcgagggcgtcgcggtgggcggcggcatggagctgtgcatggcgtgcgacctcgtcgtcgcggcgagcgatgcgcgcttcggcctgccggaagtgcggcacaacgtgcttgcgatcggcggcgggctgttccgtaccgtgcggcggatcccgtacaacatcgcgatggaattcctgctgaccggcgaaatgcaagccgccgacacgatgcagcgctggggcttcgtcaaccgcatcaccgagccgggcgcggcgctcgcgggcgcgatcgagctggcggaacggatgctcgtcaacgggcccaccgcgctcgcggcgaccaagcaggcggtgcgcgcgtcgatcgactggcgggaggacgacgcctggacgctgcagatgccgatcgcgaaccgggcgctcgaatcggaagaccgcaaggagggcgtgcaggccttcctcgagaaacgcaagccggtgtggaaggggcgttga

SEQ ID NO: 6303 - protein, 255 aa, Burkholderia sp. 383
MNEPLVLTERRGPILIVTINRPQAKNACDAATARAMNDAADLLDADDSLFVGIVTGAGGTFSAGADLRAVARGEAASTPERGGFGIFRRPPSKPVIAAVEGVAVGGGMELCMACDLVVAASDARFGLPEVRHNVLAIGGGLFRTVRRIPYNIAMEFLLTGEMQAADTMQRWGFVNRITEPGAALAGAIELAERMLVNGPTALAATKQAVRASIDWREDDAWTLQMPIANRALESEDRKEGVQAFLEKRKPVWKGR

SEQ ID NO: 6304 - DNA, 765 bp, Burkholderia sp. 383
  CDS (1)..(765): transl_table=11
atgagcgatgaattgctcgttgaatatcggaacggtattcagattctcacgatcaatcgtctggaagcacgcaatgcgtgcacgaaggcgatagcggaagccattgcggccgaactcgacacgctcgagcgccgcgacgatctgcgggccgcgatcatcacaggcgccggaggggcattctgttccggcatggatctcaaggggttcctgaaaggcgagcggccgagcattcccgggcgcggtttcgcgggtatcaccgaggcgccgcccggcaaaccgctgatcgcggccgtcgagggctatgcgctggccggcggcttcgaggtcgtgctggcgtccgacctggtggtcgcatcggaaaccgcccggttcgggttgcccgagacaaagcgtgggctcgtggcggctgccggcggattgctgcgcatccagcatcagttgccggaacgcatcgcgctcgaactcgtattgaccggcgacatgctcgatgcgaagcgtgcgttcgaatatgggctcgtcaaccggctgacgccgcccggcgacgcgttggccgtggccatcgagcttgcgggcaagattgccgcgaacgggccccttgcggttgcggcgagcaaacgcgtgatgcgtgcgtcgcgagactggtcgacggcggaaatgttcgtgcgccagcgcgaaatcaccgatcccgtgtttgcgtcgcgcgacgcccgtgaaggcgcggccgcatttgctgaaaagcgggtgccgcaatgggaggggcgatag

SEQ ID NO: 6305 - protein, 254 aa, Burkholderia sp. 383
MSDELLVEYRNGIQILTINRLEARNACTKAIAEAIAAELDTLERRDDLRAAIITGAGGAFCSGMDLKGFLKGERPSIPGRGFAGITEAPPGKPLIAAVEGYALAGGFEVVLASDLVVASETARFGLPETKRGLVAAAGGLLRIQHQLPERIALELVLTGDMLDAKRAFEYGLVNRLTPPGDALAVAIELAGKIAANGPLAVAASKRVMRASRDWSTAEMFVRQREITDPVFASRDAREGAAAFAEKRVPQWEGR

SEQ ID NO: 6306 - DNA, 792 bp, Burkholderia sp. 383
  CDS (1)..(792): transl_table=11
atgtcctatcaggcgattcagctggatatcgatcacgcgtcgaacgtggccacgatcaccctcaaccgccccgacaagctgaacagctttacgcgggcgatgcatcgcgagctgcagtcggcactcgatgatgtcgaggcggccggcgcgcgcgcgctgatcctgacaggtgcgggacgcggcttctgcgccggccaggacctggccgatctcgacttcacgccgggcgcgtctaccgacctcggcacgctgatcgacgaacacttcaatccactgatccgccgcctgcagcgtctgccgattccggtgatcgccgccgtcaatggtacggcggccggcgccggtgcgaatctcgcgctcgcctgcgatctcgtgttcgccgcccgctcgagcagtttcatccaggccttcgtcaagatcgggctcgtacccgattccggcggtacgtggttcctgccgcaacgcgtcggcatggcacgcgcgctggggctcgcactgaccggcgacaagctcggggccgaacaggccgagcaatggggcttgatctggcgtgccgtcgacgacgacacgctcgctgcgacagcccgccagctcgccacccagctcgcgcagcagccgacgcttgcgatcgcatcgatcaagcaatcgatgcgcgccagtgtcacgaacacgctcgaccagcaactcgacatggaacgcgacctgcagcgcacgctcggccagtcgcacgactacgcggaaggcgtgaaagcattcatcgagaagcgcgcgccgcgcttcgaggggcgttga

SEQ ID NO: 6307 - protein, 263 aa, Burkholderia sp. 383
MSYQAIQLDIDHASNVATITLNRPDKLNSFTRAMHRELQSALDDVEAAGARALILTGAGRGFCAGQDLADLDFTPGASTDLGTLIDEHFNPLIRRLQRLPIPVIAAVNGTAAGAGANLALACDLVFAARSSSFIQAFVKIGLVPDSGGTWFLPQRVGMARALGLALTGDKLGAEQAEQWGLIWRAVDDDTLAATARQLATQLAQQPTLAIASIKQSMRASVTNTLDQQLDMERDLQRTLGQSHDYAEGVKAFIEKRAPRFEGR

SEQ ID NO: 6308 - DNA, 801 bp, Burkholderia sp. 383
  CDS (1)..(801): transl_table=11
atgacctcgtccggctcgttctcttcgctgacgggcgacgacgccccgtcgatcctgcgcaacgacgacaacggcatcgcgtggctgacgatccatcgtccgcacgtcgccaatgcgctgtccgcggaagcgatccggcggctgtgcgacgaactcgtcacgctcgacgacaacccgtcgattcgcgtgatcgtgatccgcggcgcgggcgaccgtgccttcagcgcgggcgtcgatctcggcgaccccgagatgcgcgggatgcagccgatgcgcgggctcgcacgcaacgtgcacgagctgatcctcgaactgcgcaagccgaccatcgcggcgatcaacggctacgcgatcggcggcggcttcgagatcgcgctcgcgtgcgacctgcggatcgccgccgatcacgcgaccttcgcgctgcccgaagcacgcgtcggcatgggcgcgaacttcgcgagcgtgctgctgccgcgcatgctgccgcgtgcgatcgcgatggagctgctgttcacgggccgccgcttcgacgcggacgaggcgcagcgcgccgggttgctgaaccgcgtcgtccccggcgccgcactcgacgacaccgtgcgcgacctggcgcagacgatcgccgggaacgcgccgctcacgatccgccgcatcaaggaaaccgcggcacgcagccaggggttgccggtggccgccgcgctgcggctggacgtcggccccgacgtctatgcgagcgaggaccggatcgagggcgcccgcgcgttcctcgagaagcgcaaaccggtattcaagggacgctga

SEQ ID NO: 6309 - protein, 266 aa, Burkholderia sp. 383
MTSSGSFSSLTGDDAPSILRNDDNGIAWLTIHRPHVANALSAEAIRRLCDELVTLDDNPSIRVIVIRGAGDRAFSAGVDLGDPEMRGMQPMRGLARNVHELILELRKPTIAAINGYAIGGGFEIALACDLRIAADHATFALPEARVGMGANFASVLLPRMLPRAIAMELLFTGRRFDADEAQRAGLLNRVVPGAALDDTVRDLAQTIAGNAPLTIRRIKETAARSQGLPVAAALRLDVGPDVYASEDRIEGARAFLEKRKPVFKGR

SEQ ID NO: 6310 - DNA, 783 bp, Geobacter metallireducens GS-15
  CDS (1)..(783): transl_table=11
atggaattcaagaatctgctcatcgaaaccgctgacggcgtcgccaccctcaccgtcaaccgtccccaggccctcaatgccctgaacagcgaggtgctgaccgagctggcctccgccttctaccaactggagtacgatccggcggttcgggtggtggtcctcaccggcgccggcgagaaggccttcgtggccggggccgacatcaaagagatggcggccatgtcctccttcgaaggacaccagttcgccctgaaggggcagcactgcatgatggccatggagaagatgaagaccccggtcatcgccgcggtgaacggcttcgccctggggggcgggctggaactggccctggggtgcgacttcatctacgcctcggagaaggcgaagctcggtttccccgaggtgaccctcggcattatccccggcttcggcggcacccagaacctggcccgccttatcgggaagaaccgggctaacgaactgatctttaccggccggatgatcgcggccgacaaggcccaggcctgggggatcgtcaacgaggtgttcgctccggaggagcttctggtcaaagcaaaagagacagcggccgccatcgccggcgtcggccccctgggggttacctacgccaagaatgccattgccaacggcctgaacatgggaaaggaagacggcttccgctacgaggcctccctcttcggggtgctcttcggcaccgccgaccagaaggaagggatgggggcctttgtggaaaagcggaaagcagtatttacggggaaataa

SEQ ID NO: 6311 - protein, 260 aa, Geobacter metallireducens GS-15
MEFKNLLIETADGVATLTVNRPQALNALNSEVLTELASAFYQLEYDPAVRVVVLTGAGEKAFVAGADIKEMAAMSSFEGHQFALKGQHCMMAMEKMKTPVIAAVNGFALGGGLELALGCDFIYASEKAKLGFPEVTLGIIPGFGGTQNLARLIGKNRANELIFTGRMIAADKAQAWGIVNEVFAPEELLVKAKETAAAIAGVGPLGVTYAKNAIANGLNMGKEDGFRYEASLFGVLFGTADQKEGMGAFVEKRKAVFTGK

SEQ ID NO: 6312 - DNA, 783 bp, Geobacter metallireducens GS-15; identical to SEQ ID NO: 2692
  CDS (1)..(783): transl_table=11

SEQ ID NO: 6313 - protein, 260 aa, Geobacter metallireducens GS-15; identical to SEQ ID NO: 2693

SEQ ID NO: 6314 - DNA, 777 bp, Burkholderia thailandensis E264; identical to SEQ ID NO: 2696
  CDS (1)..(777): transl_table=11

SEQ ID NO: 6315 - protein, 258 aa, Burkholderia thailandensis E264; identical to SEQ ID NO: 2697

SEQ ID NO: 6316 - DNA, 792 bp, Burkholderia thailandensis E264
  CDS (1)..(792): transl_table=11
atgtcctaccaagcgattcgcatcgacatcgatccggcagcacagatcgcgacgatcacgctcgatcgccccgacaagctcaacagcttcacgcgcaacatgcatcgcgagctgcagtcggcgctcgacgacgtgcaggccgccaacgcgcgcgcattgattctcacgggcgcgggccgcggcttctgcgcgggccaggatcttgccgacctcgatttcacacctggggcgatgaccgatctcggcgacatgatcgaagcgcatttcaatccgctcattcgccgcctgcaagcgctgccgctgcccgtcatcgccgccgtgaacggcatcgcggcgggcgcaggcgccaatctggcgttcgcgtgcgatctcgtcatcgcggcgaaatcgagcagtttcattcaatcgttcgtgaagatcggcctcgttccggattccggcggcacgtggttcctgccgcagcgcgtcggcttcgcccgcgcgctcggcctcgcgctgacgggcgacaaactcggggccgaacaggcggagcgttgggggctcgtgtggcgcgtcgtcgacgatgccgaactcaccggtaccgcctcgcaactcgcccgacaactcgcgcagcagccgacacgagcgatcgcggcaatcaagcaggcgatgcggtcgagcgtcaccaacacgctcgaccaacagctcgatgtcgaacgcgaccttcagcgcgagctcgggcaatcgtacgactacgcggagggcgtgcgcgcgttcatcgaaaagcgcgcccctcgcttcgaaggacgctga

SEQ ID NO: 6317 - protein, 263 aa, Burkholderia thailandensis E264
MSYQAIRIDIDPAAQIATITLDRPDKLNSFTRNMHRELQSALDDVQAANARALILTGAGRGFCAGQDLADLDFTPGAMTDLGDMIEAHFNPLIRRLQALPLPVIAAVNGIAAGAGANLAFACDLVIAAKSSSFIQSFVKIGLVPDSGGTWFLPQRVGFARALGLALTGDKLGAEQAERWGLVWRVVDDAELTGTASQLARQLAQQPTRAIAAIKQAMRSSVTNTLDQQLDVERDLQRELGQSYDYAEGVRAFIEKRAPRFEGR

SEQ ID NO: 6318 - DNA, 798 bp, Frankia sp. CcI3
  CDS (1)..(798): transl_table=11
atgaacgagccgcgggtgcgctacgcgaagaagggccacgtggccagcatcatgatcgaccggcctgaggtgttcaacgcgctggaccagcggactcaccaggagctcgccgcgatctggaacgacgtggaggccgacgatgaggtgtgggtggcggtgctgaccggcgcgggcgaccgggccttctcggtcggccaggacctcaaggagcgggcagagctcaccgagcgaggcacgcccgccacctccctcggtagccggggtcagcccggctggccccggcttaccgagcgcttcaccctgtccaagccggtgatcgcgcgggtcaacgggtacgcgctgggtggcgggttcgagctggccctggcctgcgacctcatcgtcgccgccgagcacgcggtcttcgggctgccggaggcgcggctcggcctgatccccggggccggcggcgcgttccggctggcccggcagcttccgctgaagaccgcgatggggtatctgctcaccggtcgccggatgaccgccgcgacggcactgcggttcggcctggtcaacgacgtggtttcctacccggagctggacggctgcgtcgccgagtggaccgacgacatcatcagaagcgcccccctctcggttcgcgccatcaaggaagtggtgctcagatctctcgacatgccgctgccggaggcattctccgcccgataccactgggaagagcggcgccggcacagcctggactccgcggaaggggtccgagcgttcgtcgagaaacgcgacccagaatgggctggccgctga

SEQ ID NO: 6319 - protein, 265 aa, Frankia sp. CcI3
MNEPRVRYAKKGHVASIMIDRPEVFNALDQRTHQELAAIWNDVEADDEVWVAVLTGAGDRAFSVGQDLKERAELTERGTPATSLGSRGQPGWPRLTERFTLSKPVIARVNGYALGGGFELALACDLIVAAEHAVFGLPEARLGLIPGAGGAFRLARQLPLKTAMGYLLTGRRMTAATALRFGLVNDVVSYPELDGCVAEWTDDIIRSAPLSVRAIKEVVLRSLDMPLPEAFSARYHWEERRRHSLDSAEGVRAFVEKRDPEWAGR

SEQ ID NO: 6320 - DNA, 786 bp, Novosphingobium aromaticivorans DSM 12444; identical to SEQ ID NO: 2698
  CDS (1)..(786): transl_table=11

SEQ ID NO: 6321 - protein, 261 aa, Novosphingobium aromaticivorans DSM 12444; identical to SEQ ID NO: 2699

SEQ ID NO: 6322 - DNA, 765 bp, Novosphingobium aromaticivorans DSM 12444
  CDS (1)..(765): transl_table=11
atgagcgaggcggaagtccttacccaagtcgatggcaacgtgctggtcgtcacgatcaaccgtcccgatgcgaagaacgcgatgaacaaggccgcggccgagggcatcgcagcggcgatggaccggctcgatgccgaggcggacctgcgctgcgcgatcctgacgggggcgggcggaacgttctgttcgggcatggacctcaagggcttcctgcgtggcgaatcgccctcgatcccggggcgcgggttcggcgggctttccgaatggacgccaaagaagccgatcattgctgcggtcgatggctatgcgcttgcgggcggcatggaactcgcgctgtcgtgcgacctgatcgtggccagcgcttcctcgaagttcggcattcccgaagccaagcgcggccttgccgccgccgccggcgggctgatcaagctgccgcgccagatcccgccgcgcattgcgatggaactggccctgaccggcgacttcatcaccgcccagcgcgcctatgaactcggcttcatcaaccaggttgtcgaaggcccgtcgctcgacgccgccaaggctctcgccgcgcgcgtggccgagaacggtccgctggccctgatcgcctcgaaggggatcatccgcgattcgcacgaatggaccgaggccgagatgtggaagaagcagcaggcttacatcgctcccgtattctcctccagcgacgcccgcgaaggcgccgccgctttcgccgagaagcgcaagcccaactggcagggcaagtaa

SEQ ID NO: 6323 - protein, 254 aa, Novosphingobium aromaticivorans DSM 12444
MSEAEVLTQVDGNVLVVTINRPDAKNAMNKAAAEGIAAAMDRLDAEADLRCAILTGAGGTFCSGMDLKGFLRGESPSIPGRGFGGLSEWTPKKPIIAAVDGYALAGGMELALSCDLIVASASSKFGIPEAKRGLAAAAGGLIKLPRQIPPRIAMELALTGDFITAQRAYELGFINQVVEGPSLDAAKALAARVAENGPLALIASKGIIRDSHEWTEAEMWKKQQAYIAPVFSSSDAREGAAAFAEKRKPNWQGK

SEQ ID NO: 6324 - DNA, 744 bp, Burkholderia xenovorans LB400
  CDS (1)..(744): transl_table=11
atggacgaaccggtcacgtacgaatctcgcgaacgcattgcgcagatcacgatcaaccgcccgcatcgaatgaacgccatcgacgatcatgtcgaagtggcgctcgccgaagcgtggcggcgtttcaatgcgagcgacgatcgcgtggcgatcctcactggcgcgggcgataccgccttctccgccggccgggaccgcgatgcgaccggcacgccggaatatcgcaaattcgcacccggtgtcgatatcgtggttgaaaagccggtgatcgccgcggtagcgggatggtgtgtcggcggtgcgctgaccctcgtgcaaatgtgcgacctgtgcgtcgccgccgagaacgcgaagttcgtctatccagaagtgaaggtcggcttcgcgggcggcctggtcggttcgctcgcggtacgcattccgcacaagatcgcgatggaactcatgctgctcggcgaaccgatcggcgcgcaacgtgcctacgacgtgggtttcgtgaaccgtctggtgccggtcggccagcaggtcgccgaagcacgcgcgctggccctcaagatggtcaaccacgccccactcgtcctacgcatgctcaagcacttcgccaacgaaaccatgccgaaggggccggtcgaactggcgtcgcaggcgctgcgcgaaaccgatcgcctgttcgcgagcgaagactatcgtgaaggtcaggaaagcttcatgcagaagcgcacgccgcatttcaccggcaaatag

SEQ ID NO: 6325 - protein, 247 aa, Burkholderia xenovorans LB400
MDEPVTYESRERIAQITINRPHRMNAIDDHVEVALAEAWRRFNASDDRVAILTGAGDTAFSAGRDRDATGTPEYRKFAPGVDIVVEKPVIAAVAGWCVGGALTLVQMCDLCVAAENAKFVYPEVKVGFAGGLVGSLAVRIPHKIAMELMLLGEPIGAQRAYDVGFVNRLVPVGQQVAEARALALKMVNHAPLVLRMLKHFANETMPKGPVELASQALRETDRLFASEDYREGQESFMQKRTPHFTGK

SEQ ID NO: 6326 - DNA, 774 bp, Burkholderia xenovorans LB400
  CDS (1)..(774): transl_table=11
atgtcaatcgatctacgcacggaagggcacgtgtgcgttatcacgatcaaccgtccagagcggatgaacgcgctggacgctgctcattacgatgatctgtctgccgcgtggtgtcaggtccgcgacgatacgagaattcgtgcggctgtcatcaccggcgccggagagaaggcgttctgcgccggggcggacctgaaaagctttgtttcctcggctccggagcttgaagaaatcatgctcacccaaaagtcgcagcttcttaaccggggactcgaagtctggaaaccggtagttgccgcggtgaatggatactgcctcggcggagggatgacactgcttctggcgagcgatatccgtattgcctcgcgacatgtgaaattcggcctgagtgaagtcaaacggggaatctttccgggaaacggcggtactcaacggatcgcgcagcaattgccccacgccattgcaatggaggtcctgctggtcggggacacattcagtgcggagatggctgagcgctgggggttggtcaatcaggtgacagccccggaagatctgatggagaccgctcttgtctatgcggaaaagctggcagccaatgctccgctcgctgtgcaggctgccaaggagctcgcaatccgtagtcgtgacgtcgatcttgcgacaggcttgcggatggagcaggtcatgctgagactgcttcagacctccagcgacgtaaaggagggcgtaaaggcttttgccgaaaaacgtgcacccgtcttcgagggacgctaa

SEQ ID NO: 6327 - protein, 257 aa, Burkholderia xenovorans LB400
MSIDLRTEGHVCVITINRPERMNALDAAHYDDLSAAWCQVRDDTRIRAAVITGAGEKAFCAGADLKSFVSSAPELEEIMLTQKSQLLNRGLEVWKPVVAAVNGYCLGGGMTLLLASDIRIASRHVKFGLSEVKRGIFPGNGGTQRIAQQLPHAIAMEVLLVGDTFSAEMAERWGLVNQVTAPEDLMETALVYAEKLAANAPLAVQAAKELAIRSRDVDLATGLRMEQVMLRLLQTSSDVKEGVKAFAEKRAPVFEGR

SEQ ID NO: 6328 - DNA, 771 bp, Burkholderia xenovorans LB400
  CDS (1)..(771): transl_table=11
atggaaagtatcggtttctcgcgcgaagggcacatcgcacacgttcggctcaatcgccccaagtcgctcaacgcgataaacgaagaaatggacagggggctttacgaggcttggaacgagattaacaacgaccctgacatctgggtggctgtgctttcggcggaaggagaacgcgcgttctgcgtcggcgccgatgtcagtggcggagccgagcgtccgtctcgcatggcccttggaggtggcctcaccggtgtgggcggtccgctggtcaccctgcgcaagccattggtcgcagcggtacaaggctacgcgctcggcggaggcttcgagctggcgatgtgcgccgacgtgatcgtcgccgctacgacggccgtgttctcgatgccggaaaccaaggtcggtatcatcggtgaatccggcatcatgcatcgtgccattcgccaattgccatatcgagttgcgatggcgatgatccttaccggcgacaggttgcctgccagggatgcgcttgcttacggtctggtcaacgaggttgtcgaaccccaagtgttagcggaagcggcattgcgttgggcagaaaaaatcgcagccgcttccccgctcgccgtgcaggctgcgaagtcggcagtgctgcaaagactggactggcctctcgaggttgcactctcgacgcggttcgaacccatcgaacaatacgcaaccagcgaggatcgggtcgagggccggaaggcatttgcggagaagcgtgcgccgatctggcgtggacgctga

SEQ ID NO: 6329 - protein, 256 aa, Burkholderia xenovorans LB400
MESIGFSREGHIAHVRLNRPKSLNAINEEMDRGLYEAWNEINNDPDIWVAVLSAEGERAFCVGADVSGGAERPSRMALGGGLTGVGGPLVTLRKPLVAAVQGYALGGGFELAMCADVIVAATTAVFSMPETKVGIIGESGIMHRAIRQLPYRVAMAMILTGDRLPARDALAYGLVNEVVEPQVLAEAALRWAEKIAAASPLAVQAAKSAVLQRLDWPLEVALSTRFEPIEQYATSEDRVEGRKAFAEKRAPIWRGR

SEQ ID NO: 6330 - DNA, 792 bp, Burkholderia xenovorans LB400; identical to SEQ ID NO: 2702
  CDS (1)..(792): transl_table=11

SEQ ID NO: 6331 - protein, 263 aa, Burkholderia xenovorans LB400; identical to SEQ ID NO: 2703

SEQ ID NO: 6332 - DNA, 792 bp, Burkholderia xenovorans LB400
  CDS (1)..(792): transl_table=11
atgtcatatgaagcgatccgtctcgacatcgacgcatcgagccacgtcgccaccattacgctgaatcggccggacaagctcaacagctttactcgcgcgatgcatcaggaattgagcgccgcgctggaccaggtcgaagcgtccggtgcccgtgcgctcgtgctcaccggcgcgggccgcggcttttgcgccggccaggatctggccgacctcgacttcacgccaggcgccatgaccgatctgggtgaactgatcgaacaacatttcaatccgttgattcgccgcctgcaggcattgccgttgccggtcatcgccgcggtgaacggcacggctgccggcgccggcgccaatctcgcgctcgcgtgcgacctcgtgctcgcagctcgctccgcgagcttcattcaggcgttcgtgaagatcggcctggtgccggactccggcggcacatggttcctgccgcagcgtgtgggcatggctcgcgcattgggactcgccattaccggcgacaaactcagcgcggaaaaagccgaaagctggggtttgatctggcaggcagtcgaagacgccgagctcgccggcaccgcgacaaaactcgcgtcccaactcgcgcagcaacccacgcgcgccatcgcagcaatcaagcaggccatgcgcgcgggcgcgacgcaaacgctcgatcagcaactcgatctggaacgggatctgcaacgcgaactgggcgcttcccacgattacgcggaaggcgtgcaggccttcgtggaaaagcgcgcgccgcgcttcgagggccgctga

SEQ ID NO: 6333 - protein, 263 aa, Burkholderia xenovorans LB400
MSYEAIRLDIDASSHVATITLNRPDKLNSFTRAMHQELSAALDQVEASGARALVLTGAGRGFCAGQDLADLDFTPGAMTDLGELIEQHFNPLIRRLQALPLPVIAAVNGTAAGAGANLALACDLVLAARSASFIQAFVKIGLVPDSGGTWFLPQRVGMARALGLAITGDKLSAEKAESWGLIWQAVEDAELAGTATKLASQLAQQPTRAIAAIKQAMRAGATQTLDQQLDLERDLQRELGASHDYAEGVQAFVEKRAPRFEGR

SEQ ID NO: 6334 - DNA, 792 bp, Ralstonia metallidurans CH34
  CDS (1)..(792): transl_table=11
atgcaattcgaaaccctgttgtacgaagtggtcgacggcgtggccatcatccggctaaaccgcccggatcgcatgaacacactcggcggcaccatgaaacccgatctcgcccgcgcgttcttcgagttggcccgtgatgacaccagcgttcgctgtgtagtgctgaccggcaccggcgatagagcattctgcgcgggcgccgacatcaaggaacgcgccggcggcacggcccaccccgccgactactacgtcacgcagcaacgcacgcacgagctgttccgtggcatcgaggaattcgagaaaccggtgatcgccgccatcaatggcgtagcgctcggcggcggcctggaactggccctgtgcgccgacatccgcctggccgccagatcggcacgattcggcctgccagagatcaagctcggcgtcattcccgcggcgggcggcacgcagcgcctgccgcgcgtggtgggtccggccatcgccaaggaactgatctttaccagcgaactgatcaacgccgacgccgcgaaagacatccgcctggtgaaccgtgtgatcgacgacgacaagctgatggatgcggcactgacgatggccaggcgcatcgccgcgcaaccaccgctggccgtgcgcttcgccaagcggtcggtcaacctgggcatgcagggctcggtcgacatgggcctgcagttcgaatgctacggcgcggccatggtgatggacagcgaggacaggaaggaagggatgcgcgcattcgtcgagaagcgcgagccccggttcgtcgggcgctag

SEQ ID NO: 6335 - protein, 263 aa, Ralstonia metallidurans CH34
MQFETLLYEVVDGVAIIRLNRPDRMNTLGGTMKPDLARAFFELARDDTSVRCVVLTGTGDRAFCAGADIKERAGGTAHPADYYVTQQRTHELFRGIEEFEKPVIAAINGVALGGGLELALCADIRLAARSARFGLPEIKLGVIPAAGGTQRLPRVVGPAIAKELIFTSELINADAAKDIRLVNRVIDDDKLMDAALTMARRIAAQPPLAVRFAKRSVNLGMQGSVDMGLQFECYGAAMVMDSEDRKEGMRAFVEKREPRFVGR

SEQ ID NO: 6336 - DNA, 765 bp, Ralstonia metallidurans CH34
  CDS (1)..(765): transl_table=11
atgaccgacacgctagtcaaggagatccgcggcaacgtgatggtgctgaccattaaccgccccgaagcgcgcaatgcgatggacttcgaaacggccaccgccattgcggcagcgctggacgaactcgatgcgcgcgacgacctgagcatcgcggtgctgaccggtgccggcaacaccttctgttccggcatggacctgaaggggttcctcgccggcaagcggcccagcattccggggcgcggctttggtggcgtgaccgagcgcccgccgcgcaaggtgttgatcgccgcggttgagggctacgcgctggcgggtggcttcgaactcgtgctcgcttgcgatctggtcgtggcctcgcgcgaagcaaagttcggcctgccagaagtcaagcgtggcctggctgcagcagccggcggcctgatgcgcttgccgcgccgcgtgccgtaccacgtcgccatggagtacagcctgaccggcgacatgctgccggccacgcgtgcctacgaactgggtctcgtcaatcgcttggccgaagctggcggcgcgctggatgccgcgctgcaactggccgctgcggtcggcgccaacgggccgctggcgatcgccgcgagcaagcaggtggtggtgcaatcgggcgactggacccgcgaagaaatgttcgagcgtcaacggccgctgatcgagtcggttttcacctcggccgacgcgcgtgaaggcgcggcggcatttgcggagaagcgcaagccggtctggaccggcaagtaa

SEQ ID NO: 6337 - protein, 254 aa, Ralstonia metallidurans CH34
MTDTLVKEIRGNVMVLTINRPEARNAMDFETATAIAAALDELDARDDLSIAVLTGAGNTFCSGMDLKGFLAGKRPSIPGRGFGGVTERPPRKVLIAAVEGYALAGGFELVLACDLVVASREAKFGLPEVKRGLAAAAGGLMRLPRRVPYHVAMEYSLTGDMLPATRAYELGLVNRLAEAGGALDAALQLAAAVGANGPLAIAASKQVVVQSGDWTREEMFERQRPLIESVFTSADAREGAAAFAEKRKPVWTGK

SEQ ID NO: 6338 - DNA, 783 bp, Acidobacteria bacterium Ellin345; identical to SEQ ID NO: 2708
  CDS (1)..(783): transl_table=11

SEQ ID NO: 6339 - protein, 260 aa, Acidobacteria bacterium Ellin345; identical to SEQ ID NO: 2709

SEQ ID NO: 6340 - DNA, 789 bp, Silicibacter sp. TM1040
  CDS (1)..(789): transl_table=11
atgagccaagacagcccgatcaagacccgccgtgagggggccatccttgaggtgacactggaccggcccaaagccaatgcgatcgaccttgcgacctcgcggcagatgggagaggcctttcaggcctttcgcgacgatgatgcgctaagggtggcgatcataaccggtggtggcgacaagttcttttgccccgggtgggatttgaaagcggcggcaggcggcgatgccgtggatggcgactatggggtcggggggtttggtggcctgcaagaactgcgcgacctgaacaaaccggttatcgcagcggtgaatggcattgcttgcggaggtggtctggaactggcgctttcggcggatatgattctcgcggcagatcatgcgagttttgctttgccagagatccgctcgggcaccgtggccgatgcggcttcgatcaagctccctaaacgcatcccttatcacgtcgcgatggagctactgctcaccggacggtggtttgatgcggaggaagctcaccgctggggtctggtgaatgagatcgttgcagcggatcagttgatggatcgtgcctgggaactcgcgcgtctgctcgcgtccggtccgccgcttgtctacgcggcgatcaaggaaatcgtgcgcgacgcagaggattccaagtttcaggacgcaatgaatcggatcaccggacggcagttgcgcacggtcgatgtgctctatggatccgaggacaatcttgaaggcgcgcgcgcatttgcggaaaagcgcgatccggtctggaaggggcgctaa

SEQ ID NO: 6341 - protein, 262 aa, Silicibacter sp. TM1040
MSQDSPIKTRREGAILEVTLDRPKANAIDLATSRQMGEAFQAFRDDDALRVAIITGGGDKFFCPGWDLKAAAGGDAVDGDYGVGGFGGLQELRDLNKPVIAAVNGIACGGGLELALSADMILAADHASFALPEIRSGTVADAASIKLPKRIPYHVAMELLLTGRWFDAEEAHRWGLVNEIVAADQLMDRAWELARLLASGPPLVYAAIKEIVRDAEDSKFQDAMNRITGRQLRTVDVLYGSEDNLEGARAFAEKRDPVWKGR

SEQ ID NO: 6342 - DNA, 777 bp, Myxococcus xanthus DK 1622
  CDS (1)..(777): transl_table=11
atggcctacgagaacatccggctggagcaggagggcgccatcgcgaccctcttcatcgaccgccccaaggcgctcaacgccctcaacacgaagacgctgcaggagcttgagtccgcgctgaagtcccttcccgcggacgtgcgcgtcctcatcgtcaccggcggcggcgagaaggccttcgtcgcgggcgcggacatcgcggagatggccgcgctcaccgacgcgcaggcccaggagttcggcgccctggggcaccgggtcatggccgcgctggaggcgctgcccattccgaccatcgcggccgtgaatggcttcgcgctcggcggcggctccgagctggccctggcctgtgacttcatctacgcctccgagaaggccaagctcggcctgccggaagtcggcctgggcgtcatccccggcttcggcggcacccagcgcctcacccgcgtggtgggccgcgcccgcgccaaggagctcatcttcaccggcgaccgcatcgacgcggcgaaggcgaaggagattggcatggtgctggaggtcctccccgcggacggcctgctcgcgcactgccgcgccgtggcggagaagatcgtcaagaacagcccgctggccatctccaaggccaagcaggtcatcgaggccggcgccgaccaggacctgcgcgcggcgaacgacatcgagcgcaaggccttcggcgacctgttcggctccgaggaccagcgcgaaggcatgaaggccttcctggagaagcgccccgcgaccttcaccgggaagtag

SEQ ID NO: 6343 - protein, 258 aa, Myxococcus xanthus DK 1622
MAYENIRLEQEGAIATLFIDRPKALNALNTKTLQELESALKSLPADVRVLIVTGGGEKAFVAGADIAEMAALTDAQAQEFGALGHRVMAALEALPIPTIAAVNGFALGGGSELALACDFIYASEKAKLGLPEVGLGVIPGFGGTQRLTRVVGRARAKELIFTGDRIDAAKAKEIGMVLEVLPADGLLAHCRAVAEKIVKNSPLAISKAKQVIEAGADQDLRAANDIERKAFGDLFGSEDQREGMKAFLEKRPATFTGK

SEQ ID NO: 6344 - DNA, 777 bp, Rubrobacter xylanophilus DSM 9941
  CDS (1)..(777): transl_table=11
ttggagcacgtaagggtggagcgcgaggggggaggggtggcggtcgtcacgatagaccggcaggagaagctcaacgccctgaacgcccgggtgcagcgcgagatcacggaggtcttcgagcaagcgctccccggcgagacccgggccgccgtcatcaccggggcgggggagcgggccttcgtcgccggggcggacgccggggagatgggctcgttgagcgccctcgagatccgggagttcggccggatagggacgcgcatgatggaggccatagagcaggcgcccttccccgtgatcgccgccataaacggctacgccctcggcgggggactcgagctggcgctcgcctgcgacatccgcgtcgccgccgagaacgccgtcttcggcttccccgaggtcaccatcggcatcatgcccggcgcgggcggcacgcagcgcctcccgagggtaatcggcagcggaatagcccgcgagctcgtcttcaccggcaggatggtctccgcgcgggaggcaaaggagatcgggctcgtcaaccgcgtggtcggcgagggagaggccctcggggccgccagggagatggcgcgccagatagcggggaacgccccgctcgccgtcaggagcgcgaagatcgcgatgaacgtcgccagaaacaccgacctcgcgagcggcatagagcacgagggggacctcttcgcgctcctgttcaccaccgaggatgcgagggagggcctctccgccttcgccggtcgccgcaagccggagttcaagggacgctga

SEQ ID NO: 6345 - protein, 258 aa, Rubrobacter xylanophilus DSM 9941
MEHVRVEREGGGVAVVTIDRQEKLNALNARVQREITEVFEQALPGETRAAVITGAGERAFVAGADAGEMGSLSALEIREFGRIGTRMMEAIEQAPFPVIAAINGYALGGGLELALACDIRVAAENAVFGFPEVTIGIMPGAGGTQRLPRVIGSGIARELVFTGRMVSAREAKEIGLVNRVVGEGEALGAAREMARQIAGNAPLAVRSAKIAMNVARNTDLASGIEHEGDLFALLFTTEDAREGLSAFAGRRKPEFKGR

SEQ ID NO: 6346 - DNA, 804 bp, Rubrobacter xylanophilus DSM 9941
  CDS (1)..(804): transl_table=11
gtggaacgggacttcgggcatctggaggtatccgtcgagggccgggtggcggtggcccggctgaaccggccggagcggtacaacgccatcggggttcggctggcggaggagctcaaccggttcgtggagggcgtggagggggctgacgtgcgggcggtgatcctgacgggcgccggggagcgggccttctgctcgggggtggacctcaaggagcgccgcgagatgagcctggaggagcgctgggagcacaaccgggcggtcaacgggttcgtctcccggctggcgcggctgcaggtgcccaccatagcggccataaacggtctcgcgctgggcgggggcttcgagatgacgctcgggtgcgacttcaggatcgccgccgagcacgccgagttcgcgctgccggaggtggggctcgggatcataccgggcgcgggggggacccagcgcctcccgcggctggtgggcccctcgcgggcgaaggagctcatcctcaccgcccgccgcatagacgcccggcgggcgctggagatgggcatcctcaacgcggtcgtccccgccgggaggctcatggaggaggcgcggtcgctggccgaggaggcggcggccaacagccccctcgcggtggcctacgccaaggccgccgtggacgtggccatggagacccccctcgagcagggcctgcgcttcgagacggccgccatccgcaccacgctggactccgaggactacagggaggggctcgccgccttcgccgagcgccggaggccggagttcccgccgctcaaagcaaggaggatcacctga

SEQ ID NO: 6347 - protein, 267 aa, Rubrobacter xylanophilus DSM 9941
MERDFGHLEVSVEGRVAVARLNRPERYNAIGVRLAEELNRFVEGVEGADVRAVILTGAGERAFCSGVDLKERREMSLEERWEHNRAVNGFVSRLARLQVPTIAAINGLALGGGFEMTLGCDFRIAAEHAEFALPEVGLGIIPGAGGTQRLPRLVGPSRAKELILTARRIDARRALEMGILNAVVPAGRLMEEARSLAEEAAANSPLAVAYAKAAVDVAMETPLEQGLRFETAAIRTTLDSEDYREGLAAFAERRRPEFPPLKARRIT

SEQ ID NO: 6348 - DNA, 777 bp, Rubrobacter xylanophilus DSM 9941; identical to SEQ ID NO: 2714
  CDS (1)..(777): transl_table=11

SEQ ID NO: 6349 - protein, 258 aa, Rubrobacter xylanophilus DSM 9941; identical to SEQ ID NO: 2715

SEQ ID NO: 6350 - DNA, 774 bp, Mesorhizobium sp. BNC1; identical to SEQ ID NO: 2716
  CDS (1)..(774): transl_table=11

SEQ ID NO: 6351 - protein, 257 aa, Mesorhizobium sp. BNC1; identical to SEQ ID NO: 2717

SEQ ID NO: 6352 - DNA, 786 bp, Cytophaga hutchinsonii ATCC 33406
  CDS (1)..(786): transl_table=11
atgagcgataatttatctctgctagtcgttcgtgaagacgctggtattcttattataacagtaaaccgtcctgataaattaaattccttaaatagagccgtgctgcaggcaatcgatgaacaaatcgaatacgcttatacatctccatccgttaagggaattattattacaggatccggggagaaagcatttgcagccggagctgacatcagcgaattctcttcgttacagccgcacgaagcacaattgctttcgaaagaaggtcagttaatatttgaaaaaattgacatgttaaccaaacctgtcattgctgccgtaaatggttttgcattaggcggcgggtttgagcttgcattggcatgccacattcgcatggcttctgaaaatgccttattcggattacctgaagctacgctgggcctgttgcccggttatggaggcacacagcgcttgccgcaaataatcggtaaaggacgtgcaatagaagtgatgctttccgctgataagattcctgctccgaaagcactggaatggggaatcgtaaatgcggttactacacaggcagcccttatcccttctgcaatcgcgctacttaataaattcttttcaaaggcaccaacatctattgcagaagtgctgcgctgtacacacctttcaatggaaacttccggaacagcctttgatcaggaagcgaaatcatttggacgttgcgccggtacgcaggattttaaagaaggcgtacaggcattcctggaaaaacgccccgctacatttaccggaaaataa

SEQ ID NO: 6353 - protein, 261 aa, Cytophaga hutchinsonii ATCC 33406
MSDNLSLLVVREDAGILIITVNRPDKLNSLNRAVLQAIDEQIEYAYTSPSVKGIIITGSGEKAFAAGADISEFSSLQPHEAQLLSKEGQLIFEKIDMLTKPVIAAVNGFALGGGFELALACHIRMASENALFGLPEATLGLLPGYGGTQRLPQIIGKGRAIEVMLSADKIPAPKALEWGIVNAVTTQAALIPSAIALLNKFFSKAPTSIAEVLRCTHLSMETSGTAFDQEAKSFGRCAGTQDFKEGVQAFLEKRPATFTGK

SEQ ID NO: 6354 - DNA, 777 bp, Rhodococcus sp. RHA1; identical to SEQ ID NO: 2718
  CDS (1)..(777): transl_table=11

SEQ ID NO: 6355 - protein, 258 aa, Rhodococcus sp. RHA1; identical to SEQ ID NO: 2719

SEQ ID NO: 6356 - DNA, 762 bp, Rhodococcus sp. RHA1
  CDS (1)..(762): transl_table=11
atgagcgtggttctcaccgagttctccgacggcgtcgccgtcatcaccctgaaccggccggaggcgaagaacgccgtcgacctcgaggtcgccaaggcactcgccgccgcgatcgacgagttcgaggcgcggcccgacctgacgatcgcgatcctcaccggcgccgggggaacgttctgtgcggggatggatctgaaggcgttcacccgcggggagcggccgtcgctgcccggccgcggcttcggcgggatcacggaggccccgccgacgaagccgctgatcgccgcggtcgagggctgggccctggccggcggctgcgaattggcgctgtcggccgatctgatcgtcgccgcccgcgacgccaagttcggcatccccgaggtcaagcgggggctcgccgccgccgcaggtggcctgctgcgactgccgaaggtgctgccgtacccgatcgcgatggagatggcgatcaccggcgaccccctcaccgccgaggtggcgcacgcgcacggactcgtcaaccggctcaccgaacccgggcaggccctcgacaccgcccgtgaactggcggcacgggtcgccgccaacggtcccctcgcggtgcgcgccaccaagcaggtcgtcgcgatgtccgccaactacaccgaccccgacgcgttcaccgggcaacgccgcttcctcgatccggtgttcgcttcggaggacgcccaggagggtgcgcgcgccttcgcggagaagcgcccgccggtatggcgtggccgctag

SEQ ID NO: 6357 - protein, 253 aa, Rhodococcus sp. RHA1
MSVVLTEFSDGVAVITLNRPEAKNAVDLEVAKALAAAIDEFEARPDLTIAILTGAGGTFCAGMDLKAFTRGERPSLPGRGFGGITEAPPTKPLIAAVEGWALAGGCELALSADLIVAARDAKFGIPEVKRGLAAAAGGLLRLPKVLPYPIAMEMAITGDPLTAEVAHAHGLVNRLTEPGQALDTARELAARVAANGPLAVRATKQVVAMSANYTDPDAFTGQRRFLDPVFASEDAQEGARAFAEKRPPVWRGR

SEQ ID NO: 6358 - DNA, 753 bp, Rhodococcus sp. RHA1
  CDS (1)..(753): transl_table=11
atgcaagatatctcttacgaagaaataggccacgtcggggtgatcacgctgatgcggcccgaggtgcacaacgcgttacggctcgagacctacgccgagctgaccgaactcgtgcacaacgcgacggctcgcgtattggtcatcaccggtgccggacgatccttttgctcgggcgacgatgtccgagcggtgagcggtggcgcaggtccggtgtttgacgaagaaatcactccggccgcgggggccctgttggccacagatattccggtcatcgcggctgtgaatggcaccgccgtgggatgggggatggagcttgcgctgctggccgacatccgcatcgcggcacggagtgcgcgtttcggcgagctgttcgtcaaacgggggttgtgcagtgacgtagcggggctcggccgccttacgcagatcgtcgggcgcgagctggcagcagagttgcttttcactggcgagatgatcgacgcggagagggcccggcagattgggcttgtcagccgagtcgtcgacgacgagcaggtgatgccggtcgcactcgagctggcggagaagatcgcggcgaacccgccgttggctgtcgccgcgaccaagcgcggcctccgccttgcactggatcctgactggaatgaattcggacgctgggtgaccgccactcagacgtcgttgttcaccaccgtagatcaccgtgagggtgtccgctcattcctcgagaagcgcgagcctcggtatgtcggtcgatga

SEQ ID NO: 6359 - protein, 250 aa, Rhodococcus sp. RHA1
MQDISYEEIGHVGVITLMRPEVHNALRLETYAELTELVHNATARVLVITGAGRSFCSGDDVRAVSGGAGPVFDEEITPAAGALLATDIPVIAAVNGTAVGWGMELALLADIRIAARSARFGELFVKRGLCSDVAGLGRLTQIVGRELAAELLFTGEMIDAERARQIGLVSRVVDDEQVMPVALELAEKIAANPPLAVAATKRGLRLALDPDWNEFGRWVTATQTSLFTTVDHREGVRSFLEKREPRYVGR

SEQ ID NO: 6360 - DNA, 801 bp, Rhodococcus sp. RHA1
  CDS (1)..(801): transl_table=11
gtgccagaacagacggagacgacggaggcagccgcactgtgggagcggcgcggaggcatcggcatcatcacgctgaaccgccccaaggcgctcaatgcggtgaacggcgcgttgtcgaccgcagtgggcagtctgctcgagcaggccgagaacgaccccgaggtgcgggtggtcgtcgtgaccggggccggccgcgcgttctgcgccggcgccgacctcaaggccctctccacgggcgggaacatcgctgcggaggggcacctcgaatggggcttcgccggatacgcgcaacactggatcagcaagccgaccatcgccgcggtcaacggcttcgccctcggcggcggcaccgaactggtcctcgccagtgacctcgcggtcgtcgatgaggaggcgaagctcgggcttcccgaggtcaagcgtggactgttcgccgccgccggcggcgtgatccgcctgcagcagcagatcccgaagaaggtcgcgctggagatcgcactcaccggcgaaccgatcaccgcggcgcagggcaaggaactgggcctggtcaaccgtgtcgccccggcaggcaccgccctcgacgtcgcactcgaactcgccgagcagatcgctgcgaacgcaccgctgtcggtgcgcgaatcgaaggccatgatccaccgcaccgcaactgaacccgactggggcgaccgggcgtgggaggcgaacaacgccgccatcgccaccatcttcaccagcgccgacgccaaggaaggcccgacggcgttcgccgagaagcgccagccggtctggcagggccgctga

SEQ ID NO: 6361 - protein, 266 aa, Rhodococcus sp. RHA1
MPEQTETTEAAALWERRGGIGIITLNRPKALNAVNGALSTAVGSLLEQAENDPEVRVVVVTGAGRAFCAGADLKALSTGGNIAAEGHLEWGFAGYAQHWISKPTIAAVNGFALGGGTELVLASDLAVVDEEAKLGLPEVKRGLFAAAGGVIRLQQQIPKKVALEIALTGEPITAAQGKELGLVNRVAPAGTALDVALELAEQIAANAPLSVRESKAMIHRTATEPDWGDRAWEANNAAIATIFTSADAKEGPTAFAEKRQPVWQGR

SEQ ID NO: 6362 - DNA, 777 bp, Rhodococcus sp. RHA1
  CDS (1)..(777): transl_table=11
gtgagcagcggaatcttgttcgaggtcgacaaccacattgcacgtgtgacgctcgaccgccccaaggcgttgaactccatcgatcccgagatggacgcggcactgttcgaagcctggaccgagatcaactcgaatccggacatctgggtcgcagtgctcggtgctacgggggagaaggcgttctgcgccggcgccaacgtgagcggcgggaccgaaggcgacggccgcaggatggcgctcggcggcggtctcaccggtgtcggcgggccgatgctgacgcttcgtaaaccattgatcgcggcggtgcagggatacgcaatcggtggtggattcgaactggcgatgtgcgccgacatcatcgtcgcagccgacaacgctcagttcggcattccggagacgaaggtcggcatcatcggcgaggccggcatcatgcatcgcgcgatacggcagctgcctcatcacatcgcgatggccttgatcctcaccggagagcgcatcgacgcccagcaggcagagcgctacggactggtcaacgagatcgtgccgtacgagaagctgctcgagaccgcgtcgtcgtgggcggatcgaatcgcgtcggcgtcaccgcttgctgtccaagcagcaaaggacgcagttctgtcgcgtgcaggatggccgctggatgtcgcgttggcaactcgctacgagcccatcgaggcgtacgcgaacagcgcggaccgcatcgagggacgtgcagcgttcgcagacaagcgtgctgcgcaatggagcggtcgctga

SEQ ID NO: 6363 - protein, 258 aa, Rhodococcus sp. RHA1
MSSGILFEVDNHIARVTLDRPKALNSIDPEMDAALFEAWTEINSNPDIWVAVLGATGEKAFCAGANVSGGTEGDGRRMALGGGLTGVGGPMLTLRKPLIAAVQGYAIGGGFELAMCADIIVAADNAQFGIPETKVGIIGEAGIMHRAIRQLPHHIAMALILTGERIDAQQAERYGLVNEIVPYEKLLETASSWADRIASASPLAVQAAKDAVLSRAGWPLDVALATRYEPIEAYANSADRIEGRAAFADKRAAQWSGR

SEQ ID NO: 6364 - DNA, 777 bp, Rhodococcus sp. RHA1; identical to SEQ ID NO: 2720
  CDS (1)..(777): transl_table=11

SEQ ID NO: 6365 - protein, 258 aa, Rhodococcus sp. RHA1; identical to SEQ ID NO: 2721

SEQ ID NO: 6366 - DNA, 765 bp, Rhodococcus sp. RHA1
  CDS (1)..(765): transl_table=11
atgtcggacgaggtactggtcgagcgccgcggcgcggttcaggtcatcaccatcaaccgcccggaggcgaagaacgcgctgaatttggcggtcgccgagggcatcgcggcggcggtggatgagctcgatgagtcggacgagctgcgggttggggtgctgaccggcgccggtggggtcttttcggccgggatggatctcaaggcatttctgcgcggcgagtccccggcgattgaaggtcgaggtctgtgcgggattacccagtccaccccacgcaagccgctgatcggtgcggtcgaggggtgggctctggccggcggcttcgagttgctgctagcgtgcgacctcattgtcgcggcgcagaccgcgcggttcggggtccccgaggtgaagcggtcgctggtggccggtgggggagcggccctgctgctgccgcggcggctgccctacgccgtggcgctcgagctgctgctgaccggtgagcccttctctgctgagcgcgccgcggcggtgggacttgtcaaccgggtcacggagtccggcgcggcgctgaaggccgcggtcgacatggcgaccgctatcgccaagaacggtccactcgccgtcgcggccacgaaagagatcgcacaaaagaccacggactgggccctggccgagggctggcaggagcaggccacgatcatgggccccgtgttcgcctcggaggacgcgaaggagggggccaccgcgtttgccgagaagcgcgaaccagtatggcgcggccggtga

SEQ ID NO: 6367 - protein, 254 aa, Rhodococcus sp. RHA1
MSDEVLVERRGAVQVITINRPEAKNALNLAVAEGIAAAVDELDESDELRVGVLTGAGGVFSAGMDLKAFLRGESPAIEGRGLCGITQSTPRKPLIGAVEGWALAGGFELLLACDLIVAAQTARFGVPEVKRSLVAGGGAALLLPRRLPYAVALELLLTGEPFSAERAAAVGLVNRVTESGAALKAAVDMATAIAKNGPLAVAATKEIAQKTTDWALAEGWQEQATIMGPVFASEDAKEGATAFAEKREPVWRGR

SEQ ID NO: 6368 - DNA, 765 bp, Hyphomonas neptunium ATCC 15444
  CDS (1)..(765): transl_table=11
atgcccgtcgaatacgtcaaaaaaggccacgtcgcgatcatcacgatgaaccgccccgaagcccgcaacgccatcaacggcgaaatggccgccaccatggaagctgcgctcgaccagatggaatcagatccggaagtctgggtcggcatcctcaccgccgtcggcaaagcgttctgcgctggcgcagacctgaaagaaatctccgccggcaatggcggcgccctctccaccaagaagggtggcttcgccggcatcgccaagcgcgagcgcaccaagcctctcatcgccgccatcacaggctcggcgctggccggcggcacagagatcgcgctttcctgcgacatgatcgtggcggccgacgacaccaatttcggcctgccggaagtcaagcgctcgctcgtcgccggcgccggcggcctcttccgcctgccccgccagatcggcaaagccgtcgccctggaagccatcctcacgggtgacccgctctcctcgcagcgcgcttacgagctcggcatggtcaacaaggtcgtcccggaagccgacgtgatggccgaagccgaaaagctcgccggccgcatcaccgccaacgcccccctcgccgtcgccgccagccgcgccgtcgcgatcagcgcgacagccaaaaccgacgaagaactctggaaagactccggcgtcgccttcgccagcatcatcaacaccgaagactacaaagaaggccccaaagccttcatcgaaaaacgcgcgcctgtctggaagggtaagtaa

SEQ ID NO: 6369 - protein, 254 aa, Hyphomonas neptunium ATCC 15444
MPVEYVKKGHVAIITMNRPEARNAINGEMAATMEAALDQMESDPEVWVGILTAVGKAFCAGADLKEISAGNGGALSTKKGGFAGIAKRERTKPLIAAITGSALAGGTEIALSCDMIVAADDTNFGLPEVKRSLVAGAGGLFRLPRQIGKAVALEAILTGDPLSSQRAYELGMVNKVVPEADVMAEAEKLAGRITANAPLAVAASRAVAISATAKTDEELWKDSGVAFASIINTEDYKEGPKAFIEKRAPVWKGK

SEQ ID NO: 6370 - DNA, 783 bp, Rhizobium leguminosarum bv. viciae 3841
  CDS (1)..(783): transl_table=11
ttgagcgaccacattcgcacacgacaggacgacggagtgctcgaggtcgtcatcgaccggccgaaggcgaatgccatcgacctcgcgaccagccgtgccctggggttgatcttccaagatttccgcgacgatccgacgttgcgcgtcgccatcgtctcgggtgccggcgagaagtttttctgtgccggctgggatctcaaggcggcggcatcaggcgatgcggtcgatggagattacggtgtgggcggcttcggcgggctgcaggaactgcgcgacctcaacaagcccgtcatttgtgcggtcaacggcatctgttgcggcggcggactggagatcgcgctctcggccgacctgatcctcgccgccgatcatgcgaccttcgccctgccggaaatccgctcgggcacggttgccgatgcggcttccatcaagctgccgaagcgcatcccttaccacatcgccatggacatgcttttgaccgggcgctggctcgacgttcacgaggcgcatcgctggggtttcgtcaacgaggtcctgccggccgaccggttgatggacagagcccgggagcttgcccggctgcttgagagcgggccgccgctcgtctatgcggccatcaaggaaatcgtgcgcgaagcggagggttcgacgttccagactgccatgaacaagatcaccaagcggcagtttgcgacggtcgacacgctctattcgagcgaggaccaactggaaggcgcgcgggccttcgccgagaagcgaagccccatctggaaaggaaagtag

SEQ ID NO: 6371 - protein, 260 aa, Rhizobium leguminosarum bv. viciae 3841
MSDHIRTRQDDGVLEVVIDRPKANAIDLATSRALGLIFQDFRDDPTLRVAIVSGAGEKFFCAGWDLKAAASGDAVDGDYGVGGFGGLQELRDLNKPVICAVNGICCGGGLEIALSADLILAADHATFALPEIRSGTVADAASIKLPKRIPYHIAMDMLLTGRWLDVHEAHRWGFVNEVLPADRLMDRARELARLLESGPPLVYAAIKEIVREAEGSTFQTAMNKITKRQFATVDTLYSSEDQLEGARAFAEKRSPIWKGK

SEQ ID NO: 6372 - DNA, 777 bp, Rhizobium leguminosarum bv. viciae 3841
  CDS (1)..(777): transl_table=11
atgagtgtcgggttttccgtcgcagatcgtgtcgcccgcgtcaccctggaccgtcccgagcgcatgaatgcggtggatgccgcgacggagcaggagctggagacgatctggcgcgagatcgaagcgcgagacgacatcagctgcgtcgtcctgaccggagccggggaaagagccttttgcgccggcgccgatctgaagggcgggagcggtagctcaggcctcgattattgggcggcgagccgggtgaacggcttcggcgggctggcgtttcgccggtctctcgatgtgcctgtcatcgcccgcgtcaacggctttgcactcggtggcggcttcgagatggtgctcggttgcgacatcgtcattgccgcgcaaacggctcgtttcggcctgccggaagcccgcgttgggcgcatgccgctggatggcggcatggtgctcttgcaacgaaagatcgccttcaaccgggcgatggccgtcatgctgaccggccggcagttcagcgccgccgagatggcggggttcggggttgtcaacgaggtggttccggcgatcgagctggatgcggccgtcgatcgctgggttgccgatatcgttgcctgcgcgccgctgtcgctgcgcgcgatcaagcagactgtgaaccggaccggccatctgagccccgcagaggcacaggccttgcggacgccggcgctggtcaaggcgctgcaaagcgaggatgcgctggagggcgtcgccgccttccagcagaaacgggcgcccgtttggcggggacgatga

SEQ ID NO: 6373 - protein, 258 aa, Rhizobium leguminosarum bv. viciae 3841
MSVGFSVADRVARVTLDRPERMNAVDAATEQELETIWREIEARDDISCVVLTGAGERAFCAGADLKGGSGSSGLDYWAASRVNGFGGLAFRRSLDVPVIARVNGFALGGGFEMVLGCDIVIAAQTARFGLPEARVGRMPLDGGMVLLQRKIAFNRAMAVMLTGRQFSAAEMAGFGVVNEVVPAIELDAAVDRWVADIVACAPLSLRAIKQTVNRTGHLSPAEAQALRTPALVKALQSEDALEGVAAFQQKRAPVWRGR

SEQ ID NO: 6374 - DNA, 792 bp, Mycobacterium avium 104
  CDS (1)..(792): transl_table=11
gtgaccgacgcgccgggggccctggccgaacgccggggcaacgtgatggtgataaccatcaaccggccggaagcccgcaacgcggtcaacgccgcggtcagcatcggcgtcggggatgcgctcgaagaggcgcaacacgaccccgaggtgcgggcggtggtgctcaccggcgcgggcgacaagtcgttctgcgcgggggccgacctcaaggccatcgcgcggcgggagaacctgtatcaccccgaccatcccgaatggggcttcgccggctacgtgcgtcacttcatcgacaagcccaccatcgcggcggtcaacggcaccgccctgggcgggggcaccgagctggcgctggccagcgacctggtggtggccgacgagcgggcccagttcgggctgccggaggtcaagcgcggcctgatcgccgccgccggtggggtgttccggatcgccgagcagctaccccgcaaggtggcgatgcggctgctgctgaccggcgagccgctgtccgcggccgccgcccgcgactggggcctgatcaacgaggtggtcgaggccggctcggtgctggacgccgcgctggcgctggcctcggcgatcaccgtgaacgccccgctgtcggtgcaggccagcaagcggatcgcctacggcgtcgacgacggcgtggtggtcggcgacgaacccggctgggaccgcaccatgcgcgagatgcgggccctgctcaaatcggaggacgccaaggagggcccgcgggcgttcgccgagaagcgggagccggtctggcaggcgcgctga

SEQ ID NO: 6375 - protein, 263 aa, Mycobacterium avium 104
MTDAPGALAERRGNVMVITINRPEARNAVNAAVSIGVGDALEEAQHDPEVRAVVLTGAGDKSFCAGADLKAIARRENLYHPDHPEWGFAGYVRHFIDKPTIAAVNGTALGGGTELALASDLVVADERAQFGLPEVKRGLIAAAGGVFRIAEQLPRKVAMRLLLTGEPLSAAAARDWGLINEVVEAGSVLDAALALASAITVNAPLSVQASKRIAYGVDDGVVVGDEPGWDRTMREMRALLKSEDAKEGPRAFAEKREPVWQAR

SEQ ID NO: 6376 - DNA, 810 bp, Mycobacterium avium 104
  CDS (1)..(810): transl_table=11
atggctgaaaccctgacagaggtgacccgccaagccgccgtcgtcgagcggcggggcaacgtcgcgctcatcaccatcgaccggccagatgcgcgcaacgccgtcaacggcgcggtcagcacggccgtgggtgacgcgctcgaggaggcgcagcgcgatcccgaggtgtgggccgtcgtcatcaccggtgccggcgacaagtcattctgtgccggagcggatctcaaggccatctcacggggtgagaacctctaccacgccgagcaccccgaatggggcttcgccggttacgtgcaccacttcatcgacaaacccaccatcgccgcagtgaacggcaccgcgctcggcggcggctctgagctcgccctggccagcgatttggtgatcgcctgcgagagcgcaagtttcggactacccgaggtgaagcgcggcctgatcgccggggcgggcggcgtgttccggatcgtcgaacagttgccgcgcaaggtcgcgctggagttggtgttaacaggtgagccgatgacagcctccgacgccttgcggtggggcctgattaatgaggtcgtgccggacggcaccgtcgtggaagccgccctggcactcgccgagcggatcacgtgcaacgcgccgttgtcggtgcaagccagcaagcgggtcgcctacggtgccgacgacgggatcatcggcgcggaggaacccaagtgggaacgcacgattcgcgaattcaccgagttgctgaagtctgaggacgccaaggaaggtccgttggccttcgcagagaagcgtcaacccgtatggaaggcacgctga

SEQ ID NO: 6377 - protein, 269 aa, Mycobacterium avium 104
MAETLTEVTRQAAVVERRGNVALITIDRPDARNAVNGAVSTAVGDALEEAQRDPEVWAVVITGAGDKSFCAGADLKAISRGENLYHAEHPEWGFAGYVHHFIDKPTIAAVNGTALGGGSELALASDLVIACESASFGLPEVKRGLIAGAGGVFRIVEQLPRKVALELVLTGEPMTASDALRWGLINEVVPDGTVVEAALALAERITCNAPLSVQASKRVAYGADDGIIGAEEPKWERTIREFTELLKSEDAKEGPLAFAEKRQPVWKAR

SEQ ID NO: 6378 - DNA, 795 bp, Mycobacterium avium 104
  CDS (1)..(795): transl_table=11
gtgcggcacgtgagcactgggaacgaagaagccggcgaacccgaggtcctggtcgaacaacgggatcggatcctcatcatcacgatcaaccggccgaaggccaagaacgcggtcaacgccgcggtggccaacggactggccgccgccgtcgaccggctggatagcgagcccggtctgtcggtcggcgtcctgaccggggccggcggctccttttgcgcgggtatggatctgaaggccttcgcccgcggcgagctgcccatcgtcgagggccgcggcatgggtttcaccgaacgcccgccggccaagccgctgatcgcggcggtcgagggttacgcgctggccggcggcaccgagctggcgctggccaccgacctgatcgtcgcctccaaggacgcggccttcggcattccggaggtcaagcgcggcctggtcgccgggggcggcgggctgctgcggctgccgcagcgcatcccgtccgcgatcgccatggagctggcgctgaccggtgacaacctcagcgccgagcgggcgcacgcgctcggcatggtcaacgtgctggccgagcccggcagcgcgctggacgaggcgatcgcgctggccgagaagatcgcggcgaacgggccgctggcggtggccgccaccaagcggatcatcgtcgagtcccgcggctggagcccggagaccatgttcgccgagcagaacaagctgctggcccccgtgttctcctccaacgacgccaaggaaggcgccatcgcgttcgcggagaagcggccccccaagtggacgggcacctga

SEQ ID NO: 6379 - protein, 264 aa, Mycobacterium avium 104
MRHVSTGNEEAGEPEVLVEQRDRILIITINRPKAKNAVNAAVANGLAAAVDRLDSEPGLSVGVLTGAGGSFCAGMDLKAFARGELPIVEGRGMGFTERPPAKPLIAAVEGYALAGGTELALATDLIVASKDAAFGIPEVKRGLVAGGGGLLRLPQRIPSAIAMELALTGDNLSAERAHALGMVNVLAEPGSALDEAIALAEKIAANGPLAVAATKRIIVESRGWSPETMFAEQNKLLAPVFSSNDAKEGAIAFAEKRPPKWTGT

SEQ ID NO: 6380 - DNA, 759 bp, Mycobacterium smegmatis str. MC2 155
  CDS (1)..(759): transl_table=11
atgagcgtcgactacgaggtccgcaacggcgtcgcgtggctcaccatcaaccgtcccgaagcgcgtaacagcctgaacaaggcggtccgcgacgggttgttcgacggtgtccgcagattcaacaacgatgcgcaagccaaggtactggtcctgaccggtgcgggggacaaggcgttctgcgcgggcggtgacctcaaggagatgtcggacgaccaattgaccgttccgccgatcgatttcgtaccgcagttcgggcgcaacatcaccgtggacaagccgacgatcgccgcggtcaacggtgtcgcgttcgccgggggctttctgctggcgcagacatgcgacctgtgtgtggcctcgacgaccgcgaagttcgccatcaccgaggccaaggtgggccgcggatccccatgggcggcgccgctcccgctgatgatcccgcgtcgcatcgccatggaactggtgctcaccggagcaccgatctcggccgcgcgcgcccacgagatcgggttcgtcaaccgactggccgaacccgccgacctgcacgcggtggcgcagaaattggccgagcagatcgcggcgaatgcaccgctgtcggtggcggcgggcaagcggaccgcgacactgaccgccgaacatccgctgagcgaggcgttcgacatcgctgaatcaatctgggagccggtctatctcagcggagacgcccaggaggggatggcggccttcaaggagaagcgctccccggtgtggaagggacgttga

SEQ ID NO: 6381 - protein, 252 aa, Mycobacterium smegmatis str. MC2 155
MSVDYEVRNGVAWLTINRPEARNSLNKAVRDGLFDGVRRFNNDAQAKVLVLTGAGDKAFCAGGDLKEMSDDQLTVPPIDFVPQFGRNITVDKPTIAAVNGVAFAGGFLLAQTCDLCVASTTAKFAITEAKVGRGSPWAAPLPLMIPRRIAMELVLTGAPISAARAHEIGFVNRLAEPADLHAVAQKLAEQIAANAPLSVAAGKRTATLTAEHPLSEAFDIAESIWEPVYLSGDAQEGMAAFKEKRSPVWKGR

SEQ ID NO: 6382 - DNA, 807 bp, Mycobacterium smegmatis str. MC2 155
  CDS (1)..(807): transl_table=11
atgagcgagaagacccgaacggggaccgacgagatccgctacgacgtgaaaggccacgtcgcccgcgtcaccttcgaccgcccgcatgtgctcaacgcgctcgacgcgaagagcacccagcggtgcaacgagatctgggatcagatcgaaaacgacccgagcgtgcacgtcgtggtggtcaccggcgcaggggagaaggcgttctgcaccggcgccgacatgtcggtcggtggcgtcggcaagaccggcgtggactactgggccggcctcgagccgaatggttttgcgggactgtcgttgcgagaaacgctcgacgtaccggtgatcgcgcgtgtcaacggctacgcgctcggcggtgggatggaaaccgtgctcggtgcagacctcgtcatcgccgcggatcacgccacattcggcctcaccgagccgcgggtcggccgcgtgccgctggacggcggcatggtcaagctccgcgaacggatcccgcacacgcaggcaatgtccctgctactcaccgggaggaaggcttcggcccgggagatggccgacatgggcctggtcaacgaggtcgtgccgatggccgagctcgacgcggccgtcgaccgttgggtggagcagattctcgcgtgcgcgcccacctcgctgcgcgcgatcaagcaggtcgtcacccgcaccgcccatctctccgcgagagaagctcatgctgcgcggctgccggcgttgatggaggccctcgtcagcccgaatgccaccgagggcgtcgaagcctttcaacagaaacgcaaaccgaattggagtgaccgatga

SEQ ID NO: 6383 - protein, 268 aa, Mycobacterium smegmatis str. MC2 155
MSEKTRTGTDEIRYDVKGHVARVTFDRPHVLNALDAKSTQRCNEIWDQIENDPSVHVVVVTGAGEKAFCTGADMSVGGVGKTGVDYWAGLEPNGFAGLSLRETLDVPVIARVNGYALGGGMETVLGADLVIAADHATFGLTEPRVGRVPLDGGMVKLRERIPHTQAMSLLLTGRKASAREMADMGLVNEVVPMAELDAAVDRWVEQILACAPTSLRAIKQVVTRTAHLSAREAHAARLPALMEALVSPNATEGVEAFQQKRKPNWSDR

SEQ ID NO: 6384 - DNA, 765 bp, Mycobacterium smegmatis str. MC2 155
  CDS (1)..(765): transl_table=11
gtgtcagaagaagtagtcctgagggagcgtcgtgatcggacgctcatcatcacgatcaaccggccggaagcgcgcaatgcgttcaatctcgcggtggccaaggggcttgccgaggcggtcgacgaactcgacgacacccaagagctttccgtgggcatcatcaccggtgcgggtggcaccttctgtgccggtatggatctcaagggtttcgcctccggtgagctgccgcacgtgccgggccgcggaatcggcttcaccgagaagccgccccgcaaaccgctcatcgccgcggtggaaggctacgcgctggcgggaggcaccgagatcgtgctggccaccgacctcgtcgtggcgagcaggaccgcgaagttcggcatccccgaggtgaagcgcggactggtcgccgcgggcggcggtctgctgcggctgcccaagcgcatcccgtaccagaaggcgctcgagctcgcgctgaccggtgacaacttcaccgccgaggaggctgccgcctggggcttcgtcaacaagctgaccgagccaggagaggcgctggccggtgccctcgagctcgccgagcgcatcaccgccaacggcccactggccgtcgcggtcaccaaggaggtgatcgtcaagtcggccgagtggtcggaggccgagatgtggaagaaacagggtgagttgatcgggccggtcttctcgtcgaaggacgcgatcgaaggcgccactgcgttcgccgagaaacgcaaacccaactggacaggttcctga

SEQ ID NO: 6385 - protein, 254 aa, Mycobacterium smegmatis str. MC2 155
MSEEVVLRERRDRTLIITINRPEARNAFNLAVAKGLAEAVDELDDTQELSVGIITGAGGTFCAGMDLKGFASGELPHVPGRGIGFTEKPPRKPLIAAVEGYALAGGTEIVLATDLVVASRTAKFGIPEVKRGLVAAGGGLLRLPKRIPYQKALELALTGDNFTAEEAAAWGFVNKLTEPGEALAGALELAERITANGPLAVAVTKEVIVKSAEWSEAEMWKKQGELIGPVFSSKDAIEGATAFAEKRKPNWTGS

SEQ ID NO: 6386 - DNA, 795 bp, Mycobacterium smegmatis str. MC2 155
  CDS (1)..(795): transl_table=11
gtgaccgaaaccgcgccgggcgctctcaccgagcgcagaggcaatgtcctgctcatcaccatcaaccggcccgaggcgcgcaacgccatcaactcgtcggtgagccaggccgtcggcgacgcgctggccgaagcgcagaacgaccccgaggttcgcgcagtggtcctcaccggtgcgggtgacaagtcgttctgcgccggtgcggacctcaaggcgatctcgcgtggggagaacctcttccaccccgagcatcccgagtacggattcgcaggctacgtcagccatttcatcgacaagccgaccatcgccgcggtcaacggcaccgctctcggtggcggtaccgaactggcgctggccagtgatctggtggtcgccgaggagcgtgcgatgttcggtctgcccgaggtcaagcgtggcctgatcgccggtgccggaggcgttttccgcatcatcgagcagctgccgcgcaaggtggcgctggagttggtgtacaccggtgacccgatcagcgccgccgacgcgctgaagtggggcctgatcaaccaggtggtgcccgacggcaccgtcgtcgacgcggctctggctctcgcggaacgcatcacgtgcaacgcaccgctggccgtgcaggccagcaagcgcgtcgcctacggcgccgaggagggcacggtgcccgccgagcagccgtcgtggaagcgcacgaaccgcgagttcgtcacgctgctgaaaaccgaagatgccatggaaggtccgctggctttcgcgcagaagcgccagcccgtttggaaggccaagtaa

SEQ ID NO: 6387 - protein, 264 aa, Mycobacterium smegmatis str. MC2 155
MTETAPGALTERRGNVLLITINRPEARNAINSSVSQAVGDALAEAQNDPEVRAVVLTGAGDKSFCAGADLKAISRGENLFHPEHPEYGFAGYVSHFIDKPTIAAVNGTALGGGTELALASDLVVAEERAMFGLPEVKRGLIAGAGGVFRIIEQLPRKVALELVYTGDPISAADALKWGLINQVVPDGTVVDAALALAERITCNAPLAVQASKRVAYGAEEGTVPAEQPSWKRTNREFVTLLKTEDAMEGPLAFAQKRQPVWKAK

SEQ ID NO: 6388 - DNA, 801 bp, Mycobacterium smegmatis str. MC2 155
  CDS (1)..(801): transl_table=11
gtgagtgagaccggcaaggggcctgacgccctcgttgagcagcgcggacacaccctcatcgtcacgttgaaccgtcctgaggcgcgcaacgctctctcgggcgagatgctctcgatcatggtcgaagcatgggaccgggtcgacaacgatccggagatccgcacctgcatcctgaccggcgccggcggttacttctgctcgggcatggacctcaagggcgcggacaagaagccgccgggtgactcgttcaaggacggcagctacgacccgtcgaagattccaggcctgctcaagggccgccgtctgaccaagccgctgatcgccgcggtcgagggtcccgccatcgcgggcggcaccgagatcctgcagggcaccgacatccgcgtggccggtgagagcgccaagttcgggatctccgaggccaagtggagcctgtacccgatgggcggttcggccgtgcgcctggtgcgccagatcccctacaccatcgcgtgcgacatgctgctcaccggtcgccacatcaccgcggccgaggccaaggagtacggcctgatcgggtacgtcgttcccgacggcaccgcgctggacaaggcgctggagatcgccgagaccatcaacaacaacggtccgctcgccgtgcaggcgatcctcaagaccatccgtgagaccgagggcatgcacgaggacgaggcgttcggccccgacacccgcaacggcatcccggtgttcctgtccgaggacgccaaggaggggccgcgtgcgttcaaggagaagcgcgcaccgaacttccagatgaagtag

SEQ ID NO: 6389 - protein, 266 aa, Mycobacterium smegmatis str. MC2 155
MSETGKGPDALVEQRGHTLIVTLNRPEARNALSGEMLSIMVEAWDRVDNDPEIRTCILTGAGGYFCSGMDLKGADKKPPGDSFKDGSYDPSKIPGLLKGRRLTKPLIAAVEGPAIAGGTEILQGTDIRVAGESAKFGISEAKWSLYPMGGSAVRLVRQIPYTIACDMLLTGRHITAAEAKEYGLIGYVVPDGTALDKALEIAETINNNGPLAVQAILKTIRETEGMHEDEAFGPDTRNGIPVFLSEDAKEGPRAFKEKRAPNFQMK

SEQ ID NO: 6390 - DNA, 744 bp, Mycobacterium sp. KMS
  CDS (1)..(744): transl_table=11
ttggagcgccaggggcgcacactcatcatcaccatcaatcggccggaggcccgcaatgccgtgaacttcgcggtgagccagggcctcgccgacgcggtcgacgaactcgacagcgacacaagcctttccgtggcaattctcaccggcgcgggcggcaacttctgttcgggcatggacctgaaggccttcgcggcgggtgagcgggtcgacatccccggtcgcggaatcggtttcacggaacggccaccccggaaaccgctgatctccgcggtcgaggggtatgcgctcgccggcggcacggaggtggtgctcgccacggatctcgtcgtggcgtccgcgaccgcaaagttcggcatcccggaggtcaagcgcggtctcgtggccgccggcggggggttgctgaggctgccgcggcgcattccgtaccagaaggcgctcgagttggcgttgaccggtgagagtttcaccgccgaacagggcgcggcgtggggtttcgtcaacaaggtgaccgaaccggggcaggcgctcgccggcgcggtcgaactcgccgaacgcatcacggccaacggcccgctcgcggtggcggtgaccaaggagattctggtccgctcctcggagtggagcgaagccgagatgtggtccaagcaaatggaactcatcatcccggtgttctcgtccaacgacgccaaggaaggcgccatcgcgttcgcggagaagcgggcgccgaactggagcggtacctga

SEQ ID NO: 6391 - protein, 247 aa, Mycobacterium sp. KMS
MERQGRTLIITINRPEARNAVNFAVSQGLADAVDELDSDTSLSVAILTGAGGNFCSGMDLKAFAAGERVDIPGRGIGFTERPPRKPLISAVEGYALAGGTEVVLATDLVVASATAKFGIPEVKRGLVAAGGGLLRLPRRIPYQKALELALTGESFTAEQGAAWGFVNKVTEPGQALAGAVELAERITANGPLAVAVTKEILVRSSEWSEAEMWSKQMELIIPVFSSNDAKEGAIAFAEKRAPNWSGT

SEQ ID NO: 6392 - DNA, 750 bp, Mycobacterium sp. KMS
  CDS (1)..(750): transl_table=11
gtgctgatcatcacgatcaaccgccccgaggcccgcaacgccgtcaacgcgtcggtgtccatcggcgtgggcgacgccctgcaggccgcgcaggaggatccggagatccgggccgtcatcctgaccggcgccggagacaagtccttctgtgccggagccgatctcaaggcgatctcacgcggtgagaacctgttccaccccgagcattcggagtggggcttcgccgggtacgtgcggcacttcatcgacaagccgacgatcgccgcggtcaacggcacagcactgggcggcggcaccgaactcgcgctggccagcgatctggtggtggccgaggaacgtgcgaaattcggtctgcccgaggtgaaacggggcctgatcgccggtgccggcggcgtattccgcatcgtcgagcagctccctcgcaaggtcgcgctcgagctgatctacaccggtgagccgatcagtgcggccgatgcgctgcgctggggtctgatcaacgatgtggtgcccgacggcaccgtggtggacgccgcgctcaaactcgccgagcggatcacctgcaacgcgccgctggccgtgcaggccagcaagcgggtgtcctatggcgccgtcgacggtgtggtcggcagcgacgagccgttctggaagcagacgttcagcgagttctcgacgctgctgaagaccgaggacgccatggaagggccgctggcattcgcgcagaagcgcgagccggtctggaaggcgaagtaa

SEQ ID NO: 6393 - protein, 249 aa, Mycobacterium sp. KMS
MLIITINRPEARNAVNASVSIGVGDALQAAQEDPEIRAVILTGAGDKSFCAGADLKAISRGENLFHPEHSEWGFAGYVRHFIDKPTIAAVNGTALGGGTELALASDLVVAEERAKFGLPEVKRGLIAGAGGVFRIVEQLPRKVALELIYTGEPISAADALRWGLINDVVPDGTVVDAALKLAERITCNAPLAVQASKRVSYGAVDGVVGSDEPFWKQTFSEFSTLLKTEDAMEGPLAFAQKREPVWKAK

SEQ ID NO: 6394 - DNA, 774 bp, Mycobacterium sp. KMS; identical to SEQ ID NO: 2712
  CDS (1)..(774): transl_table=11

SEQ ID NO: 6395 - protein, 257 aa, Mycobacterium sp. KMS; identical to SEQ ID NO: 2713

SEQ ID NO: 6396 - DNA, 765 bp, Acidovorax sp. JS42
  CDS (1)..(765): transl_table=11
atgacatccacggtattggtcgaagtgcgcggcaacgtgcagatcatgacgctgagcaaccccgaggcacgcaatgccgccacgctggagatggccgaagccatggtggccgcgctcgatgcgctggacagcaacccggcgctgcaggtgggcatcgtcaccggcgcgggtggcaccttctgtgcgggcatggacttgaagggctttctgcagggcaagcgcccgagcatcgccgggcgggggttttgtggcctcacgcaaaagccgccgcgcaaaccgctgatcgccgccgtcgagggctacgcgctggccggtggcttcgagctggtgctggcctgcgacctgatcgtggccgcccgcacagccaagttcggcctgcccgaggtcaagcggggtttggcggccaccgctggtggcctgttgcgcctgcccaagcgcctgccctaccacgtcgccatggaatgcatcctcaccggcgacatgttcggcgccgagcgcgcccaggcccatggcctggtcaaccgcctggtcgagcccggccaggcgctggacgccgccctggaactggcccagaccgtggcggccaatggcccgctggcgctaatcgccagcaagcgcgtggcgcaagagtcggccgactggccgcaggccgagatgtttgaccgccaggccgtgatcaccgcgccggtattcgcctcgcaagacgcacgcgaaggggccacggcctttgccgaaaagcgcccacctgtctggcaaggtgtttga

SEQ ID NO: 6397 - protein, 254 aa, Acidovorax sp. JS42
MTSTVLVEVRGNVQIMTLSNPEARNAATLEMAEAMVAALDALDSNPALQVGIVTGAGGTFCAGMDLKGFLQGKRPSIAGRGFCGLTQKPPRKPLIAAVEGYALAGGFELVLACDLIVAARTAKFGLPEVKRGLAATAGGLLRLPKRLPYHVAMECILTGDMFGAERAQAHGLVNRLVEPGQALDAALELAQTVAANGPLALIASKRVAQESADWPQAEMFDRQAVITAPVFASQDAREGATAFAEKRPPVWQGV

SEQ ID NO: 6398 - DNA, 834 bp, Acidovorax sp. JS42; identical to SEQ ID NO: 2768
  CDS (1)..(834): transl_table=11

SEQ ID NO: 6399 - protein, 277 aa, Acidovorax sp. JS42; identical to SEQ ID NO: 2769

SEQ ID NO: 6400 - DNA, 825 bp, Sulfitobacter sp. EE-36
  CDS (1)..(825): transl_table=11
atgactgacgtaaaaaccaaagataccaaggatatctgggcgcgcgatttcgactatatctcggtcaagcgtgacggccatgtccttgaaattacgattgatcgcgcggatcgctacaacgccctccacggcggggcgcatcaggaattgcacgatatctttgatggatacgagcaggacccggatctgtgggttgccatcatcaccggggccggggacaaagctttttgctcgggcaacgatctgaaagccacaagcgaagggcagaatattgaacccgccagcagcggctttggcggtctcactgatcgctgggggcgggaaaagccggttatcgcggcggtgaatggcgtggcaatgggcggtggatgcgagatcgttctggcatccgatattgccgtggcggatgcccatgcgaaattcgcgctgcccgaggtgaaggttggcctgttcgcagcggcgggtggcgtgcaacgtctcacgcgccagattggtcgtaaagccgcgatggagctgatcctgacaggccgtgcgattacagccgaccgtgcctgtgagctgggtatcattaaccgcgtcgcgagcgaaggcgagacggcgatggatatcgcacgtgaaatcgccaaggagatcacgatggtatcgccgactgccgtcagggcgtcaaagcgggtgctcaacgcccttgaagaagatatcgagcgtctgcccgaagccttcgcgggcaacacggctgaatttgacgtcgtgctaaaatccaacgacggtaaagagggcgtcaaagcctttgtcgaaaaacgcgcgccgaactggacaaatagctaa

SEQ ID NO: 6401 - protein, 274 aa, Sulfitobacter sp. EE-36
MTDVKTKDTKDIWARDFDYISVKRDGHVLEITIDRADRYNALHGGAHQELHDIFDGYEQDPDLWVAIITGAGDKAFCSGNDLKATSEGQNIEPASSGFGGLTDRWGREKPVIAAVNGVAMGGGCEIVLASDIAVADAHAKFALPEVKVGLFAAAGGVQRLTRQIGRKAAMELILTGRAITADRACELGIINRVASEGETAMDIAREIAKEITMVSPTAVRASKRVLNALEEDIERLPEAFAGNTAEFDVVLKSNDGKEGVKAFVEKRAPNWTNS

SEQ ID NO: 6402 - DNA, 768 bp, Sulfitobacter sp. EE-36
  CDS (1)..(768): transl_table=11
atgagttatatcaagactgaaaccgatggtcatgtcctgatcatcacgctggaccggcccgacgcccgcaatgctttcaacctcgccatgtccgaggaactggaggcgaccatcgaccactacgagaacgatatcgagctgcgctgtgccatcattcaggcaaacgggccaaccttctcggcgggtcaggatttgatcgcggcggcaaagggggaacgctcggtcactaaggggcgcggcggcttcggcatcatgggccgcccgccaaagaagccccttgtcgcagcggttgagggccaggcgctggccggcggcatggaattgacgctgtgctgcgacatcgtcgtggcatcgaccagcgcggtgttcggtttggccgaagccaaacgcgggctggtcgcgattggcggaggctgcttccgcctgccccatcgcataccccacaacatcgcgatggagatgatcatcaccgccgagccgcgttccgccgaagacatgcacagctttggctatgtcaacaaactggtggaaccgggcaaaacccttgaaggggcgatggaatacgcggcccttgtcgtgcgcaacggaccgcttgccacagtggcgtccaaagagatcgctcaccgttccgccacggagcaatggcgcgatgaagacggctggcgcattcaggaagagatcatcaagccggttctagcctctgacgacctcaaagaaggcctcgctgcctttgctgaaaaacgtgaccccgtctggaaaggaaaatga

SEQ ID NO: 6403 - protein, 255 aa, Sulfitobacter sp. EE-36
MSYIKTETDGHVLIITLDRPDARNAFNLAMSEELEATIDHYENDIELRCAIIQANGPTFSAGQDLIAAAKGERSVTKGRGGFGIMGRPPKKPLVAAVEGQALAGGMELTLCCDIVVASTSAVFGLAEAKRGLVAIGGGCFRLPHRIPHNIAMEMIITAEPRSAEDMHSFGYVNKLVEPGKTLEGAMEYAALVVRNGPLATVASKEIAHRSATEQWRDEDGWRIQEEIIKPVLASDDLKEGLAAFAEKRDPVWKGK

SEQ ID NO: 6404 - DNA, 780 bp, Sulfitobacter sp. EE-36
  CDS (1)..(780): transl_table=11
atgagctatcaatatatcaccaccgaaaagaagggtcacatccttgttgtgaccatgaaccgccccgaggtgtacaatgccgtgcacgtcgacatgcataatgaaatggccgattgctgggacgcttttgcagcggatcaggatctttgggtcgcggttctgaccggcgcgggggacaaggcgttctccgcggggaacgacctgaaagccaccgctgccggcgggtccaaggcgacgatgcccgccagcggctttgccggtctgtcctcgcgtttcgatctggaaaagcccatcgtcgcggccgtcaacggtttcgccatgggcggcggatttgaaacggcgctgtcatgcgacattatcctcgcctccgatcaggcgaaattcgccctgcccgaggtcaaggtcggcttctttgccgcggcttccggcgtgcagcgcctgtcgcgctatatcgggcggcttgccgcgcaagagatgatgttcaccggccgcaccatcatggccgatgaggcgctgtcgatgggctgcgtcaacgcggtctaccctgccgaccagctgatggcgaaagcgatggaaaaggccgaagagctgtgcgccgtgtcgccgtcggcggtcaaggccacgaaacgcgtcctgaacgacatgtacaagcgcgacgggatgcaggaaagcatcgcctattcgcgcgaggtgatcgcggacctcagcaaaaccgaagatttcaaggaaggcgtgaacgcctttgtcgaaaaacgcaaacccaactgggtcaataaataa

SEQ ID NO: 6405 - protein, 259 aa, Sulfitobacter sp. EE-36
MSYQYITTEKKGHILVVTMNRPEVYNAVHVDMHNEMADCWDAFAADQDLWVAVLTGAGDKAFSAGNDLKATAAGGSKATMPASGFAGLSSRFDLEKPIVAAVNGFAMGGGFETALSCDIILASDQAKFALPEVKVGFFAAASGVQRLSRYIGRLAAQEMMFTGRTIMADEALSMGCVNAVYPADQLMAKAMEKAEELCAVSPSAVKATKRVLNDMYKRDGMQESIAYSREVIADLSKTEDFKEGVNAFVEKRKPNWVNK

SEQ ID NO: 6406 - DNA, 786 bp, Roseovarius nubinhibens ISM
  CDS (1)..(786): transl_table=11
atgagtgagagcccggtcaagaccgagcggcgggggcatgtgctcgaggtgacgctcgaccggcccaaggccaatgcgatcgacctgcagaccagccgtgcgctgggcgaggtgtttcgcgattttcgggacgatccagagctgcgggtggcgatcatcaccggcgcgggcgaaaagttcttttgccccggctgggatctcaaggccgcggcggatggcgatgcggtggatggcgattacggcgtcggcggctttggcgggctgcaggagctgcgcgggctcaacaagccggtgatcgcggcggtgaatggcatctgttgtggcgggggtctcgaatgggcgctgagcgccgatatcatccttgccgccgaacatgccacattcgccctgccggaaatccggtccggcacggtggccgatgccgcctcgatcaagctgcccaagcgcatcccctatcacatcgcgatggagatgctgctcaccgggcgttggatcgacgcggaagaggcggcgcgctggggcatgatcaaccgcatccacagcgccgagacgctgatggaggaggcgcgggcgctggccgatcatctcgcctcggggccgccgctggtctatgcggcgctcaaggaagtggtgcgcgaggcggaggggatgaatttccaggacgcgatgaaccgcatcaccaagcgccagttcgagacggtcgatattctctatgacagcgaggatcagctcgaaggggcgcgggcctttgccgagaagcgcgacccggtgtggaagggccgctga

SEQ ID NO: 6407 - protein, 261 aa, Roseovarius nubinhibens ISM
MSESPVKTERRGHVLEVTLDRPKANAIDLQTSRALGEVFRDFRDDPELRVAIITGAGEKFFCPGWDLKAAADGDAVDGDYGVGGFGGLQELRGLNKPVIAAVNGICCGGGLEWALSADIILAAEHATFALPEIRSGTVADAASIKLPKRIPYHIAMEMLLTGRWIDAEEAARWGMINRIHSAETLMEEARALADHLASGPPLVYAALKEVVREAEGMNFQDAMNRITKRQFETVDILYDSEDQLEGARAFAEKRDPVWKGR

SEQ ID NO: 6408 - DNA, 768 bp, Oceanicola batsensis HTCC2597
  CDS (1)..(768): transl_table=11
atgagcgccccgctcaccctggagatcgagaaccggatcgccacgatcaccttcgcccggccggacaagctgaatgccatgacgccggagatggccggtctcatgtgggacgccgtccggcagatcaacgccgaggacgaggcccgcgccgtgatcctgaccggcaccggcaaggcattctgcgccggctccgacatatcggacctcgaccgctacgccacgccgtgggatttccgcaaccgtccggaatactgcgacgcgctgcgggccctgcaaaagccctccatcgcggcgatcaacggctacgccatgggcggcgggctggagatggcgctctcctgcgacatccgcatcgccgccgataccgcgaagctcgccgcgcccgagatcaagctgggctggatcggcggcggcgggatgaccgcgctgctggcccattcgatcggcccctcgaacgccgcgatgatggtgatgaccggcgatcccgtcccggccgagagggcgctgcactgggggctggtctccgagatcaccgcccccgaggccctcatgtcccgcgcgaccgagatcgccgcgaccattgccggccgcgcgccgatcgccgcggaaaccgcccgcctgaacctgcaggccgcgtacaacatgccgctggaacaggcggtcgcctacgagcgcgatctgcaggcgatctgttttgcgaccgcggacgccgccgagggccgggccgccttcgccgaaaagcgcgcccccgatttcaaacgccgctga

SEQ ID NO: 6409 - protein, 255 aa, Oceanicola batsensis HTCC2597
MSAPLTLEIENRIATITFARPDKLNAMTPEMAGLMWDAVRQINAEDEARAVILTGTGKAFCAGSDISDLDRYATPWDFRNRPEYCDALRALQKPSIAAINGYAMGGGLEMALSCDIRIAADTAKLAAPEIKLGWIGGGGMTALLAHSIGPSNAAMMVMTGDPVPAERALHWGLVSEITAPEALMSRATEIAATIAGRAPIAAETARLNLQAAYNMPLEQAVAYERDLQAICFATADAAEGRAAFAEKRAPDFKRR

SEQ ID NO: 6410 - DNA, 807 bp, Erythrobacter sp. NAP1; identical to SEQ ID NO: 2760
  CDS (1)..(807): transl_table=11

SEQ ID NO: 6411 - protein, 268 aa, Erythrobacter sp. NAP1; identical to SEQ ID NO: 2761

SEQ ID NO: 6412 - DNA, 762 bp, Erythrobacter sp. NAP1
  CDS (1)..(762): transl_table=11
gtgtccgaagaagtactgaccgaagttcaggacggtgtcctgatcgtcaccatcaaccgtcccgaagccaagaacgccatgaccaaggccgcagccgagggtattgctgcggccatggatcgcctcgatgccgaagacgacctgcgcgtcggcatcctgacgggcgcgggcggcacgttttgctccgggatggacctcaagggcttccttcgcggagagagcccgacggtcgagggtcgcggctttggaggcgttgtgcaggcacctccttccaagccgctgattgccgcggttgaaggctacgcgctcgctggcgggcttgagctcatgatcgcctgcgacctcgtggtggcaagcgctggtgcgaaattcggcattcccgaagccaagcgcggcctcgttgcagcggcgggcggcgtgatgatgctgccggatcagattcctgagcgcatcgccatggagctggccctcacgggtgatttcattgacgcaccgcgcgcatacgagcttggcctgatcaacgaagtgaccgacggctcggccatcgacgcagcgaaggcgcttgcggctcgcatcgctgcaaatggcccgcttgcggttcgggtgtcgaagcaaatcatcaaggaatcgcgcggttgggcgatggaagatcgctacacaaaacaggcccagctcatcgcgccggtcttcgtgtccgaagacgcccgcgaaggcgcagctgccttcgccgaaaagcgcgcgcccaactggaagggcaagtaa

SEQ ID NO: 6413 - protein, 253 aa, Erythrobacter sp. NAP1
MSEEVLTEVQDGVLIVTINRPEAKNAMTKAAAEGIAAAMDRLDAEDDLRVGILTGAGGTFCSGMDLKGFLRGESPTVEGRGFGGVVQAPPSKPLIAAVEGYALAGGLELMIACDLVVASAGAKFGIPEAKRGLVAAAGGVMMLPDQIPERIAMELALTGDFIDAPRAYELGLINEVTDGSAIDAAKALAARIAANGPLAVRVSKQIIKESRGWAMEDRYTKQAQLIAPVFVSEDAREGAAAFAEKRAPNWKGK

SEQ ID NO: 6414 - DNA, 768 bp, Flavobacteria bacterium BBFL7
  CDS (1)..(768): transl_table=11
atgaacaatattctagttgctacagcaaataaaattacaaccattaccattaacagacctaataaactcaatgcattaaataaagaaaccattgcagaattaagtcaagctatagatacggctgaagatgatgagaacaccagagtaatcattcttacgggtagtggagagaaagcttttgtcgctggagcagatattgcagagtttgcagatttttctccagagcaaggaaaagagcttgctgctcatggacaagagatactttttaataaggttgaaaactgttctaagcctgttattgctgcagtaaatggatttgccttaggtggtggacttgagttagcaatgtctgctcattttagaattgctagtgataatgctagagtaggattgccagaagtctctctaggagtcataccgggatatggtggtacacagcgtttaccacaattagtaggtaaaggacgtgctatggaaatgattatgactgcaggaatgatagatgctgcgacggcacattcttatggattagtaaatcacgttgtgacacaagatgaattgatttctacttgcgagaaaattgctggtaaaataatgcgtaatagtccagtagcaataggtgctgcgattgacgcggtaaatgctggttatattgatggagtcgatggttatcaggcagaaattgactgctttggtgcatcttttggaacagacgattttaaagaaggaacgactgcgtttttagagaagagaaaagctgagttttag

SEQ ID NO: 6415 - protein, 255 aa, Flavobacteria bacterium BBFL7
MNNILVATANKITTITINRPNKLNALNKETIAELSQAIDTAEDDENTRVIILTGSGEKAFVAGADIAEFADFSPEQGKELAAHGQEILFNKVENCSKPVIAAVNGFALGGGLELAMSAHFRIASDNARVGLPEVSLGVIPGYGGTQRLPQLVGKGRAMEMIMTAGMIDAATAHSYGLVNHVVTQDELISTCEKIAGKIMRNSPVAIGAAIDAVNAGYIDGVDGYQAEIDCFGASFGTDDFKEGTTAFLEKRKAEF

SEQ ID NO: 6416 - DNA, 768 bp, marine gamma proteobacterium HTCC2143
  CDS (1)..(768): transl_table=11
atgacagcttcaaccgaacaagccgtcctcgtcgaacgtcgtgggcgcgtgatggtgattacactcaaccgtcctgatgcaatgaatgctattaatggtgcgctctctcatgggttgctgaatgctgtgcaggaacttgatgcagacgattcgctgacggcgggggtgattacaggcaacggacgcggtttttgttccggcatggatttgaaagcattttcccgtggcgaagatattggtccgctaacaacatttatccgttctggttgtagcaagcctttgattgctgccattgaaggtttcgcaattgcaggtggctgtgaggttgcattgacctgcgacctgttggtggcttcgaagggcgcgaaaatcggcatacgcgaagttaaagtcggactgtttgctgcagcgggtggcgtgtttcgtttaccgtcaagagttggctatgcaaaagccatggagatggcactcaccggtgaaccaattactgcagagacggcgtttgattgcggtatgttgagtgaattgactgaaaaaggcggcgcacttgatgcagcaatcgcattggcagagcgcatcgctgaaaatgcacctctagcggttgcagcgtcgaaaaccctagtacgcgcagcagcgcagggcatcgatgaagaatcattgtggaagatgcagataccactgcaacaaaaggtgtttgcgtcagacgatgcaaaggaaggccccagagcatttgcagagaaacgagaacccaattggaccggtaagtaa

SEQ ID NO: 6417 - protein, 255 aa, marine gamma proteobacterium HTCC2143
MTASTEQAVLVERRGRVMVITLNRPDAMNAINGALSHGLLNAVQELDADDSLTAGVITGNGRGFCSGMDLKAFSRGEDIGPLTTFIRSGCSKPLIAAIEGFAIAGGCEVALTCDLLVASKGAKIGIREVKVGLFAAAGGVFRLPSRVGYAKAMEMALTGEPITAETAFDCGMLSELTEKGGALDAAIALAERIAENAPLAVAASKTLVRAAAQGIDEESLWKMQIPLQQKVFASDDAKEGPRAFAEKREPNWTGK

SEQ ID NO: 6418 - DNA, 777 bp, marine gamma proteobacterium HTCC2143
  CDS (1)..(777): transl_table=11
atgtcatacgaatattgttctgttgaacgtgaaggcaacctaacgattgtcacattaaatcgcccagaggtgatgaatgccgttcatgctttaatgagtaacgaattggataaagtctggaatgactttgaaaatgatcctgaacagtgggtcgctattgtgaccggagcaggagaacgagccttctcagcgggcaatgatcttaaatacacggcagcgggtggtggtgtaaaaggtcctgacagtggttttgcaggaataacgaatcgcttcagtatgaataaacctgtgatagctgcggttaatggcgtggcaatgggtggtggttttgaaattgctctggcagcggatattattattgcggcagaaaacgcgaagtttgcactgcctgagccccgcgtaggattggctgcgctggctggtggtatgcatcggttaccgcgaatgattccctatcaacaagcgatgggcatgatgatgacaggccgccatgttcccgcagaagagggtttgcgaatgggctttgtgaccgccgttgttgcagagggacaggcgttagcagaagctagaaaatgggcggcgcaaatactggaatgctcgcccatgtctattcgtgcaactaaggaatcggttgttgaagggcttaaacagaaagatgttgagtcggcaatggcggttacttatccggcggttaaggccttgtatggtagtgaggacttgcaggaaggtcccaaagcttttgcagaaaaacgtaagccaaactggaaaggttgttag

SEQ ID NO: 6419 - protein, 258 aa, marine gamma proteobacterium HTCC2143
MSYEYCSVEREGNLTIVTLNRPEVMNAVHALMSNELDKVWNDFENDPEQWVAIVTGAGERAFSAGNDLKYTAAGGGVKGPDSGFAGITNRFSMNKPVIAAVNGVAMGGGFEIALAADIIIAAENAKFALPEPRVGLAALAGGMHRLPRMIPYQQAMGMMMTGRHVPAEEGLRMGFVTAVVAEGQALAEARKWAAQILECSPMSIRATKESVVEGLKQKDVESAMAVTYPAVKALYGSEDLQEGPKAFAEKRKPNWKGC

SEQ ID NO: 6420 - DNA, 795 bp, marine gamma proteobacterium HTCC2080
  CDS (1)..(795): transl_table=11
atgaggggatacgagaaatatcagcacattgcttttgagcgttcaggtggcgtgctgcaagtaacgttgaatcgtccagaggcgctcaatgcgaccgatgagctacttcatcgtgagctctcttgggtgttcgccgacatcgcccgcgataagcaaactcgggcggtggtgttaaccggcgctggcaaagcgttctgcgcgggaggcgatttgaagcacggactgtcgatgaaccgagagcaaaccgacgccatggtggaagagggcagaaaaatcatcctcgatatcctcgaggtaccccaaccaattattgcggcagtaaacggttatgcaatgggacttggcgctactctagcgctgttctccgatattgttgtggctgccgaggaggctgtgtttgccgacacccacgttattgcgggatatgttgcaggagacggtggcgccgcgatttggcctctgcttgtaggcatgcacaacgccaaggagttcctgatgactggtgatcgtctgacggcggaagaagctaaggagctcggtcttattcgccatgttgtgcaggcagctgacctgcttaaagtggctcatgcgaaggctgaaaggcttgccacaggacctaggatggccattgagggtaccaagcaaacactaaactgtttgttgcggcaggcggtcgatgcaactcttgattacggtctgttaagggaaaagcaatgtatgcaggtgagtgaggattgcgaggaggcactctcggcatttgctgagaaacgggagccagtgtttaagggaaattga

SEQ ID NO: 6421 - protein, 264 aa, marine gamma proteobacterium HTCC2080
MRGYEKYQHIAFERSGGVLQVTLNRPEALNATDELLHRELSWVFADIARDKQTRAVVLTGAGKAFCAGGDLKHGLSMNREQTDAMVEEGRKIILDILEVPQPIIAAVNGYAMGLGATLALFSDIVVAAEEAVFADTHVIAGYVAGDGGAAIWPLLVGMHNAKEFLMTGDRLTAEEAKELGLIRHVVQAADLLKVAHAKAERLATGPRMAIEGTKQTLNCLLRQAVDATLDYGLLREKQCMQVSEDCEEALSAFAEKREPVFKGN

SEQ ID NO: 6422 - DNA, 765 bp, marine gamma proteobacterium HTCC2080
  CDS (1)..(765): transl_table=11
atgagtgacgtagttattactgaggtaaacgatggcgtaatgaccatcacgcttaatcgacctgaggcgaaaaatgccgtaaatctggccatggcggaaggcgtcgctgcagccattgatgaactcgatagcaacgacgagattcgtgtggcaattctcacgggttctaacaatacgttttgttccgggatggacctcaaggcgttcgtcagtggtgaggtgccttacatcaagggaagaggctttgctggtttgaccgaatcgccacctgcgaagccgttaattgccgccgttgaaggatatgcattggcgggtgggtgtgagctggcgatggtttgcgatctgatcatagcggcagacacagcaaagtttggtgtccctgaagtgaagcgcggcttggctgctgcagccggaggtttgttgcgcttcccacgacagttgccctatcgggtggccatggagttggcgctgactggcgactttatggatgcaggtcgagctcgagatttgggtttcataaacgaaaccgtgcctgcaggtgaggctgtttctgccgcgcaggcgctggcagcaaagatagcaggtaacggacctctggcagttaagctcagcaaacaggtagtcagagactcgcaggactggagcactgatgaaatgtttggtcgccagcaggacatccttcagccagtatttgtcagtgaagatgctatggaaggggcgatagcttttgctgagaagcgagcgcctaattggaagggccgttga

SEQ ID NO: 6423 - protein, 254 aa, marine gamma proteobacterium HTCC2080
MSDVVITEVNDGVMTITLNRPEAKNAVNLAMAEGVAAAIDELDSNDEIRVAILTGSNNTFCSGMDLKAFVSGEVPYIKGRGFAGLTESPPAKPLIAAVEGYALAGGCELAMVCDLIIAADTAKFGVPEVKRGLAAAAGGLLRFPRQLPYRVAMELALTGDFMDAGRARDLGFINETVPAGEAVSAAQALAAKIAGNGPLAVKLSKQVVRDSQDWSTDEMFGRQQDILQPVFVSEDAMEGAIAFAEKRAPNWKGR

SEQ ID NO: 6424 - DNA, 792 bp, Pseudomonas putida GB-1
  CDS (1)..(792): transl_table=11
atgactttccagcacatcctgttttccatcgaggacggcgttgccctcctttcattgaaccgccccgagcaactgaacagctttaacaccgccatgcacatggaggtgcgcgaagcactcaagcaagtacgccagagcagtgaagcgcgggtgctgttgcttacggctgaaggccggggcttctgcgccggccaggacctgtccgaccgcaacgttgcccccggcgccgaaataccggacctgggcgagtcgatcgacaagttctacaacccgctggtgcgcaccctgcgcgacctgccgctgccagtgatctgtgcggtcaacggcgtggctgccggcgctggcgcaaatatcccgctggcctgcgatctggtgctggccgcccgctccgccagcttcatccaggccttctgcaagatcggcctggtgccggactctggcggcacctggctgctgccgcgcctggttggcatggcgcgggccaaggccctggccatgctgggtgagcgccttggcgccgagcaggcccagcaatgggggctgatccaccgggtggtggatgatgctgcactgcgagacgaagccctcgccctcgcccgccagctcgccacccagcccacctacggcctggccctgatcaagcgcagcctcaatgccagtttcgataatgggtttgacgagcagctggagctggagcgcgacctgcagcgcctggccgggcgcagcgaggactaccgcgaaggcgtgagtgccttcatgaacaagcgcacgccagttttcaaggggcgctga

SEQ ID NO: 6425 - protein, 263 aa, Pseudomonas putida GB-1
MTFQHILFSIEDGVALLSLNRPEQLNSFNTAMHMEVREALKQVRQSSEARVLLLTAEGRGFCAGQDLSDRNVAPGAEIPDLGESIDKFYNPLVRTLRDLPLPVICAVNGVAAGAGANIPLACDLVLAARSASFIQAFCKIGLVPDSGGTWLLPRLVGMARAKALAMLGERLGAEQAQQWGLIHRVVDDAALRDEALALARQLATQPTYGLALIKRSLNASFDNGFDEQLELERDLQRLAGRSEDYREGVSAFMNKRTPVFKGR

SEQ ID NO: 6426 - DNA, 774 bp, Pseudomonas putida GB-1
  CDS (1)..(774): transl_table=11
atgccgcgatatctcgctgtgcaggcgcccgaacacggcgttcagctcattaccttgcaacggcccgaggccttgaatgccctgtgcaccgagctactggcagaactggctgctgcgttacaggcagccgctggcgacgaacagatcggcgctgttgtgattaccggcagcgccaaggcattcgctgcaggtgccgacatccgggaaatggccgagcgcgacctggtcggcatactcaatgatccgcgcgtagcccactggcaaagcatcgcggcattcaccaagccattgattgccgctgtcaatggttacgccttgggtggcggttgcgaactggtgatgtgcgccgacatcgtcatcgctggcaccgatgcccgcttcggccagccagaaatcaacctcggcatcattcccggtgccggcggcacccagcgcctgttgcgtgccgtcggtaagccgctggccatgcagatggttctgaccggtgaagcaatcaccgctcgccacgcccagcaggcgggccttgtcagcgaaatttcccagcccgaacttaccgtcgagcgcgccatgcgggtcgcccgcagcatcgctgccaaggcgccgcttgccgtgcgcctggccaaggaggcgctactgaaggccggtgataccgacctggccagtggcctgcgcttcgaacgccatgcgttcaccttgctggccggtaccgccgaccgggacgaaggcatccgggcctttcaggaaaagcgccaggctcgtttccagggccgctaa

SEQ ID NO: 6427 - protein, 257 aa, Pseudomonas putida GB-1
MPRYLAVQAPEHGVQLITLQRPEALNALCTELLAELAAALQAAAGDEQIGAVVITGSAKAFAAGADIREMAERDLVGILNDPRVAHWQSIAAFTKPLIAAVNGYALGGGCELVMCADIVIAGTDARFGQPEINLGIIPGAGGTQRLLRAVGKPLAMQMVLTGEAITARHAQQAGLVSEISQPELTVERAMRVARSIAAKAPLAVRLAKEALLKAGDTDLASGLRFERHAFTLLAGTADRDEGIRAFQEKRQARFQGR

SEQ ID NO: 6428 - DNA, 774 bp, Pseudomonas putida GB-1
  CDS (1)..(774): transl_table=11
atggcattcgaaaccatcctgttggacatccacggcaaggtcggcctgatcaccctcaaccgcccgcaagccctcaatgcgctgaacgcgcagattgtcggcgagatcaaccaggcccttgaccagctcgagcgtgacccgaatatcggttgcgtggtgctgacaggttcggccaaggcctttgccgctggcgccgacatcaaggaaatggccgaactgcaatacccgcagatctacgtcgacgacctgttcagcgatgctgaccgcattgccaaccggcgcaagccgatcatcgcggcggtctccggcttcgcgctgggcggcggctgcgagttggcgatgatgtgtgactttatcctcgccgccgacaacgccaagttcggtcaaccggaaatcaaccttggcgtgttgccgggcatgggcggtacccagcgtctgacccgtgccgtgggtaaggccaaggccatggaactgtgcctgactggccgcctgatgggggctgaagaggctgagagggctggcttggtggcgcgaatcgtgccgcaggcggagttgctggaagaggcgcttaaggtggctgcgaccattgccagcaaatcgatcccggtgagcatgatggtcaaggagagcgttaaccgagcgtttgaagttaccctcagcgagggcgtgcgctttgaacgccgggtcttccatgcggctttctccactgaagaccaaaaagaaggcatggccgccttcatcgccaagcgcgaggcgcagttcaaggatcgttga

SEQ ID NO: 6429 - protein, 257 aa, Pseudomonas putida GB-1
MAFETILLDIHGKVGLITLNRPQALNALNAQIVGEINQALDQLERDPNIGCVVLTGSAKAFAAGADIKEMAELQYPQIYVDDLFSDADRIANRRKPIIAAVSGFALGGGCELAMMCDFILAADNAKFGQPEINLGVLPGMGGTQRLTRAVGKAKAMELCLTGRLMGAEEAERAGLVARIVPQAELLEEALKVAATIASKSIPVSMMVKESVNRAFEVTLSEGVRFERRVFHAAFSTEDQKEGMAAFIAKREAQFKDR

SEQ ID NO: 6430 - DNA, 795 bp, Pseudomonas putida GB-1
  CDS (1)..(795): transl_table=11
atgaccaccccgtcgtcgtcactgttgagcaacgtcgaagccggcgttgcctggatcaccctcaaccgccccgagcagcgcaacgcgctggatatcccaaccctcaagcaactgcatgccttgctcgacagccataacggcgacccggcggtacgcgtggtggtactcaccggcagcgggcgcagtttctgcgccggcgccgatctggccgaatgggctgccgccgaagccgcaggcaccctggaaagctacggctggaccgaaaccgcccatgctctgatgttgcgcctgcacagcctcgccaaacccaccatcgccgccatcaacggcaccgccgtgggcggtggcatggacctcagcctgtgctgcgacctgcgcatcgccgccgcctcggcgcgtttcaaggccggctacaccagcatgggctacagccccgatgccggcgccagctggcacctgccacggctgatcggcagcgagcaggccaagcgtttgttgttcctcgatgaactgtggggcgccgagcgcgccctggcggctgggctggtcagtgaagtctgtgccgacgagcaactgcccgccgtggccgccgagttggccgggcgcctggcctgcggcccgaccttcgcctttgcgcagaccaagcaactgatgcgtgacggcgcccggcgcaccctggccgagcagctggaagccgagcgccacgccggcctgttgtgcggccgcagccaggatggcgtcgaggcgctgcaagcctcggttgaacgccgcgccccccgtttcatcggccagtaa

SEQ ID NO: 6431 - protein, 264 aa, Pseudomonas putida GB-1
MTTPSSSLLSNVEAGVAWITLNRPEQRNALDIPTLKQLHALLDSHNGDPAVRVVVLTGSGRSFCAGADLAEWAAAEAAGTLESYGWTETAHALMLRLHSLAKPTIAAINGTAVGGGMDLSLCCDLRIAAASARFKAGYTSMGYSPDAGASWHLPRLIGSEQAKRLLFLDELWGAERALAAGLVSEVCADEQLPAVAAELAGRLACGPTFAFAQTKQLMRDGARRTLAEQLEAERHAGLLCGRSQDGVEALQASVERRAPRFIGQ

SEQ ID NO: 6432 - DNA, 843 bp, Pseudomonas putida GB-1
  CDS (1)..(843): transl_table=11
atgaacctttcacccgcaggagtgccgcccgtgaccgagtacagtgcattcaaggtcgaactgaccgacaacatcgcccacgttcagatcaaccgcccggaaaaggtcaacgcgatgaacgcggccttctgggatgagatcgtcgaaatcttccagtggatcgacgacaccgatgccgtgcgcgccgtggtagtcagcggtgccggcaagcacttctctgccggtatcgacctgatgatgctggcgtccctggccgggcagatgggcaaggacgtgggccgcaatgcgcgtttcctgcgcaagaccatccagcgcctgcaggcctcgttcactgccgtggacaagtgccgcaagccagtactggccgccgtgcagggctattgcatcggcggcgctatcgaccttgtctcggcctgcgacatgcgttactgcagcgttgatgcgcagttttcgatcaaggaaatcgacatgggcatggcggccgatgtcggtacactgcaacgtttgccacgtatcatcggcgacggcatgatgcgtgagctggccttcaccgggcgcaatgtggcggccgacgaggcgctgcgcataggcctggtcaaccgggtttatgatgatcaggccgcactgatggacggtgtctttgccatcgcccgcgaaattgccgcaaaatcgccaatcgccgtggccggcaccaaggaaatgctcagctacatgcgtgaccatcgcatcgacgatggcctggactacatcgccacctggaacgccgcgatgctgcaatccgaagacttgcgcgtggccgtggcggcgcacatgagcaaacaaaaaccgacgttcgccgactga

SEQ ID NO: 6433 - protein, 280 aa, Pseudomonas putida GB-1
MNLSPAGVPPVTEYSAFKVELTDNIAHVQINRPEKVNAMNAAFWDEIVEIFQWIDDTDAVRAVVVSGAGKHFSAGIDLMMLASLAGQMGKDVGRNARFLRKTIQRLQASFTAVDKCRKPVLAAVQGYCIGGAIDLVSACDMRYCSVDAQFSIKEIDMGMAADVGTLQRLPRIIGDGMMRELAFTGRNVAADEALRIGLVNRVYDDQAALMDGVFAIAREIAAKSPIAVAGTKEMLSYMRDHRIDDGLDYIATWNAAMLQSEDLRVAVAAHMSKQKPTFAD

SEQ ID NO: 6434 - DNA, 783 bp, Marinobacter sp. ELB17
  CDS (1)..(783): transl_table=11
atgagtgaatttctattgttggagcgtcgcggggcggtgcttgagattactctcaaccgccctaaagcaaacaccattgacatccctctgagtctggaactgggtcgtgtctttgcagaatttcgcgatgatcgacaattacgggttgccatcatgaccggtgctggcgatcgtttttattctgcaggctgggatctgaatgcggtagcccagggcgaggaatatattggcgattttggggaaggtggctttgccggtttccccgaaatgaaagatctcaataaaccggtaatttgtgccgtcaatggtatggctgtgggtgctgggttcgaaatgctgatgcgggctgattttgtggtggccgctgaacacgctgagtttttgctgccggaggtgcgtatcggcattgcgccggatgttggcacttttatgttgcccaagctactgacacgtcaacgtgcaatggaagtgctgatgactgggcgccgtttttcggcccaacgcatggcggattggggtctggtgaatcaggtagttccgcaatcagaactgatgcccacggcccggtcgtgggcagacactctgcttaaggctgcgcctttatctttggcagcgataaaagaagtggttaacagtaccgaaaccagcacctttgccgaatgctacgggcgcttacgcaaagacacctggccggcgttcaaaaccatgctggaaagcgacgattcgatggaaggtgccaaagcatttggtgaaggccgcgaaccccgctgggttggcgaatag

SEQ ID NO: 6435 - protein, 260 aa, Marinobacter sp. ELB17
MSEFLLLERRGAVLEITLNRPKANTIDIPLSLELGRVFAEFRDDRQLRVAIMTGAGDRFYSAGWDLNAVAQGEEYIGDFGEGGFAGFPEMKDLNKPVICAVNGMAVGAGFEMLMRADFVVAAEHAEFLLPEVRIGIAPDVGTFMLPKLLTRQRAMEVLMTGRRFSAQRMADWGLVNQVVPQSELMPTARSWADTLLKAAPLSLAAIKEVVNSTETSTFAECYGRLRKDTWPAFKTMLESDDSMEGAKAFGEGREPRWVGE

SEQ ID NO: 6436 - DNA, 783 bp, Marinobacter sp. ELB17
  CDS (1)..(783): transl_table=11
atgtcggaatatttacacgctgttcgtaacggtgaaatttttgagataaccctggataaacccaaaggcaatgcggtcagcgcagcgctgagtcgtgagatgggcaaattatttgcgcaatttcgtgacgacccatcgctacgggtggccattcttaccggcgccggggagaagtttttctgtggtggctgggacttgagttcggtcgcagacggtgaagattacatcggtgactttggcgaaggcggttttggtggctttattgaattgccgaatctaaacaaaccggtgatctgcgcgatcaatggttatgccatcggtgccggttttgaaatgctgctgcgttcagactttgtgattgccgatgaaagtgcgaagttctggttaccagaggcgcaactaggcgtggctcctgatgtggctaccttcttgctgccgaaattgctgccacggcaaaaagcctttgccattctgatgaccgcacaacgtttgtctgcccaggagcttatggaccttggtttggtgaataccgtcgtgcccaagggcgaagccatgaccgccgcccgtgagttggcacacgaactgatcaaggctgcgccactttcgttggcggctattaaagaagcggtcgaactgactgaaggcctgaccttcgctgaaagctacgcggccctgcgggcaaaagagtggccggcgtttatggccatgcttgaaagtagtgatgcccaagagggcgccaatgcattccttgaaggccgtgcccctgagtggactggacaataa

SEQ ID NO: 6437 - protein, 260 aa, Marinobacter sp. ELB17
MSEYLHAVRNGEIFEITLDKPKGNAVSAALSREMGKLFAQFRDDPSLRVAILTGAGEKFFCGGWDLSSVADGEDYIGDFGEGGFGGFIELPNLNKPVICAINGYAIGAGFEMLLRSDFVIADESAKFWLPEAQLGVAPDVATFLLPKLLPRQKAFAILMTAQRLSAQELMDLGLVNTVVPKGEAMTAARELAHELIKAAPLSLAAIKEAVELTEGLTFAESYAALRAKEWPAFMAMLESSDAQEGANAFLEGRAPEWTGQ

SEQ ID NO: 6438 - DNA, 798 bp, Erythrobacter sp. SD-21
  CDS (1)..(798): transl_table=11
atgagcccagaacccgcaagctacgaaaccatcaccgtcgaacagcgtgacgcggttacgctgatcaccttgaaccgccccaaggcgctcaacgcactcaattcgaaagtgctcgaggaattgatcgaggctttggccgcctaccaggccgacagcagccagctgtgcgcagtgcttaccggctcgggcgacaaggcctttgccgccggcgccgacatcaaggaaatgagcgagaaggacgcggccgacttctatctcgacgatttctttgcgccctggaccagcgagatcgtgaaaaagacccgcaagccatggatcgctgcggtcaacggcttcgcgctcggcggcgggtgcgaacttgcgatgatgtcggacttcatcatcgcttcggaaaacgccaagttcggtcagcccgaaatcaagctaggcgttgcgccgggcatgggcggatcgcagcgcctcaccaaggccatcggcaaatcgaaagccatggaaatgtgcctgacgggccgcatgatgggcgccgaggaagccgaacgcagtaacctcgtcgcgcgcgtggtgccgcatgacgatttgctcgaagacgccctgaagaccgcggcccagattgcttcgatgccaccgatggccgccatcgcgaacaaggagatggtcaacgccgccttcgaaaccagtctcgaccagggcctgatcatcgaacgccgcatcttccaaatcctcaccacgagcgaggacaagaaggaagggatggccgccttcgtcgaaaagcgcgagggcaagtggactgggaggtaa

SEQ ID NO: 6439 - protein, 265 aa, Erythrobacter sp. SD-21
MSPEPASYETITVEQRDAVTLITLNRPKALNALNSKVLEELIEALAAYQADSSQLCAVLTGSGDKAFAAGADIKEMSEKDAADFYLDDFFAPWTSEIVKKTRKPWIAAVNGFALGGGCELAMMSDFIIASENAKFGQPEIKLGVAPGMGGSQRLTKAIGKSKAMEMCLTGRMMGAEEAERSNLVARVVPHDDLLEDALKTAAQIASMPPMAAIANKEMVNAAFETSLDQGLIIERRIFQILTTSEDKKEGMAAFVEKREGKWTGR

SEQ ID NO: 6440 - DNA, 777 bp, Erythrobacter sp. SD-21
  CDS (1)..(777): transl_table=11
atggagagagcgagcatgtcggatgatgtcctgaccgaagtcgatgagggcgtattgatcgtcacgatcaaccgtcccgaagccaaaaatgcgatgaacaaggccgcggccgaagggatcgcggcggcgatggaccggctggatgccgaggatgacctgcgcgtcggcatcctcaccggcgcgggcggcaccttctgttcgggcatggacctcaagggcttcctgcgcggcgaatcgcccagcatcaaaggccgcgggttcggcggcgtggtgcaggctccgccgaagaagccgctgatcgccgccgtcgaaggctatgcgctggccggtgggctcgaactgatgatcgcctgcgacctcgtcgtcgcgcacaaggatgcaaaattcggcattccggaagccaagcgcggcctcgtggcggcggctggcggggttatgatgctgcccgaccagatccccgagcgcgttgccatggagctggcgctgacgggcgatttcatcggcgccgaccgcgcatatgaactgggcctcatcaaccgcgtcaccgacggttcggcgctcgacggggcgaaggcgctggctgccagcattgccgccaacggcccgctggcggtgcgcgtgtccaagcagatcatgaaggaatcgcgcggctgggcgatggacgagcgctacgacaagcaggcgcagctcatcggtccggtcttcgtctcggaagacgcgcgcgaaggcgccgccgcctttgccgaaaagcgcaagcccaactggaaggggaagtaa

SEQ ID NO: 6441 - protein, 258 aa, Erythrobacter sp. SD-21
MERASMSDDVLTEVDEGVLIVTINRPEAKNAMNKAAAEGIAAAMDRLDAEDDLRVGILTGAGGTFCSGMDLKGFLRGESPSIKGRGFGGVVQAPPKKPLIAAVEGYALAGGLELMIACDLVVAHKDAKFGIPEAKRGLVAAAGGVMMLPDQIPERVAMELALTGDFIGADRAYELGLINRVTDGSALDGAKALAASIAANGPLAVRVSKQIMKESRGWAMDERYDKQAQLIGPVFVSEDAREGAAAFAEKRKPNWKGK

SEQ ID NO: 6442 - DNA, 783 bp, unidentified eubacterium SCB49
  CDS (1)..(783): transl_table=11
atgagtttttcaaatattctaagtacatctactaacggaatcgcaaccatcacgattaacagaccttctaagttaaacgctttaaatagtgtcacgattaaagagttgcacgatgcttttgacgcggcagatgaagatcaaagcgttaaagtgattattattacaggtagtggtgagaaagcttttgttgcaggagcagacatcagtgagtttgcagattttagcgaagcagaaggcggaaaactagcggcgcaagggcaagctttattgtttgattttgtcgcaaatttaagcactccagttattgcagccgtaaacggttttgcattgggtggtggtcttgagttagcaatgtcagcacattttagagtagccagtgataacgcaaaaatgggattgccagaagtgtctctaggagtgattcctggatatggaggtacacaacgcttaccacaattagtaggtaaagggcgtgctatggaaatgataatgaccgcaggaatgattgatgcaaacaaagcattagattatggcttagtaaaccacgtaactacactagaagaacttatcccttttgtagaaaaaatagcaagtaaaattatgcgcaactcgccagttgctataagtgccgctatttctgcaattaacgcaggctttgaaaatggcgtagatggttttaaagccgaaataacagcgtttggtaactgttttggtaccgaagactttgcagaaggaacacaagcatttttaaacaaaagaaaagcagaatttcctggaaaatag

SEQ ID NO: 6443 - protein, 260 aa, unidentified eubacterium SCB49
MSFSNILSTSTNGIATITINRPSKLNALNSVTIKELHDAFDAADEDQSVKVIIITGSGEKAFVAGADISEFADFSEAEGGKLAAQGQALLFDFVANLSTPVIAAVNGFALGGGLELAMSAHFRVASDNAKMGLPEVSLGVIPGYGGTQRLPQLVGKGRAMEMIMTAGMIDANKALDYGLVNHVTTLEELIPFVEKIASKIMRNSPVAISAAISAINAGFENGVDGFKAEITAFGNCFGTEDFAEGTQAFLNKRKAEFPGK

SEQ ID NO: 6444 - DNA, 996 bp, Oryza sativa subsp
  CDS (1)..(996)
atggacgcggcggggaggaggctcgcccgcgtcacggcccacctcctgcccagctccctcccgctcccgctcgcctccgcccctaccctcgcgccttcccccgccgcgtcgccagcgtcggacagctaccgacgggtccacggcgacgtgccgtcggagcccccggagtggcgcgcggcgacggacgagtccgggaagggcttcgtggacatcctctacgacaaggccgtcggcgagggcatcgccaagatcacaataaaccgccctgatagaaggaatgcattccgacccctgaccgtgaaggagcttatgcgtgctttcgaggatgctagagatgatagttcaatcggagtcatcatactaacagggaaggggacccagtccttctgtagcggcggtgaccaggcgttaagggatgctgatggatatgttgattttgatagctttggcaggctcaacgtcctagacctccaggtgcaaatacggcgccttccaaagcctgttatagcaatggttgctggttatgctgttggaggaggccatgtgttgcacatggtgtgtgatctaacgattgcagctgacaatgcaatttttgggcagacaggtcctaaggttggaagcttcgatgctggctatggctcttcaattatgtctcggttggtaggaccaaagaaagctcgtgagatgtggtttctgtcacggttctacacagctgatgaggcagacagaatgggtctcgtcaatgtagtagtaccactcgctgatttggagcgagaaacggtgaaatggtgccgaaaaatcttgaggaacagtccaacagccatccgggtgctgaaatctgcactcaatgcagctgatgatggccatgctggccttcaggagctcggtggcaatgcgacactgatcttctatggaactgaagaggcaaaagaaggcaaaaatgcatacatggagcgacggcgccctgatttctcaaagttccctcggaagccttaa

SEQ ID NO: 6445 - protein, 331 aa, Oryza sativa subsp
MDAAGRRLARVTAHLLPSSLPLPLASAPTLAPSPAASPASDSYRRVHGDVPSEPPEWRAATDESGKGFVDILYDKAVGEGIAKITINRPDRRNAFRPLTVKELMRAFEDARDDSSIGVIILTGKGTQSFCSGGDQALRDADGYVDFDSFGRLNVLDLQVQIRRLPKPVIAMVAGYAVGGGHVLHMVCDLTIAADNAIFGQTGPKVGSFDAGYGSSIMSRLVGPKKAREMWFLSRFYTADEADRMGLVNVVVPLADLERETVKWCRKILRNSPTAIRVLKSALNAADDGHAGLQELGGNATLIFYGTEEAKEGKNAYMERRRPDFSKFPRKP

SEQ ID NO: 6446 - DNA, 810 bp, Oryza sativa subsp
  CDS (1)..(810)
atgcggcgcctcctcgccgcctccggccgctgcgctccggcgacccgcacccaccatgggctcttcgcgcgcgccatccagatcttggcgccgccggatcccgtcagtctccacaagctctcggcacccgactgcggaatcgtagagctgaggctggagcgtccggaggtcaagaactccatcaactgggaagccatgaggctgctgcggggtgtggtcgagaaggttgaggctgacgacaccgtgaaggtcgtcctggtcacgagctccgtgcctggagttttctgcgcaggcgccgatctcaaggcactatctattccaacaattgctgtcattgaaggagctgctttgggtggtgggctagaactggcactttcatgcgacctgcgtatatgtggagaaaatgcaactcttggactgccagagacaggacttgctatcattcctggagctgggggcacacagcgtcttcctaggattgttggaaggtccagagcgaaggagatgatattcaccggccgtagatgtaatgcaactgaagctgtaatgatgggactcgcaaactactgcgttccagcaggggaggctcatgaaaaagcccttgaacttgcccgcgagatagcccagaaagggcctctggggataagaatggccaagaaggccattgatcaagggatgcaggcagcagacatgccgtccgcgttggccgtcgaaggggagtgctacgagcagctgctgcacacggaggatcgccttgagggcctagccgcattcgccgagaggaggaaacctgtatactcaggaaagtag

SEQ ID NO: 6447 - protein, 269 aa, Oryza sativa subsp
MRRLLAASGRCAPATRTHHGLFARAIQILAPPDPVSLHKLSAPDCGIVELRLERPEVKNSINWEAMRLLRGVVEKVEADDTVKVVLVTSSVPGVFCAGADLKALSIPTIAVIEGAALGGGLELALSCDLRICGENATLGLPETGLAIIPGAGGTQRLPRIVGRSRAKEMIFTGRRCNATEAVMMGLANYCVPAGEAHEKALELAREIAQKGPLGIRMAKKAIDQGMQAADMPSALAVEGECYEQLLHTEDRLEGLAAFAERRKPVYSGK

SEQ ID NO: 6448 - DNA, 990 bp, Oryza sativa subsp
  CDS (1)..(990)
atgcgcatcctccggggaatcctcgccgtctccggccacctcgccggccgccgcgcgccggcgaacaacgtccacctggcactcttctcccgcgccctccaaatcctcgcccagcaggagcccgtccgcctccagaagctctcggcgcccgactccgggatcgtggagatgaggctggagcggccggaggccaggaacgccatcgggagggagatgctccaggggttgcggagcgcgatcgagaaggtgaaggctgacgcgacggcgaacgtcgtgctgctggcgagctccgtcccgaaggttttctgcgctggcgctgatctcaaggaaaggaggttaatgagcccttgcgaagttcgcgaatttgtcaattccctaagatctacattcctgtcctttgaggcattgtcaattcctacaattgccattgttgagggagctgcttttggcggtgggttagaattggctctttcttgtgatctccgtatatgtggggaaaatgcaacatttagcttgccagaaactggccttgctattattcctgggtatgtgttcaagatggcgctttacttttctgggggaacgcagcgtcttcctaggattgttggaaagtccagagcaaaggaattaatattcactggtcgtagattcgatgcagtagaagctgtaaccatgggtaaggttggcctggcgccttcttttttgagaggagtcttgttacattttatttctacaggagtagtaaactactgtgttcccgctggggaggcttataaaagggctcttgaacttgcccaggagataaatcagaaaggtccgttagcgataagaatggctaagaaggccatcaatcaaggcatggaggtagatctgtccgccggattggctgtcgaagaagaatgctacgagcaagttctgcacactcaagatcgtcttgaaggtctagctgcatttgctgagaaaaggaaacctgtatacacagggaaataa

SEQ ID NO: 6449 - protein, 329 aa, Oryza sativa subsp
MRILRGILAVSGHLAGRRAPANNVHLALFSRALQILAQQEPVRLQKLSAPDSGIVEMRLERPEARNAIGREMLQGLRSAIEKVKADATANVVLLASSVPKVFCAGADLKERRLMSPCEVREFVNSLRSTFLSFEALSIPTIAIVEGAAFGGGLELALSCDLRICGENATFSLPETGLAIIPGYVFKMALYFSGGTQRLPRIVGKSRAKELIFTGRRFDAVEAVTMGKVGLAPSFLRGVLLHFISTGVVNYCVPAGEAYKRALELAQEINQKGPLAIRMAKKAINQGMEVDLSAGLAVEEECYEQVLHTQDRLEGLAAFAEKRKPVYTGK

SEQ ID NO: 6450 - DNA, 990 bp, Oryza sativa subsp
  CDS (1)..(990)
atgcgcatcctccggggaatcctcgccgtctccggccacctcgccggccgccgcgcgccggcgaacaacgcccacctggcactcttctcccgcgccctccaaatcctcgcccagcaggagcccgtccgcctccagaagctctcggcgcccgactccgggatcgtggagatgaggctggagcggccggaggccaggaacgccatcgggagggagatgctccaggggttgcggagcgcgatcgagaaggtgaaggctgacgcgacggcgaaagtcgtgctgctggcgagctccgtcccgaaggttttctgcgctggcgctgatctcaaggaaaggaggttaatgagcccttgcgaagttcgcgaatttgtcaattccctaagatctacattcctgtcctttgaggcattgtcaattcctacaattgccattgttgagggagctgcttttggcggtgggttagaattggctctttcttgtgatctccgtatatgtggggaaaatgcaacatttagcttgccagaaactggccttgctattattcctgggtatgtgttcaagatggcgctttacttttctgggggaacgcagcgtcttcctaggattgttggaaagtccagagcaaaggaattaatattcactggtcgtagattcgatgcagtagaagctgtaaccatgggtaaggttggcctggcgccttcttttttgagaggagtcttgttacattttatttctacaggagtagtaaactactgtgttcccgctggggaggcttataaaagggctcttgaacttgcccaggagataaatcagaaaggtccgttagcgataagaatggctaagaaggccatcaatcaaggcatggaggtagatctgtccgccggattggctgtcgaagaagaatgctacgagcaagttctgcacactcaagatcgtcttgaaggtctagctgcatttgctgagaaaaggaaacctgtatacacagggaaataa

SEQ ID NO: 6451 - protein, 329 aa, Oryza sativa subsp
MRILRGILAVSGHLAGRRAPANNAHLALFSRALQILAQQEPVRLQKLSAPDSGIVEMRLERPEARNAIGREMLQGLRSAIEKVKADATAKVVLLASSVPKVFCAGADLKERRLMSPCEVREFVNSLRSTFLSFEALSIPTIAIVEGAAFGGGLELALSCDLRICGENATFSLPETGLAIIPGYVFKMALYFSGGTQRLPRIVGKSRAKELIFTGRRFDAVEAVTMGKVGLAPSFLRGVLLHFISTGVVNYCVPAGEAYKRALELAQEINQKGPLAIRMAKKAINQGMEVDLSAGLAVEEECYEQVLHTQDRLEGLAAFAEKRKPVYTGK

SEQ ID NO: 6452 - DNA, 777 bp, Magnetospirillum gryphiswaldense
  CDS (1)..(777): transl_table=11
atgccctacgaaaatatcatcgtcgaaacccgcggccaggtcggcctgatcaccttgaaccgccccaaggcgctgaacgccttgtgcgccgcgctgatcaaggaattgggccaggcgcttgacgccttcgaggccgatggcgaaatcggcgccgtggtgctgaccggctcggaaaaggccttcgccgccggggccgacatcaaggaaatgcagtccaagacctatatggacgcctatctggccgatttcatcaccaatggctgggaacgcatcaccacctgccgcaagccgatcatcgccgccgtcgccggctatgccctgggcggcggctgtgaagtgtcgatgatgtgcgatttcatcctggccgccgacaatgccaagttcggtcagccggaaatcaccatcggcaccattcctggtgccggcggcacccagcgcctgacccgcgccgtcggcaaggccaaggccatggaaatgtgcctgaccgggcgcatgatggacgccgccgaggccgagcgcgccggtctggtcagccgcgtcattcccgccgccgacctgcttgacgaagccttgaaggtggccgaccgcatcgcgtcgatgtcccgtccggtggtcatgctggccaaggaatcggtcaacgccgccttcgagaccaccctggcccagggcatcaagttcgagcgccgtctgttccattccaccttcgcctgcgaagaccagaaggaaggcatggccgctttcgccgaaaagcgcagcccggtgttcaagaaccgctga

SEQ ID NO: 6453 - protein, 258 aa, Magnetospirillum gryphiswaldense
MPYENIIVETRGQVGLITLNRPKALNALCAALIKELGQALDAFEADGEIGAVVLTGSEKAFAAGADIKEMQSKTYMDAYLADFITNGWERITTCRKPIIAAVAGYALGGGCEVSMMCDFILAADNAKFGQPEITIGTIPGAGGTQRLTRAVGKAKAMEMCLTGRMMDAAEAERAGLVSRVIPAADLLDEALKVADRIASMSRPVVMLAKESVNAAFETTLAQGIKFERRLFHSTFACEDQKEGMAAFAEKRSPVFKNR

SEQ ID NO: 6454 - DNA, 915 bp, Vitis vinifera
  CDS (1)..(915)
  misc_feature (804)..(804): r is g or a
atgggtgtgttcgctatatctctctatcaccactgccgcagaaatttctcattcaactaccattaccagagttgtagaactctcatattgcagtctgcttttgaatcagttagagtccagagactttcccacgacgattctgaaatccaatctgattcaactaccgaactgagtatttttccaggtattgttgaggttcacttggatcggcctgaagccaagaatgccattgggaaggagatgctgagaggcttgcaaaacatttttgaagctattaacagagacgcgtctgctaatgttgtcatgctaagtagttcagttcccagggtattctgtgcaggtgctgatttgaaggggctttacaggtgtaaagaatgggcctttcttcgtgaggaaattgtagaaactagaaaggcactccatgttcctactattgctgttattgaaggagcagcactgggtggtgggctagaaatggctctatcatgtgatcttcggatttgtggagaagatgcggtattgggcttaccagaaacaggacttgctataattcctggggctggtggaactcaaagactttcaagattggttggaaaatcaattgcaaaggaactcatattcactggtcggaaagttggtggcagggatgcaatgtcagtaggattagtcaattactgtgttcctgctggtgaagctcatttgaaggcacttgaaattgctcagcatataaatcagaagggtccattagcattgcggatggcaaaacgagctatcaatgaggggctcgagttagatatggaatcrgctttggcattggaagaagagtgttatgaacaacttctgaacacaaaagatcgcttagaaggtttggcagcctttgccgagaagcggaagcccagatataatggtgaataa

SEQ ID NO: 6455 - protein, 304 aa, Vitis vinifera
MGVFAISLYHHCRRNFSFNYHYQSCRTLILQSAFESVRVQRLSHDDSEIQSDSTTELSIFPGIVEVHLDRPEAKNAIGKEMLRGLQNIFEAINRDASANVVMLSSSVPRVFCAGADLKGLYRCKEWAFLREEIVETRKALHVPTIAVIEGAALGGGLEMALSCDLRICGEDAVLGLPETGLAIIPGAGGTQRLSRLVGKSIAKELIFTGRKVGGRDAMSVGLVNYCVPAGEAHLKALEIAQHINQKGPLALRMAKRAINEGLELDMESALALEEECYEQLLNTKDRLEGLAAFAEKRKPRYNGE

SEQ ID NO: 6456 - DNA, 1011 bp, Vitis vinifera
  CDS (1)..(1011)
  misc_feature (195)..(195): w is a or t
  misc_feature (643)..(643): k is g or t
atggcccaaattgccaacaaggacctcaacgccaacgcccgcagaagactcgcttctgtcgcccaccacctcactccgcttcattccactactcccaattgctcttcgcttgggttccataccacctccgccccagacagctaccgccgtgtacacggtgaggtccccactcacgacgttacttggaatcccgcwtgcgatgagtccggcaaggcgttcaccgacattatctacgagaaagcggtcggagaagccattgccaagattacgattaaccggccagagagaagaaatgccttcagacccaatacggtaaaggagctcattcgcgcattcaatgatgccagagatgatagttcagtgggagtcatcatctttactgggaaggggaccaaggcattttgtagtggtggggatcaagcatttagaggcagagacggctatgctgatcatgatgattttggtcgcctcaatgttctagatttacagatgcagattcggcgtcttccaaaacccgtcattgcaatggtagcaggttatgccgttggagggggacatgtgttgcacatggtctgtgatctcacaattgctgcagataatgccatttttggtcagactggtcctaaggttggaagctttgatkctgggtatggaagttccatcatgtcccgtttgattgggcctaagaaagcacgtgaaatgtggtttacggcaaggttctacacagcttcagaggcagagaaaatgggtcttgtcaatattgttgtaccattggagaatttagaaaaagagacagttaaatggtgtagggagattctcaggaacagcccaactgcaatccgggtgctgaaatcagctcttaatgcagttgatgatggccatgctggactccaggagcttggtggaaatgctaccttcatattttatggcaccgaggaaggtaacgaggggaagacagcatacttggaacgacggcccccagacttctcaaaatttccccgacgaccttga

SEQ ID NO: 6457 - protein, 336 aa, Vitis vinifera
  misc_feature (215)..(215): The Xaa at location 215 stands for Ala, or Ser.
MAQIANKDLNANARRRLASVAHHLTPLHSTTPNCSSLGFHTTSAPDSYRRVHGEVPTHDVTWNPACDESGKAFTDIIYEKAVGEAIAKITINRPERRNAFRPNTVKELIRAFNDARDDSSVGVIIFTGKGTKAFCSGGDQAFRGRDGYADHDDFGRLNVLDLQMQIRRLPKPVIAMVAGYAVGGGHVLHMVCDLTIAADNAIFGQTGPKVGSFDXGYGSSIMSRLIGPKKAREMWFTARFYTASEAEKMGLVNIVVPLENLEKETVKWCREILRNSPTAIRVLKSALNAVDDGHAGLQELGGNATFIFYGTEEGNEGKTAYLERRPPDFSKFPRRP

SEQ ID NO: 6458 - DNA, 1011 bp, Vitis vinifera
  CDS (1)..(1011)
atggcccaaattgccaacaaggacctcaacgccaacgcccgcagaagactcgcttctgtcgcccaccacctcactccgcttcattccactactcccaattgctcttcgcttgggttccataccacctccgccccagacagctaccgccgtgtacacggtgaggtccccactcacgacgttacttggaatcccgcatgcgatgagtccggcaaggcattcaccgacattatctacgagaaagccgtcggagaagccattgccaagattacgattaaccggccagagagaagaaatgccttcagacccaatacggtaaaggagctcattcgcgcattcaatgatgccagagatgatagttcagtgggagtcatcatctttactgggaaggggaccaaggcattttgtagtggtggggatcaagcatttagaggcagagacggctatgctgatcatgatgattttggtcgcctcaatgttctagatttacagatgcagattcggcgtcttccaaaacccgtcattgcaatggtagcaggttatgccgttggagggggacatgtgttgcacatggtctgtgatctcacaattgctgcagataatgccatttttggtcagactggtcctaaggttggaagctttgattctgggtatggaagttccatcatgtcccgtttgattgggcctaagaaagcacgtgaaatgtggtttacggcaaggttctacacagcttcagaggcagagaaaatgggtcttgtcaatattgttgtacaattggagaatttagaaaaagagacagttaaatggtgtagggagattctcaggaacagcccaactgcaatccgggtgctgaaatcagctcttaatgctgttgatgatggccatgctggactccaggagcttggtggaaatgctaccttcatattttatggcaccgaggaaggtaacgaggggaagacagcatacttggaacgacggcccccagacttctcaaaatttccccgacgaccttga

SEQ ID NO: 6459 - protein, 336 aa, Vitis vinifera
MAQIANKDLNANARRRLASVAHHLTPLHSTTPNCSSLGFHTTSAPDSYRRVHGEVPTHDVTWNPACDESGKAFTDIIYEKAVGEAIAKITINRPERRNAFRPNTVKELIRAFNDARDDSSVGVIIFTGKGTKAFCSGGDQAFRGRDGYADHDDFGRLNVLDLQMQIRRLPKPVIAMVAGYAVGGGHVLHMVCDLTIAADNAIFGQTGPKVGSFDSGYGSSIMSRLIGPKKAREMWFTARFYTASEAEKMGLVNIVVQLENLEKETVKWCREILRNSPTAIRVLKSALNAVDDGHAGLQELGGNATFIFYGTEEGNEGKTAYLERRPPDFSKFPRRP

SEQ ID NO: 6460 - DNA, 828 bp, Vitis vinifera
  CDS (1)..(828)
atggaaaactacaaaaccctagaaattgttcagagaagccctaaatcttcagttttccacctcaatctcaaccgtccttctctccgaaatgctctctccctcgacttcttctcagagtttcccaaagccctcgattccctcgaccaaaaccctaacgtaagcgtcattattctctccggaaacggagcccatttctgctccggcatcgacctaaaagtcttggactccatctccgaacgttcccaatccagtgaccgcggccgcaccggggagaggctccgacggcatattaagttcttgcaggatgccatcacggccatcgagcactgccggaagccggtgatcgccgggatccacggagcgtgcatcggcgctgggattgatgttgtgacggcttgtgacatcaggttttgtacggaggacgcattcttctccgtgaaagaggtggatctggcgatcactgccgatgtcggtacgcttcagcggctcccgagcatcgttgggtacggtaacgcggtcgaattggcgctgactggaaggcgattttcgggctctgaggcgaaatcgttgggtctggtttctacggtttttgcctccaaggaagccatggatgaaggcataagactagttgcagaaggaattgcagccaagtctcctcttgctgtcaccgggacaaaagcagtgttactaagaggtcgagatctcactgtggatcaaggattagattatgttgcaacttggaactccggcatgcttttatctggtgatttagccgaagccgtctcagctcaaatccagaagaggaagcctgtttttgccaagctctga

SEQ ID NO: 6461 - protein, 275 aa, Vitis vinifera
MENYKTLEIVQRSPKSSVFHLNLNRPSLRNALSLDFFSEFPKALDSLDQNPNVSVIILSGNGAHFCSGIDLKVLDSISERSQSSDRGRTGERLRRHIKFLQDAITAIEHCRKPVIAGIHGACIGAGIDVVTACDIRFCTEDAFFSVKEVDLAITADVGTLQRLPSIVGYGNAVELALTGRRFSGSEAKSLGLVSTVFASKEAMDEGIRLVAEGIAAKSPLAVTGTKAVLLRGRDLTVDQGLDYVATWNSGMLLSGDLAEAVSAQIQKRKPVFAKL

SEQ ID NO: 6462 - DNA, 804 bp, Amycolatopsis orientalis
  CDS (1)..(804): transl_table=11
atgagctacacccgggtgcggtacgagaagaaggatcacgtcgcctgcgtgacgatggaccggcccgacgtgctgaacgcgatggaccggcggatgcacacggagctcgccgagatctgggatgacgtcgaggccgatgacgacatcagggcggttgtactgaccggcgcgggaaatcgcgcgttcaccgtcggccaggacctcaaggaacgcgcgcaacgcaacgacgcgggcgaggaagagtcgacgttcggcagccggggccaggcaggccatccccggctgaccgaccgtttcacgctctccaagcccgtggttgcccgggtacacggctacgcgctgggcggcggcttcgagctcgtgctcgcctgcgacatcgtgatcgcctcagaggaggcgatattcggcctgccggaggtccaactcggcctgatccccggggcgggcggcgtgttccggctgccgcggcagctgccgcagaaggtcgcgatgggctacctgctgaccgggcgacggatggatgcggcgacagcgcttcgatacggactggtgaacgaggtcgtgccgctggatgagctggatcagtgcgtcgccggatggaccgacagcctcgtgcgcgccgcgccgctctcggttcgcgcgatcaaacaggccgcgttgcggtcgctcgacctcccactcgaggaggcattcaccgcctcgtatccgtgggaggagcgtcgcaggcgaagcgaggacgcgatcgagggcgtccgggccttcactgaaaaacgggatccggtttggacagggcattacatgtga

SEQ ID NO: 6463 - protein, 267 aa, Amycolatopsis orientalis
MSYTRVRYEKKDHVACVTMDRPDVLNAMDRRMHTELAEIWDDVEADDDIRAVVLTGAGNRAFTVGQDLKERAQRNDAGEEESTFGSRGQAGHPRLTDRFTLSKPVVARVHGYALGGGFELVLACDIVIASEEAIFGLPEVQLGLIPGAGGVFRLPRQLPQKVAMGYLLTGRRMDAATALRYGLVNEVVPLDELDQCVAGWTDSLVRAAPLSVRAIKQAALRSLDLPLEEAFTASYPWEERRRRSEDAIEGVRAFTEKRDPVWTGHYM

SEQ ID NO: 6464 - DNA, 774 bp, Pseudomonas putida; identical to SEQ ID NO: 2770
  CDS (1)..(774): transl_table=11

SEQ ID NO: 6465 - protein, 257 aa, Pseudomonas putida; identical to SEQ ID NO: 2771

SEQ ID NO: 6466 - DNA, 792 bp, Pseudomonas putida
  CDS (1)..(792): transl_table=11
atgactttccagcacatcctgttttccatcgaggacggcgtggccttcctctccttgaaccgccccgagcagctgaacagcttcaacgccgccatgcaccttgaagtgcgcgaagccctcaagcaagttcgccagagcagtgatgcacgggtgctgttgctgacggctgagggccgcggcttttgcgccggccaggacctgtccgaccgtaacgtcgctccagacgccgaggtgccagacctgggcgaatcgatcgacaagttctacaacccgttggtgcgcaccctgcgcgacctgccgctgccggtgatctgtgcggtaaatggtgtggccgccggcgccggtgccaacatcccactggcctgcgacctggtgctggccgggcgatcggccagcttcattcaggcattttgcaagatcggcctggtgccggactctggtggtacctggttgctgccgcgcctggtcggcatggcgcgggctaaagcactggccatgctgggcgagcggcttggtgccgaacaggcccagcaatgggggctgatccaccgcgtggtggacgatgccgccctgcgcgacgaagccctcaccctcgctcgccagctcgccagccagcccacctatggcctcgcgctgatcaagcgcagcctcaatgccagtttcgacaacggcttcgatgaacaactggaactcgagcgcgacctgcaacgcttggccgggcgcagcgaggactaccgtgaaggcgtgagcgccttcatgaacaagcgcacacccgcattcaaggggcgctga

SEQ ID NO: 6467 - protein, 263 aa, Pseudomonas putida
MTFQHILFSIEDGVAFLSLNRPEQLNSFNAAMHLEVREALKQVRQSSDARVLLLTAEGRGFCAGQDLSDRNVAPDAEVPDLGESIDKFYNPLVRTLRDLPLPVICAVNGVAAGAGANIPLACDLVLAGRSASFIQAFCKIGLVPDSGGTWLLPRLVGMARAKALAMLGERLGAEQAQQWGLIHRVVDDAALRDEALTLARQLASQPTYGLALIKRSLNASFDNGFDEQLELERDLQRLAGRSEDYREGVSAFMNKRTPAFKGR

SEQ ID NO: 6468 - DNA, 894 bp, Streptomyces griseus subsp
  CDS (1)..(894): transl_table=11
atgaaccaggaagcattccgggcgggccaggaacccccggccgagtgggcgggggcggcgaccgagtcgttcgcggacttcgccgaccgggtggacggcaaggaggtcgtaccgctgcgggcctcgcttgcgggcggggtcgccaccctgacgctggaccggccgcaccgccgcaacagcctcgacctgacgctctcccgccatctgctgctcggcctgatgtgcgcgggcgacgacccccgggtgcgtacggtcgtgatcaccgggaacggcggggcgttctgcgcgggcgacgacgtcgggagcgtacggcggtggcggctgggcgaccgggcggacacccccttcgacccgatcacctcggacgcccactacctgcgggtctgcgaggcgatcctgcatctgccgaagccggtggtcgtggggctgaccggggcggcggcgggcgccggggcggagatcgcctgcgccgccgacttccggctggcggacacccgtgcctcgatcggcagttgcctggccggggtcgggcatgtggggaacgtggtcctgatgtcccggctgaccggtccggcgcgggcgacggagatctacctcaccgggcggatggtctccggggacgaggcggtgcgcctggggctgttcgaccggctctgcgaaccggaggatttcgaccgcgaactggccgatctggcgggccggttcgcggcactgccgaccgcttcggtggggctgttcaaggagttgcgggagcggagctgggggcagccggccgagtacgggctgcggctccaggacacgtaccacctgaagacgcacgcgacggtggccgacgcccgggaggggatggccgcgttcacggagaagcggccgccccgcttcaccggcgcctga

SEQ ID NO: 6469 - protein, 297 aa, Streptomyces griseus subsp
MNQEAFRAGQEPPAEWAGAATESFADFADRVDGKEVVPLRASLAGGVATLTLDRPHRRNSLDLTLSRHLLLGLMCAGDDPRVRTVVITGNGGAFCAGDDVGSVRRWRLGDRADTPFDPITSDAHYLRVCEAILHLPKPVVVGLTGAAAGAGAEIACAADFRLADTRASIGSCLAGVGHVGNVVLMSRLTGPARATEIYLTGRMVSGDEAVRLGLFDRLCEPEDFDRELADLAGRFAALPTASVGLFKELRERSWGQPAEYGLRLQDTYHLKTHATVADAREGMAAFTEKRPPRFTGA

SEQ ID NO: 6470 - DNA, 831 bp, Ostreococcus tauri
  CDS (1)..(831)
atgcgcgcgtcgtcgtcggcgccccgcgcgcgcgcgcgcgacgtcgacgccgacgcgatcgcggtgatcgagctcgcgcacgcccggacgtcgaacgcgctcgatcgcgatgggttcgaggcgttgaagcgggcgtgcgagacgatcgaatcgaatcgccgagcgcggtgcgtcgtcgtgcgcggcgcgggcgggaactttagctctgggttagatttgtcgacggcgaatgcgatcttggacgcgaggacggcggacgggtgcgcgggacgggcgaacgaggcgttgatgcgaacgatcgaggcgatgcaggctggggtgtcggcgctcgagcggatgtcggcgccgtcgatcgcgtgcgtcagcggagtgtgttttggcggtggcgtggacgtgataacggcgtgtgacgtgagaatcgcgagcgaggacgcgcggttttgcgtcaaagaggtggatttgggattggcggcggatttggggacgctgcagcggttgccgacgatcgtcggacacggacgcgcgatggatctcgcgctcacggcgagaacgatcgacgccagggaggcactggcgattggactcgtgacggaggtcgtcgccgacgtcgacgcgagggggatggagttggcgagggagttggcgaagaagtcgcctctggcgcttcgcgggacaaagcgcgtcctcttgcgagcgagagacgacccaaacgtggctaaggggttagattacgtcgccgcacacaacgccgcgatgctgaggagcgatgacctttccgaggcccttcgcgcgcgcgcggagaggcgtcctccagtgttctcaaagctctaa

SEQ ID NO: 6471 - protein, 276 aa, Ostreococcus tauri
MRASSSAPRARARDVDADAIAVIELAHARTSNALDRDGFEALKRACETIESNRRARCVVVRGAGGNFSSGLDLSTANAILDARTADGCAGRANEALMRTIEAMQAGVSALERMSAPSIACVSGVCFGGGVDVITACDVRIASEDARFCVKEVDLGLAADLGTLQRLPTIVGHGRAMDLALTARTIDAREALAIGLVTEVVADVDARGMELARELAKKSPLALRGTKRVLLRARDDPNVAKGLDYVAAHNAAMLRSDDLSEALRARAERRPPVFSKL

SEQ ID NO: 6472 - DNA, 897 bp, Phaeosphaeria nodorum
  CDS (1)..(897)
atgcctctccttctccggcccagcccacggctgctcatccgtcccatacaacgatgcgcatactcgagtgctccagcaccagctataaacgtcaccaacgtaccagcaccacattctggaagcataagaattctctccctgaaccggccggctgcacgtaatgccatttcgaggcaattgctcaccgagctacaccaccaagtcaacagcatacagagcgaaggagatgcggggcctacgcgggcactcatcctggccagtgaagtagacacgagtttctgcgcaggcgcagacttgaaagagcgcgctacatttacgcaagaggacacagcaaacttcctcacaaacctccgcggcacgttcacctccatctcgcaactccaaatacccacaatctccgcgcttgcagcaccagcattcggcggcggcctcgagctcgctctgaccacacacatgcgcatcttcgcgtccaacacaaccgtcgcactccccgagacacggctggctatcattcccggcgctggaggaacataccgcctccccgcgctcatcggcctctctcgagcccgcgacctgatcctcacaggccgaagggtcggcggaccagaagcatatttcctcggcctgtgcgaccggctggtggaggtcacgccggaagacgcagcacgcgaaggcgcggcgcgcaagaaggtgctcgacgaagcgatcaagctggcgcgggatatctgcgagggtgggccaattgccatcaaagccgctctcgcagcggtggagggatgcgcattgggcgagaaggcagaaaacgccgcgtacgaactcgtcgtcaagacgaaggatcgcgacgaagcactcgcggcgtttagggagaagcggaaacccgtgttccggggggaatag

SEQ ID NO: 6473 - protein, 298 aa, Phaeosphaeria nodorum
MPLLLRPSPRLLIRPIQRCAYSSAPAPAINVTNVPAPHSGSIRILSLNRPAARNAISRQLLTELHHQVNSIQSEGDAGPTRALILASEVDTSFCAGADLKERATFTQEDTANFLTNLRGTFTSISQLQIPTISALAAPAFGGGLELALTTHMRIFASNTTVALPETRLAIIPGAGGTYRLPALIGLSRARDLILTGRRVGGPEAYFLGLCDRLVEVTPEDAAREGAARKKVLDEAIKLARDICEGGPIAIKAALAAVEGCALGEKAENAAYELVVKTKDRDEALAAFREKRKPVFRGE

SEQ ID NO: 6474 - DNA, 870 bp, Phaeosphaeria nodorum
  CDS (1)..(870)
atgcaggcattcagatcaactgcgcgggttgcttcacagttcaggccgacgggtctgcccaggtttgtgcggggatatgcttccgcaccgcagtatgagcacataatggtatcgacacctaagcgcggtgttggcttcatccagctcaaccgccccaaagccctcaacgcgctctgcacacctctcatcctcgagctcaaccaagcccttcgcgacttccaggcggacaaatccatcggcgccattgtcttgactggctccgagaaggcttttgcagctggcgcagacatcaaggagatgaaggacctcacattcagctacgcatatggcaacgactttatagaaagctggtccgatctcgtcaccttcctcaagaagcctctaatcacagctgtcaacggctacgcgctgggaggaggatgcgagcttgcaatgatgggcgacatcatgtacgcaggaccgaaggctgtcttcggacaaccagagatcaagctgggcgtaatcccaggcgcaggaggctcacaacgactcacaaaggcgattggaaagtcaagagccatggagactatccttactggagacaacatctcagcaacacaggcgggcgagtggggtttggtagcgaaggtgttcgagactccggaagagtgcgtcaatggcgctctcgcgacggcgaagaagattgcgagctacagccaaatcgctgtcaaggcttgcaaagaagtagtcaacaagagccaggaattgggcattcgcgagggtgttgagtatgagaggagagtcttccacggcctgtttggcagccaagaccagaagattggcatgtcagcttttgcgaacaagcagaaggctgagtggaagaacgagtag

SEQ ID NO: 6475 - protein, 289 aa, Phaeosphaeria nodorum
MQAFRSTARVASQFRPTGLPRFVRGYASAPQYEHIMVSTPKRGVGFIQLNRPKALNALCTPLILELNQALRDFQADKSIGAIVLTGSEKAFAAGADIKEMKDLTFSYAYGNDFIESWSDLVTFLKKPLITAVNGYALGGGCELAMMGDIMYAGPKAVFGQPEIKLGVIPGAGGSQRLTKAIGKSRAMETILTGDNISATQAGEWGLVAKVFETPEECVNGALATAKKIASYSQIAVKACKEVVNKSQELGIREGVEYERRVFHGLFGSQDQKIGMSAFANKQKAEWKNE

SEQ ID NO: 6476 - DNA, 846 bp, Phaeosphaeria nodorum
  CDS (1)..(846)
atgtcctcggtccagcctcagacaactcccccacccacgtcgcacgtcgtactctcgtacccagccgattatgtcctgctcgtcactatcaaccgcgagaagcagatgaacagcatccccttcgcgggtcatctggaaatgggccaggtctttgactggtttgaccgcgaacctaacctgcgcgtagctatcatcacgggtgctggcaagaagagcttctgtgctggacaggacttgattgaactgggcaacatcagaagcgggaagatcaagccgagcccaggccttctcaggcatccgcttagtgggtttggtgggttgagtaggagaggtgggaggaagcctgtcattgcggctgttaatggctttgcacttggtggaggatttgagattgtgcttggatgcgacttggtggtggcagctccaggcgcaacattcggtctccccgaggctctccgcggaatcttcgcaggcgcaggcggccctccacgtcttgttcgcaatgtcgggctacctatagcctctgagatggccttgaccggcaaatccatcaccgcacaacgagctaaagagctcaaccttgtcaatcgcatttcgccatcacaggagacagtcgtcgatgaagctgtgaagttggcaaatgagattgcgcagatctctccagattctgcgattgtcacaagggcagcgctgaaggaggcatgggaacatggcagtgttgaacgcgccacccaattgactattgagcgattcaacgagcccttgaactcgagcgagaacgctctagaggggctacaggcgttcgcagaaaagcgaaagcctaattggaggccctcgaagttgtaa

SEQ ID NO: 6477 - protein, 281 aa, Phaeosphaeria nodorum
MSSVQPQTTPPPTSHVVLSYPADYVLLVTINREKQMNSIPFAGHLEMGQVFDWFDREPNLRVAIITGAGKKSFCAGQDLIELGNIRSGKIKPSPGLLRHPLSGFGGLSRRGGRKPVIAAVNGFALGGGFEIVLGCDLVVAAPGATFGLPEALRGIFAGAGGPPRLVRNVGLPIASEMALTGKSITAQRAKELNLVNRISPSQETVVDEAVKLANEIAQISPDSAIVTRAALKEAWEHGSVERATQLTIERFNEPLNSSENALEGLQAFAEKRKPNWRPSKL

SEQ ID NO: 6478 - DNA, 750 bp, Rhizobium meliloti
  CDS (1)..(750): transl_table=11
ctggtaaccatcaatcgccccgacgcaataaatgcgctcgatgtcaagcatgaccaggcgctggcaagggtgtggcgcgaggtagaggcagacccgttaatccgtgtttcgattttgactggtgcaggcggtcgggcattctgctccggcggagacttgaagacctatatgccgtggcggcgacagcttgcccaggaaggcaacgagagcacgatcagcttcgggggcatgacgctcccgcacgaaattaccaagccggttattgcggccatccaaggatattgtattgccggtggcctcgaacttgcgatggcgtgtgatatccggctcagcaccgcagattccaagtttggactcgcggaggttcgctggggcgtgctgccggggggagggggaacacaacggcttccgcggctcgtccccgtgggatacgctctggaaatgatcctgacgggagaatcgatcacagcccagcgggcggaacagatcggcctcgtcaaccggatcgtcgaagcgggcgatttgctagacaccgcgtttaaagtggcccagcgcattgtggagaatggcccgttggctgttcaagcagccaagaaagctgtccagcaggggttaagcgcggcgcttcaggatggtctgactctggaggcagctttgcaacggcaactactccaatcagaagacgcacaagaggggttgaaggctttcgcggaaaggcgctcgcccgtgttcaagggtgtagcgtcgtaa

SEQ ID NO: 6479 - protein, 249 aa, Rhizobium meliloti
MVTINRPDAINALDVKHDQALARVWREVEADPLIRVSILTGAGGRAFCSGGDLKTYMPWRRQLAQEGNESTISFGGMTLPHEITKPVIAAIQGYCIAGGLELAMACDIRLSTADSKFGLAEVRWGVLPGGGGTQRLPRLVPVGYALEMILTGESITAQRAEQIGLVNRIVEAGDLLDTAFKVAQRIVENGPLAVQAAKKAVQQGLSAALQDGLTLEAALQRQLLQSEDAQEGLKAFAERRSPVFKGVAS

SEQ ID NO: 6480 - DNA, 816 bp, Aspergillus oryzae
  CDS (1)..(816)
atgtcgatagagatgcagcatccaccagtccagggctgtctagtctcattccctgctccaaacattctcctcctcacactcaaccggccaaagcagcgcaattccataccgctcgctacgagcgccgagatacagcgactatgggattggttcgatcaggagtctactctccaggtggcaataattacaggaacgggagaatccttttgcgccggagctgatctcaaagaatggaacgaactcaatgcgcgcggtgaaacgaatgaaatgacagcacccggactggccgggctccctcgccggcgaggaggaaagccaattatcgccgccgtcaacggatactgtctcggaggcggatttgagatgatagtcaattgcgatattgtcgtcgccagtgagcgagcttccttcgggcttcccgaagtacaacgaggaattgctgctgttgcaggctctctgcctcggttggttcgggtgctgggcaaacagcgagctgcggagattgcactgagtggtctgactttccctgcatcgcagctagagcgttgggggttggtgaatcgcgtggtggagcatggtcagctagtagccacggcagtggagatcgcaagcgccattgcgaagaatagcccggacagcatccgcgttacgatggagggtctccattacgcgtgggagattgccagtgtggaagaaggtagtaccgccttggtagaccggtggtaccctaagctcatggctggggagaattttcacgaaggcgtgagagcatttgtggagaaacggaaaccgaagtggagagcttctaacttgtaa

SEQ ID NO: 6481 - protein, 271 aa, Aspergillus oryzae
MSIEMQHPPVQGCLVSFPAPNILLLTLNRPKQRNSIPLATSAEIQRLWDWFDQESTLQVAIITGTGESFCAGADLKEWNELNARGETNEMTAPGLAGLPRRRGGKPIIAAVNGYCLGGGFEMIVNCDIVVASERASFGLPEVQRGIAAVAGSLPRLVRVLGKQRAAEIALSGLTFPASQLERWGLVNRVVEHGQLVATAVEIASAIAKNSPDSIRVTMEGLHYAWEIASVEEGSTALVDRWYPKLMAGENFHEGVRAFVEKRKPKWRASNL

SEQ ID NO: 6482 - DNA, 834 bp, Aspergillus oryzae
  CDS (1)..(834)
atgactttcaaaaccccacccccaaccccccaacacgccaaagtgaccttcccaaccccacacgtcctacaagtgacgctctcacgacccaaggacctaaactgcataaacacagcgggtcacaatgagctacacgcgctctgggaatggatggacgaggagccgagtatcagggttggggtgttgacgggggaagggagggcgttttgtgccggggcggatctaaaggaatggaacaaccaagtgaacagcgccgagggatccaaacgacaacagccgtcgtcgggattcgggggtctttcccgacggagcggaaagaagcctattatttgcgcggtgaatgggatctgtctgggtggtggatgtgagatgattgtcaatgcggacatggtgattgcgtgtgagaaggcatttttcgggtttcccgaagttcagcgcggagtggtcgcgattgcgggggcgttgccgcgggtggtccggacgattgggcgacagcgggcgatggagatggtcttgacggggcggcgggtgacggcagtcgaggcggagaagtggggatttgtcaatgaggtgttgcccacgcccgaagaagtggtgacgcgggcattggagatcgcgggtcagatcgcggcgaatagtcccgatgcggtgatcgtcagtcgcgagggggtcaagttgggttgggagggtgttggagctgaggagggcagtcgctggttgatcgacgggtggcagaagaggttaaacgagggcgagaatatcaaagagggattgagggcgtttgtggagaagaggcaaccaaagtgggtggataactcgtatgcgctgcactaa

SEQ ID NO: 6483 - protein, 277 aa, Aspergillus oryzae
MTFKTPPPTPQHAKVTFPTPHVLQVTLSRPKDLNCINTAGHNELHALWEWMDEEPSIRVGVLTGEGRAFCAGADLKEWNNQVNSAEGSKRQQPSSGFGGLSRRSGKKPIICAVNGICLGGGCEMIVNADMVIACEKAFFGFPEVQRGVVAIAGALPRVVRTIGRQRAMEMVLTGRRVTAVEAEKWGFVNEVLPTPEEVVTRALEIAGQIAANSPDAVIVSREGVKLGWEGVGAEEGSRWLIDGWQKRLNEGENIKEGLRAFVEKRQPKWVDNSYALH

SEQ ID NO: 6484 - DNA, 846 bp, Aspergillus oryzae
  CDS (1)..(846)
atgacgaccccaaccctaacccccaaatacttcaacataacctacccccaagaatatgttgcgcacgtcgaaatcaaccgtgccgacaaaatgaactccttctttgaagcaatgtggctcgaactccacacaatcttcacccacctctcacactccccaaccgtcagagccatcatcctctccggtgccggccccaaagccttcaccgccggattggacgtcaaagccgccagccagggcctcctctcctccgacgacagtcaaagcgaccccgcccgcaaagccttccatctgcgccgccacatcacctccttccaagattgcatttcggccatcgagcgctgcgagaagcccgttatcgtggccatgcatggcttctccctcggtctggccgtggacatcgccacggcggcggatgtccggctctgtgccgctgataccaagttcgccgtgaaggaggtggatattggtcttgcagcggatattgggacgctgagtcggttgccgaaggtggtggggaatttcgggtgggtgaaggaggtggccttgagcgcgagggtgtttggggccgaggaggcgctgcgggttgggtttgttagtcaggtgtttgggggcaaggaggaggttctcaagggggcgttggagattgctgggttgattgctagtaagagtccggttgctgtgttgggcacgaaggatattttgaattggagtcgggatcggagtgtggaggatggtcttcggtatacgagtgtgtggaacagtgctgcgttgcagacgaaggatgtcagcgcggcgttgttgtcggggattcagaagaggaagcctacgtttgagaagttgtaa

SEQ ID NO: 6485 - protein, 281 aa, Aspergillus oryzae
MTTPTLTPKYFNITYPQEYVAHVEINRADKMNSFFEAMWLELHTIFTHLSHSPTVRAIILSGAGPKAFTAGLDVKAASQGLLSSDDSQSDPARKAFHLRRHITSFQDCISAIERCEKPVIVAMHGFSLGLAVDIATAADVRLCAADTKFAVKEVDIGLAADIGTLSRLPKVVGNFGWVKEVALSARVFGAEEALRVGFVSQVFGGKEEVLKGALEIAGLIASKSPVAVLGTKDILNWSRDRSVEDGLRYTSVWNSAALQTKDVSAALLSGIQKRKPTFEKL

SEQ ID NO: 6486 - DNA, 846 bp, Aspergillus oryzae
  CDS (1)..(846)
atgtctccatcgtttcagtctgaaccacccaagactacacactaccgtgtgtcattccccgaaccccatatcatgttagtcaccatagatcgtgagaaacaacgaaactccctaccctcctacgcgcactgggaagcacatgagctcttcacctggttcgaccatgagccatctttacttgtcgccgttgtcaccggggccgggaacaaggccttctgtgcagggcaggacctccaagaacaaaacaaaaaacgagggaatgagaaaacggcatctcaaaaggctctacttacccatcccccgacagggttcatgggactaagtcagaggaaaggtgtgaagcccgtcctggcagccgtgaatgggtttgctttgggtggagggtttgaaatttgtctcaattgtgacgtggtcgttgcatcctcaacggcagagtttgggcttccagaggctcaggtcggcttgtttgcggcagctggcggtttgccccggttggttcgaacatgtggtatgcaagtagccacggagctcgctttgacgtgcagaaggatctctgcgcaggaagctctgagtctacgattgattaataggatctctaagactcctgagtcacttgtagaagagtgcctggcgattgcatcccggattgtgcagttgtctcccgacgcgatcttggcgacgcgacaggggctcagggcagcttgggacaatccaagtgtacagcatgcaacatcgcaaatccgtgagatgtatgctgatcgggtggttaaaggggagaattttaaaattggcgtggaggcatttgtaaagaagactaagccacaatgggtgatgcctaagatttaa

SEQ ID NO: 6487 - protein, 281 aa, Aspergillus oryzae
MSPSFQSEPPKTTHYRVSFPEPHIMLVTIDREKQRNSLPSYAHWEAHELFTWFDHEPSLLVAVVTGAGNKAFCAGQDLQEQNKKRGNEKTASQKALLTHPPTGFMGLSQRKGVKPVLAAVNGFALGGGFEICLNCDVVVASSTAEFGLPEAQVGLFAAAGGLPRLVRTCGMQVATELALTCRRISAQEALSLRLINRISKTPESLVEECLAIASRIVQLSPDAILATRQGLRAAWDNPSVQHATSQIREMYADRVVKGENFKIGVEAFVKKTKPQWVMPKI

SEQ ID NO: 6488 - DNA, 801 bp, Rhodococcus aetherivorans
  CDS (1)..(801): transl_table=11
atggccgacgagtccaccgttaccgaacctgccgcacagtacgagcggcgtggcggcatcgccgtcatcacgctcaaccgcccccgggcgctcaacgccgtgaacgcagcgctggcgacggcggtcggcacgctgctcgagcaggcggaggcggacgacgacgtgcgcgtcgtggtgctcaccggtgcgggccgcgcgttctgcgcgggcgccgacctcaaggccctggccacgggcgagagcatcgccgccgacgggcaccctgaatggggtttcgccggctatgcccagcactggatcagcaagccgaccatcgccgcggtcaacgggttcgccctcggcggcggcaccgagctggtgctcgcgtccgacctcgccgtcgtcgacgaggaggcccagctgggcctgcccgaggtcaagcgaggtctcttcgccgccgcgggcggggtgatccggctccaacagcagatcccccgcaaggtcgcgctggaactggcgctgaccggtgagccgatctccgctgcgcagggcaaggaactgggcctggtcaaccgggtcgcaccgcacggcacggcgctcgagatggcgctcgggctggccgagaccatcgccgcgaacgctccgctctcggtacgcgaatcgaagtcgatgatccaccggaccgcgcacggcgccgactgggagccgggtgtgtgggaggccaacgccgccgcggtgaaggtggtgttcaccagcgacgacgccaaggaaggcccgaccgcgttcgcacagaagcggcagccggtctggaagggtcgctga

SEQ ID NO: 6489 - protein, 266 aa, Rhodococcus aetherivorans
MADESTVTEPAAQYERRGGIAVITLNRPRALNAVNAALATAVGTLLEQAEADDDVRVVVLTGAGRAFCAGADLKALATGESIAADGHPEWGFAGYAQHWISKPTIAAVNGFALGGGTELVLASDLAVVDEEAQLGLPEVKRGLFAAAGGVIRLQQQIPRKVALELALTGEPISAAQGKELGLVNRVAPHGTALEMALGLAETIAANAPLSVRESKSMIHRTAHGADWEPGVWEANAAAVKVVFTSDDAKEGPTAFAQKRQPVWKGR

SEQ ID NO: 6490 - DNA, 768 bp, Klebsiella sp; identical to SEQ ID NO: 2774
  CDS (1)..(768): transl_table=11

SEQ ID NO: 6491 - protein, 255 aa, Klebsiella sp; identical to SEQ ID NO: 2775

SEQ ID NO: 6492 - DNA, 771 bp, Azoarcus sp
  CDS (1)..(771): transl_table=11
atgccggtaacgctggaagtaaagaatcacgtcgcctacgtcaccctgaaccgtccggaagcgatgaactcgctcgacccggaatcgacctgcgatctcgccgaaatctgggcgcgcgtgcgtaccgaccccgacatccgcgtggccgtgttgtccggtgcgggcgaaaaggcgttctgcacaggcacggacatgaagaaggcaccgccgcccaccgagtgcatggcagcgacctatctgcgcgagggccagccgatcctgccgcacatgaagatgtggaagccgatcatcgccgcgatcaacggctacgcggtgggtggcgggctcgagatggcgcttgcgtgcgacatgcggatcgcctcgtcgaatgccaagttcgggctgaccgaagtgaaggtcgcgagcctcgccggcctcaacggcacgcaggcgctgccgcgcgcgatcccgcaggcggtggcgatgaagatgctgctgacgggcgagatgatctctgcggaggaggcgctgcgctacgggcttgtcagcgacgtggtcgagccgtcggcgctcgcggacctggcgcgaacgtacgcggagaagatcgccagcgcggcgccgctgagcgtgcaggcgaccaagcaagccgcagtgctcggcaaggacatgccgctcgagcacggcatcctttactcgcatctgctgtggggcgtgttgcgtgacaccgaggaccgcaaggagggcttcaaggccttcggcgagcggcgcgcgccggagtttcgcggcgcctga

SEQ ID NO: 6493 - protein, 256 aa, Azoarcus sp
MPVTLEVKNHVAYVTLNRPEAMNSLDPESTCDLAEIWARVRTDPDIRVAVLSGAGEKAFCTGTDMKKAPPPTECMAATYLREGQPILPHMKMWKPIIAAINGYAVGGGLEMALACDMRIASSNAKFGLTEVKVASLAGLNGTQALPRAIPQAVAMKMLLTGEMISAEEALRYGLVSDVVEPSALADLARTYAEKIASAAPLSVQATKQAAVLGKDMPLEHGILYSHLLWGVLRDTEDRKEGFKAFGERRAPEFRGA

SEQ ID NO: 6494 - DNA, 807 bp, Actinoplanes teichomyceticus
  CDS (1)..(807): transl_table=11
gtgtccagcgtgaccgcggcccgggtgcggtaccacaggaccggccacgtcgcccgggtcacgctcgaccgtcccgacgtgctcaacgccatggatctgcggatgcacgaggaactggcgcggatctgggacgacatcgaggccgacgaccggatccgggtcgtggtgctgaccggcgccggggaccgcgcgttctcggtgggccaggacctcaaggagcgtgcccgccgcgacgcggcgggcaccccggggtccagtttcggcagccgcggccagcccggctggccgcggctcaccgagcggttcgggttcagcaagccggtggtcgcgcgcgtcgacgggtacgccctcggcggcggcttcgagctcgcgctggcctgcgatctgatcatcgcatcggaccgctcggtgttcgggctgccggaggtgcggctcgggctcgtgccgggggccggcggcgtgttccggctggtccggcagctgccgcagaagacggcgatgggctacctgctgaccggccgtcgcttcgacgcggcgaccgcgctccggttcgggctggtcaacgaggtggtgccggcgcagcggttggacgcttgcgtggacggctgggtcgatgatctcgtcacaagcgcgccactgtcggtccgggcgatcaaggaagccgcgctgcgctcggtcgacctgccgctgccggacgccttcaccgccacgtaccgctgggagcagcggcgccgcgccagcgcggacgccgtcgaggggccccgggcgttcgccgagcgccgggcgccgcgctggtccggcacctga

SEQ ID NO: 6495 - protein, 268 aa, Actinoplanes teichomyceticus
MSSVTAARVRYHRTGHVARVTLDRPDVLNAMDLRMHEELARIWDDIEADDRIRVVVLTGAGDRAFSVGQDLKERARRDAAGTPGSSFGSRGQPGWPRLTERFGFSKPVVARVDGYALGGGFELALACDLIIASDRSVFGLPEVRLGLVPGAGGVFRLVRQLPQKTAMGYLLTGRRFDAATALRFGLVNEVVPAQRLDACVDGWVDDLVTSAPLSVRAIKEAALRSVDLPLPDAFTATYRWEQRRRASADAVEGPRAFAERRAPRWSGT

SEQ ID NO: 6496 - DNA, 798 bp, Nonomuraea sp
  CDS (1)..(798): transl_table=11
atgagcgagcctcgcgtgcgctacgagaagaaggaacacgtcgcccatgtgacgatgaaccggccccacgtgctgaacgcgatggatcgccggatgcacgaggagctcgccgagatctgggacgacgtcgaggccgacgacgacgtcaggacggtcgtcctgaccggtgcgggaacgcgggccttctccgtcggccaggacctcaaggaacgcgcgctgctggacgaggcgggcacgcaggcctcgacgttcggcagccgggggcaggcaggtcatccccggctgaccgaccgcttcaccttgtccaagccggtggtcgcccgggtgcacggctacgcgctgggtggcggcttcgagctggtgctcgcctgcgacctcgtcatcgcctccgaggaggcggtgttcggcctgccggaggtccggctcggcctgatccccggggcgggaggcgtgttccggctgccgcggcagctgccgcagaaggtggcgatgggccatctgctgaccgggcgccggatggatgcggccacggcgttccggtacggattggtgaacgaggtcgtaccgcttgatgagctggatcggtgcgtggccggatggaccgacgacctcgtacgcgccgctccgctgtctgttcgcgcgatcaaggaggccgccatgcggtcgctcgacattcccctggaggaggcgttcaccacgtcctacccatgggaagagcgtcgtcggcgtagcggcgatgcgatcgagggcgtccgggcgttcgtcgagaagagggacccggtctggacgtcgagatga

SEQ ID NO: 6497 - protein, 265 aa, Nonomuraea sp
MSEPRVRYEKKEHVAHVTMNRPHVLNAMDRRMHEELAEIWDDVEADDDVRTVVLTGAGTRAFSVGQDLKERALLDEAGTQASTFGSRGQAGHPRLTDRFTLSKPVVARVHGYALGGGFELVLACDLVIASEEAVFGLPEVRLGLIPGAGGVFRLPRQLPQKVAMGHLLTGRRMDAATAFRYGLVNEVVPLDELDRCVAGWTDDLVRAAPLSVRAIKEAAMRSLDIPLEEAFTTSYPWEERRRRSGDAIEGVRAFVEKRDPVWTSR

SEQ ID NO: 6498 - DNA, 1014 bp, Arabidopsis thaliana
  CDS (1)..(1014)
atggcggattccaatgagcttggctcggcgagccgacgactctccgtcgtcaccaatcatctcatccctatcggattcagtccagctcgtgctgactcagtggaactctgtagtgcttcgtcgatggatgatagattccataaggttcacggtgaagttccgacccacgaagtcgtttggaaaaaaactgatttctttggtgaaggagataacaaggagtttgttgatattatttatgagaaagcccttgatgaaggcattgcaaagattactataaaccggccagagagaagaaatgcgttccggcctcagactgtgaaggagcttatgcgtgcgtttaatgatgctagagatgatagctctgtaggagtcatcatactcaccggcaagggaacaaaagcattttgcagtggtggtgatcaggctttgagaacacaagacgggtatgctgatcccaatgacgttggccgccttaatgttcttgatcttcaggttcaaatccgcagattgccaaagccagttattgcaatggtagctggttatgctgttggaggaggacacattttgcacatggtctgcgatctaacaattgcagctgataatgcgatttttggtcaaacgggtcctaaggttggaagttttgatgctggttatggaagttccatcatgtctcgtctggtttgtcctaaaaaggcacgagaaatgtggtttatgacgaggttctacacagcttctgaagcagagaaaatgggacttatcaatacagttgtaccgctagaggatttggagaaagaaactgtgaaatggtgcagagaaatcttacggaacagtccaactgcaatccgagtacttaaggcagcacttaatgcagttgatgatggccatgccggccttcagggactcggtggtgatgcgacactcttattctatggaaccgaagaagctactgaagggagaactgcttatatgcaccgccgaccaccggacttctctaaatttcaccggcgaccttaa

SEQ ID NO: 6499 - protein, 337 aa, Arabidopsis thaliana
MADSNELGSASRRLSVVTNHLIPIGFSPARADSVELCSASSMDDRFHKVHGEVPTHEVVWKKTDFFGEGDNKEFVDIIYEKALDEGIAKITINRPERRNAFRPQTVKELMRAFNDARDDSSVGVIILTGKGTKAFCSGGDQALRTQDGYADPNDVGRLNVLDLQVQIRRLPKPVIAMVAGYAVGGGHILHMVCDLTIAADNAIFGQTGPKVGSFDAGYGSSIMSRLVCPKKAREMWFMTRFYTASEAEKMGLINTVVPLEDLEKETVKWCREILRNSPTAIRVLKAALNAVDDGHAGLQGLGGDATLLFYGTEEATEGRTAYMHRRPPDFSKFHRRP

SEQ ID NO: 6500 - DNA, 804 bp, Streptomyces toyocaensis
  CDS (1)..(804): transl_table=11
atgaccggcgaccgtacgcgggtgcgctacgagaagaagcagcacgtcgcccgtatcacgctcgaccgtcccgacgtgctcaacgcgatggatctgcgcatgcacgaggagctcgccgagatctgggacgacgtcgaggccgacgacgacatcagggtcgccgtgctgaccggagcgggtgaccgtgccttctccgtcggccaggacctcaaggagcgggcccgcctggaccgtcagggcgtcgctccgacgaccttcggcagccgcgggcagccgggctggccccggctcaccgaccgcttcacgctgtacaaaccggtgctcgcacgggtccacggttacgccctgggcggcggtttcgaactcgccctggcctgcgacctgatcatcgcctcggaccaggcggtcttcgccctgcccgaggcgcggctcggtctcgtgcccggtgcgggcggtgcgttccggctggccaggcagctgccggagaagatcgccatggggtacctgctcaccggtcgtcggctgagcgccgcgacggccctgcgccacgggctcgtcaacgaggtggtcccggccgaccggttggacgcctgcgtccaggagtggaccgacgacctggtccgcagcgccccgctctcggtccgggccatcaaggaagccgctgcgaaatccgtcgacatgcccctcgagcaggcgttcaccgccgagtacggctgggaggagcgccgcaggcgcagcagcgacgcggtcgaaggagtccgggccttcgcggacaggcgcgatcccgtctggaccggccgctga

SEQ ID NO: 6501 - protein, 267 aa, Streptomyces toyocaensis
MTGDRTRVRYEKKQHVARITLDRPDVLNAMDLRMHEELAEIWDDVEADDDIRVAVLTGAGDRAFSVGQDLKERARLDRQGVAPTTFGSRGQPGWPRLTDRFTLYKPVLARVHGYALGGGFELALACDLIIASDQAVFALPEARLGLVPGAGGAFRLARQLPEKIAMGYLLTGRRLSAATALRHGLVNEVVPADRLDACVQEWTDDLVRSAPLSVRAIKEAAAKSVDMPLEQAFTAEYGWEERRRRSSDAVEGVRAFADRRDPVWTGR

SEQ ID NO: 6502 - DNA, 810 bp, Amycolatopsis balhimycina
  CDS (1)..(810): transl_table=11
gtgagcggcgaccgggtgcggtacgagaagaaggaccacgtcgcctacgtgacgctggaccggcccggcgtgctgaacgccatggaccggcggacgcacgaggagctcgccggaatctgggacgacgccgaggccgacgacgaagtccgggtggtggtgctgaccggcgccgggaaccgcgcgttctccgtcggccaggacctcaaggaacgcgcccggctgaacgaagcgggtgcgcgggccacgacgttcggcagccggggccagccggggcatccccggctgaccgaccggttcaccctgtccaagccggtggtcgcccgggtgcacggctacgcgctgggcggtggcttcgagctggtgctcgcctgcgacatcgtcatcgcctccgacgattcggtgttcgccctgccggaggtccgcctcggcctgatccccggggcgggcggggtgttccggctgccgcggcagctgccgcagaaggtggcgatgggctacctgctgaccggccgccggatggacgcggcgacggcgctgcggtacggattggtcaacgaggtcgtgccaccggaggaactggaccggtgcgtcgccgaatggacggacagcctcgtgcgcgccgctccgctttcggttcgcgcgatcaaggaggccgcgctacggtcgctcgacctccccctggaggaggcgttcaccgcttcctacacctgggaagagcgccgtcggcggagcgaagacgcgatcgagggtccccgggccttcgccgcgaaacgggatccggtctggaccggggaataccggccgggttga

SEQ ID NO: 6503 - protein, 269 aa, Amycolatopsis balhimycina
MSGDRVRYEKKDHVAYVTLDRPGVLNAMDRRTHEELAGIWDDAEADDEVRVVVLTGAGNRAFSVGQDLKERARLNEAGARATTFGSRGQPGHPRLTDRFTLSKPVVARVHGYALGGGFELVLACDIVIASDDSVFALPEVRLGLIPGAGGVFRLPRQLPQKVAMGYLLTGRRMDAATALRYGLVNEVVPPEELDRCVAEWTDSLVRAAPLSVRAIKEAALRSLDLPLEEAFTASYTWEERRRRSEDAIEGPRAFAAKRDPVWTGEYRPG

SEQ ID NO: 6504 - DNA, 888 bp, Oryza sativa
  CDS (1)..(888)
atggcggcagatggcgccgtcgaggcgccatctgccacatcagcttggagggcggcaggcatgcgcatcctccgtggaatcctcgccgtctccggccacctcgccggccgccgcgcgccggcgaacaacgtccacctggcactcttctcccgcgccctccaaatcctcgcccagcaggagcccgtccgcctccagaagctctcggcgcccgactccgggatcgtggagatgaggctggagcggccggaggccaggaacgccatcgggagggagatgctccaggggttgcggagcgcgatcgagaaggtgaaggctgacgcgacggcgaacgtcgtgctgctggcgagctccgtcccgaaggttttctgcgctggcgctgatctcaaggcattgtcaattcctacaattgccattgttgagggagctgcttttggcggtgggttagaattggctctttcttgtgatctccgtatatgtggggaaaatgcaacatttagcttgccagaaactggccttgctattattcctggagctgggggaacgcagcgtcttcctaggattgttggaaagtccagagcaaaggaattaatattcactggtcgtagattcgatgcagtagaagctgtaaccatgggagtagtaaactactgtgttcccgctggggaggcttataaaagggctcttgaacttgcccaggagataaatcagaaaggtccgttagcgataagaatggctaagaaggccatcaatcaaggcatggaggtagatctgtccgccggattggctgtcgaagaagaatgctacgagcaagttctgcacactcaagatcgtcttgaaggtctagctgcatttgctgagaaaaggaaacctgtatacacagggaaataa

SEQ ID NO: 6505 - protein, 295 aa, Oryza sativa
MAADGAVEAPSATSAWRAAGMRILRGILAVSGHLAGRRAPANNVHLALFSRALQILAQQEPVRLQKLSAPDSGIVEMRLERPEARNAIGREMLQGLRSAIEKVKADATANVVLLASSVPKVFCAGADLKALSIPTIAIVEGAAFGGGLELALSCDLRICGENATFSLPETGLAIIPGAGGTQRLPRIVGKSRAKELIFTGRRFDAVEAVTMGVVNYCVPAGEAYKRALELAQEINQKGPLAIRMAKKAINQGMEVDLSAGLAVEEECYEQVLHTQDRLEGLAAFAEKRKPVYTGK

SEQ ID NO: 6506 - DNA, 909 bp, Oryza sativa
  CDS (1)..(909)
atgcggcgcctcctcgccgcctccggccgctgcgctccggcgacccgcacccaccatgggctcttcgcgcgcgccatccagatcttggcgccgccggatcccgtcagtctccacaagctctcggcacccgactgcgcgccgccatctcctgacgcggcgtgggtgccgatcccccgcttcgctctgtatctcctcggttcccggccgggcggaatcggcgactcggcgtggcgtcggcgaggccctggaacagtggagcggtacaaggaggtaggaatcgtagagctgaggctggagcgtccggaggtcaagaacgccatcaactgggaagccatgaggctgctgcggggtgtggtcgagaaggttgaggctgacgacaccgtgaaggtcgtcctggtcacgagctccgtgcctggagttttctgcgcaggcgccgatctcaaggcactatctattccaacaattgctgttattgaaggagctgctttgggtggtgggctagaactggcactttcatgcgacctgcgtatatgtggagaaaatgcaactcttggactgccagagacaggacttgctatcattcctgggtccagagcgaaggagatgatattcaccggccgtagatgtaatgcaactgaagctgtaatgatgggactcgcaaactactgcgttccagcaggggaggctcatgaaaaagcccttgaacttgcccgcgagatagcccagaaagggcctctggggataagaatggccaagaaggccattgatcaagggatgcaggcagcagacatgccgtccgcgttggccgtcgaaggggagtgctacgagcagctgctgcacacggaggatcgccttgagggcctagccgcattcgccgagaggaggaaacctgtatactcaggaaagtag

SEQ ID NO: 6507 - protein, 302 aa, Oryza sativa
MRRLLAASGRCAPATRTHHGLFARAIQILAPPDPVSLHKLSAPDCAPPSPDAAWVPIPRFALYLLGSRPGGIGDSAWRRRGPGTVERYKEVGIVELRLERPEVKNAINWEAMRLLRGVVEKVEADDTVKVVLVTSSVPGVFCAGADLKALSIPTIAVIEGAALGGGLELALSCDLRICGENATLGLPETGLAIIPGSRAKEMIFTGRRCNATEAVMMGLANYCVPAGEAHEKALELAREIAQKGPLGIRMAKKAIDQGMQAADMPSALAVEGECYEQLLHTEDRLEGLAAFAERRKPVYSGK

SEQ ID NO: 6508 - DNA, 774 bp, Pseudomonas putida; identical to SEQ ID NO: 2782
  CDS (1)..(774): transl_table=11

SEQ ID NO: 6509 - protein, 257 aa, Pseudomonas putida; identical to SEQ ID NO: 2783

SEQ ID NO: 6510 - DNA, 771 bp, Thauera aromatica
  CDS (1)..(771): transl_table=11
atgccggtaacgctggaagtatcgaaccacgtcgcctacgtgaccttgaaccgtccggaagcgatgaattcgctcgacccggaatcgaccgccgacctcactgaaatctgggcgcgtgtgcgcaccgatccggacatccgtgtcgcggtgctgaccggcgccggcgagaaatcgttttgcaccggcaccgacatgaaaaaatcgccaccgcccaccgagtgcatggccgcgacctatctgcgcgacggccagccgatcctgccgcacatgaagatgtggaagccgatcattgccgcgatcaacggctacgcggtcggcggcgggctcgagatcgcgcttgcctgcgacctgcgcatcgcttccacgaacgccaaattcggcctcaccgaagtcaaggtcgcgagcctcgccggcctcaacggcacgcaggcgctgccgcgcgccattccgcaggcggtggcgatgaagatgttgctcaccggcgagatgatcagcgccgaagaggcgctgcgctatgggctggtcagcgacgtcgtcgagccgtcggcactcgccgatctcgcccgcagctatgcggagaagatcgccagcgcggcgcccttgagcgtgcaggcgaccaagcaggccgcggtgctcggcaaggacatgccgctcgagcacggcatcctgtactcgcacctgctgtggggcgtgctgcgtgacaccgaagaccgcaaggaaggcttcaaggccttcggcgaacggcgcgcgccggcattccgcggcgcctga

SEQ ID NO: 6511 - protein, 256 aa, Thauera aromatica
MPVTLEVSNHVAYVTLNRPEAMNSLDPESTADLTEIWARVRTDPDIRVAVLTGAGEKSFCTGTDMKKSPPPTECMAATYLRDGQPILPHMKMWKPIIAAINGYAVGGGLEIALACDLRIASTNAKFGLTEVKVASLAGLNGTQALPRAIPQAVAMKMLLTGEMISAEEALRYGLVSDVVEPSALADLARSYAEKIASAAPLSVQATKQAAVLGKDMPLEHGILYSHLLWGVLRDTEDRKEGFKAFGERRAPAFRGA

SEQ ID NO: 6512 - DNA, 810 bp, Streptomyces collinus
  CDS (1)..(810): transl_table=11
  misc_feature (760)..(760): n is a, g, c or t
atgcgccatgccgacaccgtgctctacgaggtgagcgacgggctcgcgacgatcacgctgaaccgccccgaggcgatgaacgcgctgaacatcgcgaccaaggtcgccctccgcgaggcggcggaatcggcggccgccgacacggccgtacgggcgattctgctgaccgcggccggggagcgggcgttctgcgtgggccaggacctcaaggagcacatcgggctgctcgcccaggaccgggagaccgggtcggggcagacgatgagcacggtcaaggagcactacaacccgatcgtgcgggccctcgccggggcggcgaagccggtggtcgccgcggtgaacggcgtcgcggccggggccggcttcggcttcgcgctcaccgcggactaccgcgtcgtcgccgacaccgcctccttcaacacgtccttcgccggcgtggccctcaccgccgactccggcatctcctggacgctgccccgtgtgatcggcccgagccgcgccgccgacctgctgctcttcccgcgcagcatcagcgcccaggacgcgctggagctgggcatcgccaaccgggtcgtccccgccgcggagctgcgcgccgaggccgagaaggtggcgcgggcgctggccgaggggccgacggtggcgtacgcggcgatcaaggaggcggtggcctacgggctgacgcactcgctcgcggagacgctggagaaggaggacgagctgcagacccgggccgggcagtccgaggaccacgccatcntcgtccaggcgttcgtgaacaaggagcggcccaagtacctggggcggtag

SEQ ID NO: 6513 - protein, 269 aa, Streptomyces collinus
  misc_feature (254)..(254): The Xaa at location 254 stands for Ile, Leu, Phe, or Val.
MRHADTVLYEVSDGLATITLNRPEAMNALNIATKVALREAAESAAADTAVRAILLTAAGERAFCVGQDLKEHIGLLAQDRETGSGQTMSTVKEHYNPIVRALAGAAKPVVAAVNGVAAGAGFGFALTADYRVVADTASFNTSFAGVALTADSGISWTLPRVIGPSRAADLLLFPRSISAQDALELGIANRVVPAAELRAEAEKVARALAEGPTVAYAAIKEAVAYGLTHSLAETLEKEDELQTRAGQSEDHAIXVQAFVNKERPKYLGR

SEQ ID NO: 6514 - DNA, 783 bp, Bacillus subtilis
  CDS (1)..(783): transl_table=11
atgggagaatctattcttttcactgcaaaaacagaacatattactgtcatcacccttaacaggccccatgcggcaaatgccctttcggcagaaatgcttagagacctgcaatccactctccaagaagtcgaattcaacacgaaaatccgctgcgtcatcctgacaggcgccggtgaaaaagcattctgtgcgggagcagacttgaaagaaagaataaaaatgaaacaagatcaggttctcaaaagtgtttccctcattcacagaaccgctgctttactcgaagccttgccgcagccggtgatagcagccataaacggaagtgctttagggggcgggcttgaattggcattggcatgcgacatccgaatagcagccgagaacgctacgttaggccttccggaaacggctttagccattatcccgggcgcaggagggacacaaagacttccgcgtctgatcggcagaggaaaagcaaaagaactcatttatacaggcagacgcataaccgcacatgaagccaaagagataaaccttgtagagcatgttacggcttcttgtgagcttatggcgaaagcagaggaactggcagaagccatttcagctaacggaccaattgccgtccgccaggctaaattcgcgatcaataaaggattggaaacaaaccttgcaacgggattatcaattgaacaaaaagcatatgaacacacgatcccgacaaaggacaggacagagggacttcaagcctttcaagaaaaaagacgtgccgtatacacgggagaataa

SEQ ID NO: 6515 - protein, 260 aa, Bacillus subtilis
MGESILFTAKTEHITVITLNRPHAANALSAEMLRDLQSTLQEVEFNTKIRCVILTGAGEKAFCAGADLKERIKMKQDQVLKSVSLIHRTAALLEALPQPVIAAINGSALGGGLELALACDIRIAAENATLGLPETALAIIPGAGGTQRLPRLIGRGKAKELIYTGRRITAHEAKEINLVEHVTASCELMAKAEELAEAISANGPIAVRQAKFAINKGLETNLATGLSIEQKAYEHTIPTKDRTEGLQAFQEKRRAVYTGE

SEQ ID NO: 6516 - DNA, 828 bp, Rhodococcus fascians
  CDS (1)..(828): transl_table=11
atgcgttggtcgggccggcgtttgcgtgcacagccacatcaagcagattggaagtccttacacatgagcgattgcgttttgacagagttcgcgggcggcattgccgtcatcactattaatcggccagcctcacgcaacgcggtcaaccgcgaggtagctgaacagattgccgcagcaatcgacgaactggattcacgcgatgatctcgtggtcggaatcttgaccggtgcgggcggatcattctgcgcgggaatggatctgaaagcgttcgtcgacgggaatgtgccgtccgtcgccggccgtggtttcggcggcctggttgaacgacccccgataaagccactgatcgcggctgttgaagggtgggctttggctggcggttgtgagatcgcgctcagcgccgacctcatcgtagcttcccgggaggcgaagttcggcctccctgaggtcaaacgaggccttgtcgccgccggaggaggactgctgcgcctgccgcgggcgattccctaccagatcgccatggaggcggtactgaccggtgacccgatcaccgctgagcgggctcaccacttcggtctgattaacacgctgaccgaacccggtgaggcattggccggggctcgcgaacttgctgcgagaattgccgcaaacgggccacttgcggttcgagtcagcaagaagatcctctcggaggccgtcggctggacggactccgaggggtttgagcgccaaacagcggacactgacggaatcttcgcttccgacgatgcgcaggaaggtgctcgcgcgtttactgagaagcgtgtgcccgtgtggagtgggcgctga

SEQ ID NO: 6517 - protein, 275 aa, Rhodococcus fascians
MRWSGRRLRAQPHQADWKSLHMSDCVLTEFAGGIAVITINRPASRNAVNREVAEQIAAAIDELDSRDDLVVGILTGAGGSFCAGMDLKAFVDGNVPSVAGRGFGGLVERPPIKPLIAAVEGWALAGGCEIALSADLIVASREAKFGLPEVKRGLVAAGGGLLRLPRAIPYQIAMEAVLTGDPITAERAHHFGLINTLTEPGEALAGARELAARIAANGPLAVRVSKKILSEAVGWTDSEGFERQTADTDGIFASDDAQEGARAFTEKRVPVWSGR

SEQ ID NO: 6518 - DNA, 894 bp, Escherichia coli O6
  CDS (109)..(894): transl_table=11
atgaaacggcagggaactaccctgtcagctaataatcacgctctaaaacaatatgcattttttgcagggatgttgtcgtccctgaaaaagcaaaaatggagaaaaggaatgagtgaatcattacatctgacccgcaatggatcaattctggaaattacccttgatcgtccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggaggttttgcgggattaaccgaaattttcaatctcgacaaaccggtcatcgccgctgtgaacggctatgcctttggcggcggctttgaactggcgctggcggcagattttattgtttgtgccgataacgccagcttcgccctaccggaagccaaactgggcatcgttcctgacagcggcggcgtgctgcgtctgccgaagatcctgccgcctgccatcgtcaatgaaatggtgatgaccggcagacgaatgggcgcagaagaggcgctgcgttggggggtagtcaaccgcgtggttagccaggcggaactgatggataacgcccgcgaactggcgcagcagctggttaacagcgctccgctggcgattgcggcgctgaaagagatctaccgcaccaccagtgaaatgccggtagaagaagcgtatcgctatattcgcagcggcgtgttgaaacactatccgtcggttctgcattcggaggatgccattgaagggccgctggcgtttgccgagaagcgcgatccagtgtggaaaggacgttaa

SEQ ID NO: 6519 - protein, 261 aa, Escherichia coli O6
MSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPAIVNEMVMTGRRMGAEEALRWGVVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 6520 - DNA, 894 bp, Escherichia coli; identical to SEQ ID NO: 6086
  CDS (109)..(894): transl_table=11

SEQ ID NO: 6521 - protein, 261 aa, Escherichia coli
MSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPAIVNEMVMTGRRMGAEEALRWGIVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 6522 - DNA, 786 bp, Proteus sp
  CDS (1)..(786): transl_table=11
atgagccaatcattacatctaacaacacgtggttcagtgcttgagattatattagatagaccgaaagccaatgcaattgatgccaaaaccagccatgaaatgggtgaggtatttatgcgttttcgtgatgatcctagtttacgcgttgccattattacaggtgctggcgaacgattcttttgtgccggctgggatttgaaagccgcagctgaaggagaagcccctgatgcagactttggtgctggtggctttgcgggcttaacggaattatttgatcttaataaacctgtcattgctgccattaacggctatgcttttgggggtggctttgaattagcactggcagccgacatgataatttgttcagacaatgcttcttttgccttgccagaagcacaattaggtattgtccctgacagtggcggtgttttacgtttacctaaacgcttacctcctgcaattgtcaatgaaatgctcatgactggccgtcgtatgaatgcacaagaggcgctacgctggggcattgctaaccgcgttgtcagtgcgactgaactgatggatagcgcccgtgaattagccgatcagatcgccaacagtgcgccacttgcagtcgctgcattaaaagagatctaccgtgccactagcgagctttcgattgaagaaggctacaaattaatgcgcagtggtgttctaaaatattacccacgtgttttacattcagaagatgcactcgaaggcccgctagcctttgccgaaaaacgctcacctgaatggaaaggacggtaa

SEQ ID NO: 6523 - protein, 261 aa, Proteus sp
MSQSLHLTTRGSVLEIILDRPKANAIDAKTSHEMGEVFMRFRDDPSLRVAIITGAGERFFCAGWDLKAAAEGEAPDADFGAGGFAGLTELFDLNKPVIAAINGYAFGGGFELALAADMIICSDNASFALPEAQLGIVPDSGGVLRLPKRLPPAIVNEMLMTGRRMNAQEALRWGIANRVVSATELMDSARELADQIANSAPLAVAALKEIYRATSELSIEEGYKLMRSGVLKYYPRVLHSEDALEGPLAFAEKRSPEWKGR

SEQ ID NO: 6524 - DNA, 786 bp, Salmonella typhi
  CDS (1)..(786): transl_table=11
atgagtgagtcattacatctgacccgtaacggcccgatcctggaaattaccctcgaccgacctaaagcgaatgccattgatgcgaaaaccagttttgcgatgggtgaagcttttcttaatttccgtgacgacccggaattacgcgtagcaatcattaccggcggcggggagaaattcttttctgcgggctgggacttaaaagcggcagcggaaggtgaagcgccggatgccgattttggtcccggcggctttgccggtttaaccgaaatatttgacctcgataagccggttatcgccgcggtgaacggctacgcatttggtggcggttttgagctggcgctggcggcagactttattgtctgcgccgaaaacgccagcttcgcgctgccggaagccaagctcggcatcgtgcctgacagcggcggcgtattgcgtctgcctaagctgctgccaccggctatcgtcaacgaaatggtaatgaccggcagacgaatgagcgccgaagaagcgctgcgttgggggatcgtgaaccgcgttgtcagccagagcgaactgatggagagcgcgcgcgaactggcgcaacaactggtcaatagcgctccgctggctatcgcggcgctgaaagagatttatcgcgcgaccagtgaaatgccggttgaagaaggctaccgctacatccgcagcggcgtgctgaaacattatccgtcggtactgcattcagaagatgcgctcgaaggaccgcaggcatttgccgaaaaacgcgctccggtgtggaaaggtcgttaa

SEQ ID NO: 6525 - protein, 261 aa, Salmonella typhi
MSESLHLTRNGPILEITLDRPKANAIDAKTSFAMGEAFLNFRDDPELRVAIITGGGEKFFSAGWDLKAAAEGEAPDADFGPGGFAGLTEIFDLDKPVIAAVNGYAFGGGFELALAADFIVCAENASFALPEAKLGIVPDSGGVLRLPKLLPPAIVNEMVMTGRRMSAEEALRWGIVNRVVSQSELMESARELAQQLVNSAPLAIAALKEIYRATSEMPVEEGYRYIRSGVLKHYPSVLHSEDALEGPQAFAEKRAPVWKGR

SEQ ID NO: 6526 - DNA, 786 bp, Salmonella typhimurium
  CDS (1)..(786): transl_table=11
atgagtgagtcattacatctgacccgtaacggcccgatcctggaaattaccctcgaccgacctaaagcgaatgccattgacgccaaaaccagctttgcaatgggtgaagcttttcttaatttccgtgacgatccggaattacgcgtagcaatcattaccggcggcggggagaaattcttttctgctggctgggacttaaaagcggcagcggaaggtgaagcgccggatgccgattttggtcccggcggctttgccggtttaaccgaaatatttgacctcgataagccggttatcgccgcggtgaacggctacgcgtttggcggcggttttgagctggcgctggcggcggactttattgtctgcgccgaaaacgccagcttcgcgctgccggaagccaagctcggcatcgtgcctgacagcggcggcgtattgcgtctgcctaagctgctgccaccggctatcgtcaacgaaatggtaatgaccggcagacgaatgagcgccgaagaagcgctgcgttggggagtcgtgaaccgcgttgtcagccagagcgaactgatggagagtgcgcgcgaactggcgcaacaactggtcaatagcgccccgctggctatcgcggcgctgaaagagatttatcgcgcgaccagcgaaatgccggtagaagaaggctaccgctacatccgcagcggcgtactgaagcattatccgtcggtgctgcattcagaagatgcgctcgaaggaccgcaggcatttgccgaaaaacgcgatccggtgtggaaaggtcgttaa

SEQ ID NO: 6527 - protein, 261 aa, Salmonella typhimurium
MSESLHLTRNGPILEITLDRPKANAIDAKTSFAMGEAFLNFRDDPELRVAIITGGGEKFFSAGWDLKAAAEGEAPDADFGPGGFAGLTEIFDLDKPVIAAVNGYAFGGGFELALAADFIVCAENASFALPEAKLGIVPDSGGVLRLPKLLPPAIVNEMVMTGRRMSAEEALRWGVVNRVVSQSELMESARELAQQLVNSAPLAIAALKEIYRATSEMPVEEGYRYIRSGVLKHYPSVLHSEDALEGPQAFAEKRDPVWKGR

SEQ ID NO: 6528 - DNA, 894 bp, Shigella flexneri
  CDS (109)..(894): transl_table=11
atgaaacgtcagggaactaccctgccagctaataatcacgccctaaaacaatatgcattttttgcagggatgttgtcgtccctaaaaaagcaaaaatggagaaaaggaatgagtgaatcattacatctgacccgcaatggatcaattctggaaattacccttgatcgcccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggtggttttgcgggattaaccgaaattttcaatctcgacaaaccagttatcgcagctgtgaacggctacgcctttggcggcggtttcgaactggcgctggcggcagattttattgtttgtgccgataacgccagcttcgccctgccggaagccaaactgggcatcgttcctgacagcggcggtgtgctgcgtctgccgaagatcctgccgcctaccatcgtcaatgaaatggtgatgacaggcagacgaatgggcgcagaagaggcgctgcgttgggggatagtcaaccgcgtggttagccaggcggaactgatggataacgcccgcgaactggctcagcagctggttaacagcgccccgctggcgattgcggcgctgaaagagatctaccgcaccaccagcgaaatgccggtagaagaagcgtatcgctatattcgcagcggcgtgttgaaacactatccatcggttctgcattcggaagatgccattgaagggccgctggcgtttgccgagaagcgcgatccggtgtggaaaggacgttaa

SEQ ID NO: 6529 - protein, 261 aa, Shigella flexneri
MSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPTIVNEMVMTGRRMGAEEALRWGIVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 6530 - DNA, 774 bp, Mycobacterium bovis; identical to SEQ ID NO: 2788
  CDS (1)..(774): transl_table=11

SEQ ID NO: 6531 - protein, 257 aa, Mycobacterium bovis; identical to SEQ ID NO: 2789

SEQ ID NO: 6532 - DNA, 774 bp, Rhizobium meliloti; identical to SEQ ID NO: 2792
  CDS (1)..(774): transl_table=11

SEQ ID NO: 6533 - protein, 257 aa, Rhizobium meliloti; identical to SEQ ID NO: 2793

SEQ ID NO: 6534 - DNA, 816 bp, Bacillus subtilis
  CDS (1)..(816): transl_table=11
atggctgaatggaaaacaaaacggacatacgatgagatattgtatgaaacgtataatggcattgcaaaaataacaatcaaccgacctgaggtacataatgcgtttacccctaaaacggttgctgaaatgattgatgcgtttgctgacgcaagagacgaccaaaacgttggggttatcgtgcttgccggtgcaggggacaaagcattttgttctggcggagaccaaaaagtgcgcggccacggtggatatgtaggagacgaccagatccctcgtcttaacgtattggatcttcagcgtttaatccgcgtcatcccgaaaccggttgttgcgatggtgtccggatatgcgatcggcggaggccatgtgcttcacatcgtatgtgacttgacaattgctgcggacaacgcaatttttggacaaacaggccctaaagtgggaagcttcgatgcaggttacggttctggctacctggctcgaattgtaggacataaaaaagcacgtgaaatctggtacctatgccgtcagtacaacgcacaggaagcactggacatgggtcttgtcaacacagtcgttcctttggaacagcttgaagaagaaacgattaaatggtgtgaagaaatgcttgaaaaaagcccgaccgcactgcgctttcttaaagctgcgtttaacgcggacacagacggacttgctggaattcagcagtttgcaggggatgctacccttctttactacacaacagatgaagcaaaagaaggccgtgattcctttaaggaaaaacgcaaacctgatttcggacagttccctcgttttccgtga

SEQ ID NO: 6535 - protein, 271 aa, Bacillus subtilis
MAEWKTKRTYDEILYETYNGIAKITINRPEVHNAFTPKTVAEMIDAFADARDDQNVGVIVLAGAGDKAFCSGGDQKVRGHGGYVGDDQIPRLNVLDLQRLIRVIPKPVVAMVSGYAIGGGHVLHIVCDLTIAADNAIFGQTGPKVGSFDAGYGSGYLARIVGHKKAREIWYLCRQYNAQEALDMGLVNTVVPLEQLEEETIKWCEEMLEKSPTALRFLKAAFNADTDGLAGIQQFAGDATLLYYTTDEAKEGRDSFKEKRKPDFGQFPRFP

SEQ ID NO: 6536 - DNA, 768 bp, Escherichia coli; identical to SEQ ID NO: 2564
  CDS (1)..(768): transl_table=11

SEQ ID NO: 6537 - protein, 255 aa, Escherichia coli; identical to SEQ ID NO: 2565

SEQ ID NO: 6538 - DNA, 789 bp, Escherichia coli
  CDS (1)..(789): transl_table=11
atgatggaattcatcctcagtcatgtagaaaagggcgtgatgacactaacgctcaaccgcccggaacgcctgaacagttttaatgatgagatgcacgcacaactggcagagtgcctgaaacaggtcgagcgcgacgacactatccgttgcctgttacttacaggtgccgggcgcggattttgtgctggtcaggatcttaacgatcgtaacgttgatcccacaggccccgcaccggatttagggatgtcagttgaacgtttctataacccactggtacgtcgcctggcaaaactgccaaaaccggtgatctgtgcagtcaatggcgtggcggcaggggcaggcgcaacactggcactggggggcgacatcgttattgctgcccgttcagcaaaattcgtcatggcgtttagtaagttaggcttaatacccgattgcggtggaacctggttactgccacgcgttgccggacgagcgcgcgccatggggctggcactgctggggaatcaactgagtgctgaacaggcgcacgaatgggggatgatctggcaggttgttgatgatgaaacgctggcagataccgcgcaacagctggcacggcatctggcgacacaaccgacatttggtcttggacttatcaagcaagcgataaatagcgctgaaaccaatacgctcgatacgcaactggatctggaacgtgactatcagcgacttgccggacggagcgcagattatcgtgaaggtgtcagtgcgttcctggctaaacgctcaccgcagttcacggggaaatag

SEQ ID NO: 6539 - protein, 262 aa, Escherichia coli
MMEFILSHVEKGVMTLTLNRPERLNSFNDEMHAQLAECLKQVERDDTIRCLLLTGAGRGFCAGQDLNDRNVDPTGPAPDLGMSVERFYNPLVRRLAKLPKPVICAVNGVAAGAGATLALGGDIVIAARSAKFVMAFSKLGLIPDCGGTWLLPRVAGRARAMGLALLGNQLSAEQAHEWGMIWQVVDDETLADTAQQLARHLATQPTFGLGLIKQAINSAETNTLDTQLDLERDYQRLAGRSADYREGVSAFLAKRSPQFTGK

SEQ ID NO: 6540 - DNA, 876 bp, Oryza sativa
  CDS (1)..(876)
atggccggcagcggcggcggcgaccgcggctcgcccgaggcggagctccggcgcgggttcaagacgctcgccgtgacgcggcccgacccgtccgcggcggtctacgaggtccgcctcaaccgccccacccggctcaacgccctcagcccggacgccttcgcggagatcccgcgcgccatggcgctcctcgaccgcgcccccgccgcgcgcgccgtcgtgctctccgccgccggcccgcacttctgcgccggcatcgagctcggctcccccgggagccccgccacggccccctccggcgaccccgcgcccgcggccgccgaggggctccgccgcgccatcctggagatgcaggcggcgctcacggccatcgagcggtgccggaagccggtggtcgcggcggtgcacggcgcctgcgtcggcggcggcgtcgaggtcgtggccgcctgcgacatacggtgctgctccaaggacgccacgttcgtgctcagggaggtggacatggccatcgtcgccgacctcggcgcgctgcagcggcttccgcggatcgtcgggtacgggaacgccgccgacctcgcgctcaccggccgcaagatcaccgccatggaggccaaggagatggggctcgtgaccagggtgttcaattccaagcaagaattggatgctggcgttgcaaagattgcaaaagaaatatctgagaagtcagcatgggcagtgatgggaacaaaggctgttttgctgagaagcagggatataacagtagagcagggcctggagcatgttgcaacatggaacgccgcaatgctgagatctaatgacctggaggaggctatccaagccttcctagagaagcggaagccagtcttctccaaactgtaa

SEQ ID NO: 6541 - protein, 291 aa, Oryza sativa
MAGSGGGDRGSPEAELRRGFKTLAVTRPDPSAAVYEVRLNRPTRLNALSPDAFAEIPRAMALLDRAPAARAVVLSAAGPHFCAGIELGSPGSPATAPSGDPAPAAAEGLRRAILEMQAALTAIERCRKPVVAAVHGACVGGGVEVVAACDIRCCSKDATFVLREVDMAIVADLGALQRLPRIVGYGNAADLALTGRKITAMEAKEMGLVTRVFNSKQELDAGVAKIAKEISEKSAWAVMGTKAVLLRSRDITVEQGLEHVATWNAAMLRSNDLEEAIQAFLEKRKPVFSKL

SEQ ID NO: 6542 - DNA, 903 bp, Oryza sativa; identical to SEQ ID NO: 2802
  CDS (1)..(903)

SEQ ID NO: 6543 - protein, 300 aa, Oryza sativa; identical to SEQ ID NO: 2803

SEQ ID NO: 6544 - DNA, 831 bp, Brassica napus; identical to SEQ ID NO: 2806
  CDS (1)..(831)

SEQ ID NO: 6545 - protein, 276 aa, Brassica napus; identical to SEQ ID NO: 2807

SEQ ID NO: 6546 - DNA, 831 bp, Brassica napus; identical to SEQ ID NO: 2808
  CDS (1)..(831)

SEQ ID NO: 6547 - protein, 276 aa, Brassica napus; identical to SEQ ID NO: 2809

SEQ ID NO: 6548 - DNA, 1020 bp, Glycine max; identical to SEQ ID NO: 2810
  CDS (1)..(1020)

SEQ ID NO: 6549 - protein, 339 aa, Glycine max; identical to SEQ ID NO: 2811

SEQ ID NO: 6550 - DNA, 915 bp, Triticum aestivum
  CDS (1)..(915)
atgcgcagcctacggggcctcctcgccgtctccggccacctcgccgcccgccacgcgccgccgagcggcgcctcctcgtctccccacagcgtcctcttcgcccgtgccctccagatcctctcccagccggagcccgtccgcctccacaagctctcggcgcccgactccgggatcgtggagctgaggctggagcggccggaggccaggaacgccatcgggaaggagatgctcaaggggctgcggagcgccatggacaaggtgaaggccgactcgacggccaacgttgtactggtagcgagctccgtgcccaaggtcttctgcgcgggcgctgacctcaaggaaaggaggttaatgggcccttctgaagtccgggaatttgttaataccttgagagctacattctcatcctttgaggcactccctattcctacaatagctgttgttgaaggagctgcctttggcggtgggctagagttggctctttcatgtgatcttcgtatatgtggggagagtgcaacattcagcttgccagaaaccggccttgctattattcctggagctggagggacacagcgtcttccaaggattgttggaagggccagagcaaaggaattgatattcactggccgtagatttgatgcgacagaagctgtaaatatgggggtagtgaactactgcgttcctggtggcgaggcttatcaaaaggctcttgaacttgcccgggagataaatcagaaaggtccgttagcgataaggatggccaagaaggccatcaacgaaggggtggaggtagacctgtcctctgcgttggctgtcgaagaagagtgctacgagcaagttctgcacactcaggatcgccttgaaggtctagctgcatttgcagagaaaagaagacctttgtacacaggaaagtga

SEQ ID NO: 6551 - protein, 304 aa, Triticum aestivum; identical to SEQ ID NO: 2815

SEQ ID NO: 6552 - DNA, 789 bp, Linum usitatissimum; identical to SEQ ID NO: 2816
  CDS (1)..(789)

SEQ ID NO: 6553 - protein, 262 aa, Linum usitatissimum; identical to SEQ ID NO: 2817

SEQ ID NO: 6554 - DNA, 801 bp, Helianthus annuus; identical to SEQ ID NO: 2820
  CDS (1)..(801)

SEQ ID NO: 6555 - protein, 266 aa, Helianthus annuus; identical to SEQ ID NO: 2821

SEQ ID NO: 6556 - DNA, 1017 bp, Brassica napus
  CDS (1)..(1017)
atggctgactccaaggaactcggcaccgcgagccgccgtatctccgtcttcaccaatcatctcatccccgtggaaacaattccaactcgcgttcactcagtggaactctctactgcctcgtcgatgaatgacaattaccataaggttcacggtgaagtgccgactcaccaagtcgtttggagaaaagctgatctcgtcggtgacgacggagaaacaaaagagtttgttgacattatatatgagaaagccgtcggtgaagatattgccaagatcactataaaccgtccggagaaaagaaacgcgttccggtctcagactgtgaaggagcttatgcgtgcgtttaacgacgccagagacgatagctctgtaggtgtcatcatactcaccggcaagggaacgaaagcgttttgcagtggtggtgatcaagcgttgaggacaccagatggttatgctgatcccaatgatgttggtcgacttaatgtccttgatctccaggttcaaatccgcagactgccaaaaccagttatcgcaatggctgctggttatgctgttggaggaggacatatcttgcacatggtctgtgatctaaccattgcagctgacaatgctattttcggtcagacgggtcctaaggttggaagttttgatgctggttatggaagttcaatcatgtctcgtctggttggtcctaaaaaggcacgggaaatgtggttcatgacgagattctacacagcttcggaagcagataaaatgggactcatcaatacagttgtaccgctagaggatttggagaaagaaactgtgaaatggtgcagagaaatcttacggaacagccctactgcaatccgtgtgcttaaggcagcactcaatgcagtcgatgatggccatgccggacttcaggggctaggaggtgatgccacgctcttattctatggaaccgaagaaggtatagaaggaagaacagcttatatgcaacgccgaccaccgaacttctctaaatttccccggcgaccttga

SEQ ID NO: 6557 - protein, 338 aa, Brassica napus; identical to SEQ ID NO: 2823

SEQ ID NO: 6558 - DNA, 831 bp, Brassica napus
  CDS (1)..(831)
atggattcctacaaaaccctagaaatcgttcgcaagaataccgactcctccgtcttccacgtcgtcctcaacaggccgtcgcagctcaacgccctatccctcgacttcttcgacgaattccccatagctctatcgtccctcgaccaaaacccagacgtcgccgtcatcatcctctccggcgccggaaaacacttctgctccggcatcgacctcgcttccctctcctcgatctcggcccaatcgtcctcaggcggcgacagagggcgctcgagtgagggtctacgacgcaggatcaaatcgatgcaggcggcgataaccgccgtggaagagtgccggaagcctgtgatcgcagctgtgcacggcgcgtgtatcggagggggagttgatctcgtcacggcttgtgacgttagatactgctccgaggacgctttcttctcgatcaaggaggttgatctagcgatcgttgcggatctcgggactctccagcggttgccgaggatcgtcgggcacgcgaaggctatggagttggcgttgacggcgagacgattctcgggatgtgaagcgaaggaacttggtcttgtttctcaggtcttcagatctaagtcggagcttgataaaggcatcaccatgatcgctgaaagaatagcagcgaagtctcctttagctgtgacagggacgaaggcagtgttgttgagaagcagagagatgagtgtagaacaaggtcttgactacgtagcaacttggaactcgggtatgcttatatcgaacgatctcaacgaagctgtctctgcgcagatgatgaaaagacaacctcgtttctctaaactgtga

SEQ ID NO: 6559 - protein, 276 aa, Brassica napus
MDSYKTLEIVRKNTDSSVFHVVLNRPSQLNALSLDFFDEFPIALSSLDQNPDVAVIILSGAGKHFCSGIDLASLSSISAQSSSGGDRGRSSEGLRRRIKSMQAAITAVEECRKPVIAAVHGACIGGGVDLVTACDVRYCSEDAFFSIKEVDLAIVADLGTLQRLPRIVGHAKAMELALTARRFSGCEAKELGLVSQVFRSKSELDKGITMIAERIAAKSPLAVTGTKAVLLRSREMSVEQGLDYVATWNSGMLISNDLNEAVSAQMMKRQPRFSKL

SEQ ID NO: 6560 - DNA, 906 bp, Brassica napus
  CDS (1)..(906)
atgagctttgtcaagtatctccgccgtgatagtttgctccagttagccggaaaacgatcccttagccgaagttgcatgcttcagacctgccggactctcatcattgaaaccgccccgcctgaatctgtcaagcttaaccgtctctctggttccgattctgggattgtcgaggtcaatctagacaggtctgtggccaaaaattccattaataaagagatgctgaaaggtctccagaccacatttgagaccatacatcatgatagttccgctagagttgtgatgatcacaagtctggttccaggagttttctgtgcaggtgcagatctcaaggaacgtagaactatgagtccatctgaggttcacacatatgtcaactccttgcgctacatgttctccttcatagaggcattgagtatcccaactattgctgcaatagaaggtgtggcactaggaggtggactcgaaatggctttatcctgtgatcttcgaatctgtggcgaaaatgcagtatttggtttgcctgaaacaggactcgctgtaatccctggtgctggtgggacacagagactctcaaggctggttggaagatcagtttcaaaggaacttatattcacaggtcgaaagattgatgcaagagaagctgcaaagaaagggctagttaacttctgtgttgcggcgggtgaggctcataagaaagcaatggaagtggctcagcagataaataataaaggtccaatggcgataaagatggcgaagaaagcgattgatgaaggaatagagacgaatatggcttcaggattagagctagaggagatgtgttatcagaagcttctaaacactgaagatcgtctggaaggattagctgcgtttgctgagaaacgtaagcctcgttacactggcaagtga

SEQ ID NO: 6561 - protein, 301 aa, Brassica napus; identical to SEQ ID NO: 2805

SEQ ID NO: 6562 - DNA, 1017 bp, Brassica napus
  CDS (1)..(1017)
atggctgactccaaggaactcggcaccgcgagccgccgtatctccgtcttcaccaatcatctcatccccgtggaaacaattccaactcgcgttcactcagtggaactctctactgcctcgtcgatgaatgacaattaccataaggttcacggtgaagtgccgactcaccaagtcgtttggagaaaagctgatctcgtcggtgacgacggagaaacaaaagagtttgttgacattatatatgagaaagccgtcggtgaagatattgccaagatcactataaaccgtccggagaaaagaaacgcgttccggtctcagactgtgaaggagcttatgcgtgcgtttaacgacgccagagacgatagctctgtaggtgtcatcatactcaccggcaagggaacgaaagcgttttgcagtggtggtgatcaagcgttgaggacaccagatggttatgctgatcccaatgatgttggtcgacttaatgtccttgatctccaggttcaaatccgcagactgccaaaaccagttatcgcaatggttgctggttatgctgttggaggaggacatatcttgcacatggtttgtgatctaaccattgcagctgataatgctattttcggtcagacgggtcctaaggttggaagttttgatgctggttatggaagttcaatcatgtctcgtctggttggtcctaaaaaggcacgggaaatgtggttcatgacgagattctacacagcttcggaagcagataaaatgggactcatcaatacagttgtaccgctagaggatttggagaaagaaactgtgaaatggtgcagagaaatcttacggaacagccctactgcaatccgtgtgcttaaggcagcactcaatgcagtcgatgatggccatgccggacttcaggggctaggaggtgatgccacgctcttattctatggaaccgaagaaggtatagaaggaagaacagcttatatgcaacgccgaccaccgaacttctctaaatttccccggcgaccttga

SEQ ID NO: 6563 - protein, 338 aa, Brassica napus; identical to SEQ ID NO: 2825

SEQ ID NO: 6564 - DNA, 918 bp, Zea mays
  CDS (1)..(918)
atgcgcagtccgcgaggcctcctcaccgcctccggctaccttgcgggccggcacgctccgtcgccctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatagagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcatgcgatcttcgaatatgtggagaaaatgctgaacttggactgccagaaacaagccttgctattatacctggagctggaggtacgcaacgccttcctaggatcatagggaggtccagagcaaaggaactgatattcactggccgcagatgtggtgcagctgaagctgtaacgatggggttagcaaactactgtgttccagcaggagaggcttaccagaaggctcttgacattgcctgtgagataactcagaagggtcccatggggataagaatggcaaagaaggcgatcaatgagggggcagaggttgccgacatgtcctcggcgctggctatcgaaggggagtgctacgagcagctgctttacacgcaggatcgcgttgaggccctagctgcatttgccgagaagaggaagcctgtgtacacaggaaagtag

SEQ ID NO: 6565 - protein, 305 aa, Zea mays; identical to SEQ ID NO: 2827

SEQ ID NO: 6566 - DNA, 909 bp, Zea mays
  CDS (1)..(909)
atgctcggcctccggcgcctccccgctgtctccggccgcctcgcgccggaggtcacctccgtctctgcggcctcctcccacagcgccgtcttctttcgcaccctccaaatcctcgtccagcaggggcccgtccgcctccaaaagctctctgctccggacaccgggatcgtggagctgaggctggagcggccggaggccaagaacgccatagggaaggagatgctccaggggctgcggagcgcgatccaggaggtggaggccgacacggctgcaaacgtcgtcttggtgacgagctcggtgcccaaggttttctgcgcgggcgccgatctcaaggaaaggaggttgatgggtcctagtgaagttcgggacttcgttaattccttaaggtctacattttcatcctttgaggcactgtctattcctacaattgctgttgtcgaaggggttgcttttggtggcgggttagaattggctctgtcatgtgatcttcgcatatgtggcaaggatgcaaaattcagtttgccagagactggccttgctattatcccaggtgctggaggaacacagcgccttcctaggattgttggaaggtcaagagcaaaagaactaatattcactggtcgtagattcgatgcggtggaggctgtaactatgggagtagtaaactactgtgttcctgccggcgacgcttatcaaaaggctcttgaacttgcgcgggagataaaccagaaaggcccgttagcagtaaaaatggctaagaaggccatcgatcaaggggcagaggtagacttgccctcggcattggtcgttgaagaagaatgctaccagcaagtcctgcacactgaggatcgtcttgagggtctagccgcattcgccgagaaaagaaagcctatatataaagggaagtag

SEQ ID NO: 6567 - protein, 302 aa, Zea mays; identical to SEQ ID NO: 2829

SEQ ID NO: 6568 - DNA, 918 bp, Zea mays
  CDS (1)..(918)
atgcgcagtccgcgaggcctcctcaccgcctccggctaccttgcgggccggcacgctccgtcggcctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatagagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcatgcgatcttcgaatatgtggagaaaatgctgaacttggactgccagaaacaagccttgctattatacctggagctggaggtacgcaacgccttcctaggatcatagggaggtccagagcaaaggaactaatattcactggcctcagatgtggtgcagctgaagctgtaacgatggggttagcaaactactgtgttccagcaggagaggcttaccagaaggctcttgacattgcctgtgagataactcagaagggtcccatggggataagaatggcaaagaaggcgatcaatgagggggcagaggttgccgacatgtcctcggcgctggctatcgaagaggagtgctacgagcagctgctttacacgcaggatcgcgttgaggccctagctgcatttgccgagaagaggaagcctgtgtacacaggaaagtag

SEQ ID NO: 6569 - protein, 305 aa, Zea mays; identical to SEQ ID NO: 2831

SEQ ID NO: 6570 - DNA, 810 bp, Zea mays; identical to SEQ ID NO: 2818
  CDS (1)..(810)

SEQ ID NO: 6571 - protein, 269 aa, Zea mays; identical to SEQ ID NO: 2819

SEQ ID NO: 6572 - DNA, 1011 bp, Zea mays
  CDS (1)..(1011)
atggacgctgcggagaggaggctggctcgcgtcgctgcccacctcgttccgtccttcccggtcccacacgccaccgggcctcccctcgcgccttctcccgcggcagcgtcctcgtcgtcgtcctcgccggcgggggacagctacaggcgcgtgcacggcgacgtgccgtcggagccaccggagtggcgcaccgccacagacgagtcagggaaggagttcgtcgacatcatctacgagaaggccgtcggagagggcatcgccaagatcaccattaaccggcctgacagaaggaacgccttccgtccgctgaccgtgaaggaactaatgcgcgcgttcaacgatgccagagatgatagttcgattggagtcatcattcttacagggaagggaaccaaggcgttctgcagcggcggtgaccaggcgttaagagattctgatggatatgtggacttcgatagctttggccgcctcaatgtcttagatctccaggtgcagattcgccgtcttccaaagcctgtcattgctatggttgctggttatgctgttggtggtggacatgttttgcacatggtgtgtgatataacaattgcagcagagaacgcgatatttgggcagacagggcccaaggttggaagctttgatgctggttatggatcttcgataatgtcccggttggttggacccaagagagcccgtgaaatgtggtttctgtcacggttctacacagctgacgaagctgacaaaatgggactcgtgaacaccgtagtaccgcttgctgaactggagcaggaaactgtcaaatggtgccgtcagatcttaagaaacagccccatggctattcgcgtgctgaaatctgcactcaacgcggcagatgatggccatgcaggccttcaggagctcggcgggaatgccacgctaatattttacggcacggaggaggcaaaggaagggaagaacgcgtacatggagagacgacgcccagatttctccaagttcccacgcaaaccttga

SEQ ID NO: 6573 - protein, 336 aa, Zea mays; identical to SEQ ID NO: 2833

SEQ ID NO: 6574 - DNA, 867 bp, Zea mays
  CDS (1)..(867)
atggccggcggcggcgaccgtgacgcatccgacgcggagctccgcgcggggttcgagaccctggccgtgacgcggccggacccttccgcgggggtctacgaggtccgcctcaaccgcccggcgcagcgcaacgcgctgagcccggccgcgttcgcggagatcccgcgcgccatgtctctgctggaccgcgccccctcggcgcgcgccgtggtgctgtccgccgcgggcccgcacttctgcgcgggcatcgagctcgggggccccggggacccgctgtccgccgcctccgccgatcccgtggccgccgcggaggggctccgccgcgcggtcctcgacatgcaggcggcgctcacggccatcgagcggtgccggaagcccgtcgtcgcggcggtgcacggcgcctgcgtcggcggcggcgtcgacctcgtggccgcctgcgacatcaggtgctgctccagggacgcctccttcgtgctcaaggaggtggacatggccatcgtcgccgacctcggcgcgctgcagcgcctcccgcggatcgtcggctacggcaacgctgctgacctcgcgctcaccggacgcaagatcaacgccatggaggccaaggacatggggttggttaccagggtctttgattccaagcaagacttggatgcgggcgtcgcaaagatcgccaaagaaatagctgacaagtcggcatgggcggtgattggaaccaaggccgttctgctgagaagcagggatgcgaccatagaacaaggcctggagcatgtagccacatggaacgcgggtatgatgaggtcgaacgatctgaaggaggccatcagagccttcctggagaagcggaagcctgtgttctccaagctgtaa

SEQ ID NO: 6575 - protein, 288 aa, Zea mays; identical to SEQ ID NO: 2835

SEQ ID NO: 6576 - DNA, 23 bp, Artificial sequence
  primer
atgaaacagcagggaactaccct

SEQ ID NO: 6577 - DNA, 24 bp, Artificial sequence
  primer
ttaacgtcctttccacaccggatc

SEQ ID NO: 6578 - protein, 329 aa, Artificial sequence
  consensus sequence
  Variant (3)..(4): Xaa in position 3 to 4 is any amino acid
  Variant (5)..(5): Xaa in position 5 is any or no amino acid
  Variant (8)..(31): Xaa in position 8 to 31 is any amino acid
  Variant (32)..(62): Xaa in position 32 to 62 is any or no amino acid
  Variant (64)..(67): Xaa in position 64 to 67 is any amino acid
  Variant (68)..(68): Xaa in position 68 is any or no amino acid
  Variant (70)..(71): Xaa in position 70 to 71 is any amino acid
  Variant (73)..(73): Xaa in position 73 is any amino acid
  Variant (75)..(80): Xaa in position 75 to 80 is any amino acid
  Variant (81)..(133): Xaa in position 81 to 133 is any or no amino acid
  Variant (135)..(135): Xaa in position 135 is any amino acid
  Variant (139)..(140): Xaa in position 139 to 140 is any amino acid
  Variant (142)..(142): Xaa in position 142 is any amino acid
  Variant (144)..(144): Xaa in position 144 is any amino acid
  Variant (148)..(154): Xaa in position 148 to 154 is any amino acid
  Variant (156)..(157): Xaa in position 156 to 157 is any amino acid
  Variant (158)..(163): Xaa in position 158 to 163 is any or no amino acid
  Variant (165)..(165): Xaa in position 165 is any amino acid
  Variant (167)..(169): Xaa in position 167 to 169 is any amino acid
  Variant (171)..(173): Xaa in position 171 to 173 is any amino acid
  Variant (175)..(177): Xaa in position 175 to 177 is any amino acid
  Variant (178)..(188): Xaa in position 178 to 188 is any or no amino acid
  Variant (190)..(192): Xaa in position 190 to 192 is any amino acid
  Variant (193)..(193): Xaa in position 193 is any or no amino acid
  Variant (195)..(195): Xaa in position 195 is any amino acid
  Variant (196)..(203): Xaa in position 196 to 203 is any or no amino acid
  Variant (205)..(209): Xaa in position 205 to 209 is any amino acid
  Variant (211)..(215): Xaa in position 211 to 215 is any amino acid
  Variant (217)..(218): Xaa in position 217 to 218 is any amino acid
  Variant (220)..(221): Xaa in position 220 to 221 is any amino acid
  Variant (222)..(222): Xaa in position 222 is any or no amino acid
  Variant (224)..(239): Xaa in position 224 to 239 is any amino acid
  Variant (240)..(264): Xaa in position 240 to 264 is any or no amino acid
  Variant (266)..(279): Xaa in position 266 to 279 is any amino acid
  Variant (281)..(296): Xaa in position 281 to 296 is any amino acid
  Variant (297)..(314): Xaa in position 297 to 314 is any or no amino acid
  Variant (316)..(317): Xaa in position 316 to 317 is any amino acid
  Variant (320)..(321): Xaa in position 320 to 321 is any amino acid
  Variant (324)..(325): Xaa in position 324 to 325 is any amino acid
  Variant (328)..(328): Xaa in position 328 is any amino acid
RPXXXNAXXXXXXXXXXXXXXXXXXXXXXXXXXXXXXXXXXXXXXXXXXXXXXXXXXXXXXXGXXXXXFXXGXDXXXXXXXXXXXXXXXXXXXXXXXXXXXXXXXXXXXXXXXXXXXXXXXXXXXXXXXXXXXPXIAAXXGXAXGGGXXXXXXXDXXXXXXXXAXFXXXEXXXGXXXXXXXXXXXXXXGXXXXLXXXXXXXXXAXXXXXTXXXXXAXXAXXXGXXXXXXXXXXXXXXXXXXXXXXXXXXXXXXXXXXXXXXXXXAXXXXXXXXXXXXXXKXXXXXXXXXXXXXXXXXXXXXXXXXXXXXXXXXXDXXEGXXAFXXKRXP

SEQ ID NO: 6579 - protein, 24 aa, Artificial sequence
  protein pattern
  Variant (2)..(2): Xaa in position 2 is any or no amino acid
  Variant (4)..(4): Xaa in position 4 is any or no amino acid
  Variant (6)..(7): Xaa in position 6 to 7 is any amino acid
  Variant (8)..(8): Xaa in position 8 is any or no amino acid
  Variant (10)..(10): Xaa in position 10 is any amino acid
  Variant (11)..(11): Xaa in position 11 is Ala, Cys or Val
  Variant (12)..(12): Xaa in position 12 is any amino acid
  Variant (13)..(13): Xaa in position 13 is Ala, Gly or Thr
  Variant (14)..(14): Xaa in position 14 is any amino acid
  Variant (16)..(22): Xaa in position 16 to 22 is any amino acid
  Variant (24)..(24): Xaa in position 24 is Phe, Ile, Leu, Met or Val
PXIXAXXXGXXXXXGXXXXXXXDX

SEQ ID NO: 6580 - protein, 18 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Ala or Gly
  Variant (7)..(8): Xaa in position 7 to 8 is any amino acid
  Variant (10)..(12): Xaa in position 10 to 12 is any amino acid
  Variant (13)..(13): Xaa in position 13 is Lys or Arg
  Variant (15)..(15): Xaa in position 15 is any amino acid
  Variant (16)..(16): Xaa in position 16 is Ala, Gly or Pro
  Variant (17)..(17): Xaa in position 17 is any amino acid
  Variant (18)..(18): Xaa in position 18 is Phe, Trp or Tyr
DXXXEXXXAXXXXRXXXX

SEQ ID NO: 6581 - DNA, 240 bp, ESCHERICHIA COLI
  CDS (1)..(240): transl_table=11
atggactctattcacggtcatgaagtgttaaatatgatgattgaatcaggcgagcaatatacgcatgccagtctggaagctgcgattaaagcgcgttttggtgaacaggcacgttttcacacctgctcggcagaagggatgacagcgggagagctggtagcgtttctggcagcaaaaggcaaatttataccttcgaaagacggtttttcgaccgatcagagtaagatttgccgtcactaa

SEQ ID NO: 6582 - protein, 79 aa, ESCHERICHIA COLI
MDSIHGHEVLNMMIESGEQYTHASLEAAIKARFGEQARFHTCSAEGMTAGELVAFLAAKGKFIPSKDGFSTDQSKICRH

SEQ ID NO: 6583 - DNA, 240 bp, Escherichia coli O157:H7 EDL933
  CDS (1)..(240): transl_table=11
atggactctattcacggtcatgaagtgttaaatatgatgattgaatcaggcgagcaatatacgcatgccagtctggaagctgcgattaaagcgcgttttggtgaacaggcacgttttcacacttgctcggcagaagggatgacagcgggagagctggtagcgtttctggcagcaaaaggcaaatttataccttcagaagaaggtttttcgaccgatcagagtaagatttgccgtcactga

SEQ ID NO: 6584 - protein, 79 aa, Escherichia coli O157:H7 EDL933
MDSIHGHEVLNMMIESGEQYTHASLEAAIKARFGEQARFHTCSAEGMTAGELVAFLAAKGKFIPSEEGFSTDQSKICRH

SEQ ID NO: 6585 - DNA, 240 bp, Salmonella typhimurium LT2
  CDS (1)..(240): transl_table=11
atggattccattcatggtcacgaagtgctcaacatgatgattgagtctggcgagcagtacacgcatacctcgctggaggcggcaataaaagcgcgctttggcgagcgggcacgatttcacacttgttcagcatcagatatgacggcggcggaactggtcgcgtttctggcggcgaaaggaaagtttattgcggtggaggacggtttttcaacgcatgagagtaaaatctgccgccattaa

SEQ ID NO: 6586 - protein, 79 aa, Salmonella typhimurium LT2
MDSIHGHEVLNMMIESGEQYTHTSLEAAIKARFGERARFHTCSASDMTAAELVAFLAAKGKFIAVEDGFSTHESKICRH

SEQ ID NO: 6587 - DNA, 252 bp, Shewanella oneidensis MR-1
  CDS (1)..(252): transl_table=11
atgcccgattctgttcacggtcatgatgttatggcgctgatggtagcgcaagccaaccccgttttaaagcctgagttaatcgcacagatagtccaaacctttggagaagcaacgcgttatcacacctgtagcgctgaaaatcttactgccgaggagttaatcagtttgttgttaagtaaaggaaaaataactgaatcagcacaagggctctcgcttgttgctgggcggcagtgtcatcattcccatcattga

SEQ ID NO: 6588 - protein, 83 aa, Shewanella oneidensis MR-1
MPDSVHGHDVMALMVAQANPVLKPELIAQIVQTFGEATRYHTCSAENLTAEELISLLLSKGKITESAQGLSLVAGRQCHHSHH

SEQ ID NO: 6589 - DNA, 240 bp, Escherichia coli CFT073
  CDS (1)..(240): transl_table=11
atggactctattcacggtcatgaagtgttaaatatgatgattgaatcaagcgagcaatatacgcatgccagtctggaagcagcaattaaagcgcgttttggtgaacaggcacgttttcacacctgctcggcagaagggatgactgcgggagagttggtggcgtttctggcagcaaaaggcaaatttataccttcagaagaaggtttttcaaccgatcagagtaagatttgccgtcactga

SEQ ID NO: 6590 - protein, 79 aa, Escherichia coli CFT073
MDSIHGHEVLNMMIESSEQYTHASLEAAIKARFGEQARFHTCSAEGMTAGELVAFLAAKGKFIPSEEGFSTDQSKICRH

SEQ ID NO: 6591 - DNA, 225 bp, Vibrio parahaemolyticus RIMD 2210633
  CDS (1)..(225): transl_table=11
atgatgagtgacattcatgctcacaacttactaaacctactacgtgaaaccccaatgagccgcgacgagctcgcacaacattttggcgcagacgcacgttttcatacctgtaagttgaatgatctagacttagatgcattgctaacctttttattacagcgcgataaggttcgcgaactcgaaggcaagttcgtcgtcaacatggcgcgtatttgcaaccattaa

SEQ ID NO: 6592 - protein, 74 aa, Vibrio parahaemolyticus RIMD 2210633
MMSDIHAHNLLNLLRETPMSRDELAQHFGADARFHTCKLNDLDLDALLTFLLQRDKVRELEGKFVVNMARICNH

SEQ ID NO: 6593 - DNA, 222 bp, Vibrio vulnificus YJ016
  CDS (1)..(222): transl_table=11
atgaatgatatccatgctcacaatcttcttcatctccttaaagaacaaccgatggaccgtgcagaattgcttgcgcatttcggtggcgatacccgttttcatacgtgcaaattacaagggctcgacttggactcactgctgagctttttgttggaacgagaaaaaatcagtgagcagcaaggaaaattctgtgtgaatctggcgcgaatctgtaatcactaa

SEQ ID NO: 6594 - protein, 73 aa, Vibrio vulnificus YJ016
MNDIHAHNLLHLLKEQPMDRAELLAHFGGDTRFHTCKLQGLDLDSLLSFLLEREKISEQQGKFCVNLARICNH

SEQ ID NO: 6595 - DNA, 240 bp, Klebsiella pneumoniae subsp. pneumoniae MGH 78578
  CDS (1)..(240): transl_table=11
atgtcttctattcatggtcatgaagttttacagatgatgctcgcctcgggtgagtcctggacggtcgcctcgctggaggccgccattcgccgccgctttggcgaagaggcgcggtttcacacctgttcagcagagaatctaagcgccgcacagttggtggcgtttttagagaaaaaaggcaaatttattgccagagaggaaggtcttactaccgcagaaaataagatctgccgacattaa

SEQ ID NO: 6596 - protein, 79 aa, Klebsiella pneumoniae subsp. pneumoniae MGH 78578
MSSIHGHEVLQMMLASGESWTVASLEAAIRRRFGEEARFHTCSAENLSAAQLVAFLEKKGKFIAREEGLTTAENKICRH

SEQ ID NO: 6597 - DNA, 240 bp, Erwinia carotovora subsp. atroseptica SCRI1043
  CDS (1)..(240): transl_table=11
atgtcatctattcacggccatgaagttttgcaaatgatgctcgcgtccggtgagtcatttaccactgaacaactgattaccaccatagaaacccgcttcggcaacgcagcgcgttttcatacctgctccgccgaaaacatgacagcctcaatgctggtgcaatttctgtctgaacgcggaaaatttatcccgcacgatgctggtttcaccaccagcgccagtaaaatctgccagcactag

SEQ ID NO: 6598 - protein, 79 aa, Erwinia carotovora subsp. atroseptica SCRI1043
MSSIHGHEVLQMMLASGESFTTEQLITTIETRFGNAARFHTCSAENMTASMLVQFLSERGKFIPHDAGFTTSASKICQH

SEQ ID NO: 6599 - DNA, 249 bp, Shewanella sp. MR-4
  CDS (1)..(249): transl_table=11
atgtccgattctgttcacggtcatgacgttatggcgctgatggtagcgcaagaaaatccgcttttaaagcctgagtttatcgccttgatggcacaaacctttggtgaaactgcgcgttatcatacctgcagcgccgaaaatttgcaggcggaagagcttattagcttattggttggcaaagggaaaattctggagtcagcgcaaggtttgacattggttgcggggcggcagtgtcatcattcccattga

SEQ ID NO: 6600 - protein, 82 aa, Shewanella sp. MR-4
MSDSVHGHDVMALMVAQENPLLKPEFIALMAQTFGETARYHTCSAENLQAEELISLLVGKGKILESAQGLTLVAGRQCHHSH

SEQ ID NO: 6601 - DNA, 240 bp, Photobacterium sp. SKA34
  CDS (1)..(240): transl_table=11
atgaatacatatcacgctcacgatatccttaatttactgattgaatctcaacagccgtacacaatagaaacactgaaagaaaaaattgcgaatagctacggcgctgatgtgacgttttacacctgcaagttaaaagatttaacgattgagcaattgttagaattttttgttgctaagaacaaagtgacagttacagatgacatagttacaactaacattgccaatatgtgccaccattaa

SEQ ID NO: 6602 - protein, 79 aa, Photobacterium sp. SKA34
MNTYHAHDILNLLIESQQPYTIETLKEKIANSYGADVTFYTCKLKDLTIEQLLEFFVAKNKVTVTDDIVTTNIANMCHH

SEQ ID NO: 6603 - DNA, 222 bp, Vibrio sp. Ex25
  CDS (1)..(222): transl_table=11
atgagtgaaatccatgcccacgagctgctaaacctacttcgagaaacgccaatggatcgcgaagcgctggcacagcactttggcaacaccgttcgctttcacacctgtaaactgaatgatctagacttagatgcattgctagcatttttgctcaagcgcgacaaaatccgtgagcttgaaggtaagtttgtggtcaatatggcgcgtgtctgcaatcactaa

SEQ ID NO: 6604 - protein, 73 aa, Vibrio sp. Ex25
MSEIHAHELLNLLRETPMDREALAQHFGNTVRFHTCKLNDLDLDALLAFLLKRDKIRELEGKFVVNMARVCNH

SEQ ID NO: 6605 - DNA, 24 bp, Artificial sequence
  primer
atggactctattcacggtcatgaa

SEQ ID NO: 6606 - DNA, 26 bp, Artificial sequence
  primer
ttagtgacggcaaatcttactctgat

SEQ ID NO: 6607 - protein, 79 aa, Artificial sequence
  consensus sequence
  Variant (2)..(4): Xaa in position 2 to 4 is any amino acid
  Variant (6)..(6): Xaa in position 6 is any amino acid
  Variant (8)..(9): Xaa in position 8 to 9 is any amino acid
  Variant (11)..(26): Xaa in position 11 to 26 is any amino acid
  Variant (27)..(32): Xaa in position 27 to 32 is any or no amino acid
  Variant (35)..(37): Xaa in position 35 to 37 is any amino acid
  Variant (43)..(51): Xaa in position 43 to 51 is any amino acid
  Variant (53)..(54): Xaa in position 53 to 54 is any amino acid
  Variant (57)..(60): Xaa in position 57 to 60 is any amino acid
  Variant (62)..(76): Xaa in position 62 to 76 is any amino acid
  Variant (78)..(78): Xaa in position 78 is any amino acid
MXXXHXHXXLXXXXXXXXXXXXXXXXXXXXXXFGXXXRFHTCXXXXXXXXXLXXFLXXXXKXXXXXXXXXXXXXXXCXH

SEQ ID NO: 6608 - protein, 39 aa, Artificial sequence
  protein pattern
  Variant (3)..(3): Xaa in position 3 is Glu, Gly or Asn
  Variant (4)..(4): Xaa in position 4 is any amino acid
  Variant (5)..(5): Xaa in position 5 is Ala, Thr or Val
  Variant (7)..(7): Xaa in position 7 is Phe or Tyr
  Variant (11)..(11): Xaa in position 11 is any amino acid
  Variant (12)..(12): Xaa in position 12 is Ala or Leu
  Variant (13)..(13): Xaa in position 13 is Glu, Asn, Gln or Ser
  Variant (14)..(14): Xaa in position 14 is Asp, Gly or Asn
  Variant (15)..(15): Xaa in position 15 is Leu or Met
  Variant (16)..(16): Xaa in position 16 is Asp, Gln, Ser or Thr
  Variant (17)..(17): Xaa in position 17 is Ala or Leu
  Variant (18)..(18): Xaa in position 18 is Ala, Asp, Glu, Gly or Ser
  Variant (19)..(19): Xaa in position 19 is any amino acid
  Variant (21)..(21): Xaa in position 21 is Ile, Leu or Val
  Variant (22)..(22): Xaa in position 22 is Ala, Gln or Ser
  Variant (23)..(23): Xaa in position 23 is Phe or Leu
  Variant (25)..(26): Xaa in position 25 to 26 is any amino acid
  Variant (27)..(27): Xaa in position 27 is Lys or Arg
  Variant (28)..(28): Xaa in position 28 is Asp, Glu or Gly
  Variant (30)..(30): Xaa in position 30 is any or no amino acid
  Variant (32)..(34): Xaa in position 32 to 34 is any amino acid
  Variant (35)..(35): Xaa in position 35 is Ala, Asp, Glu or Gln
  Variant (36)..(36): Xaa in position 36 is Gly or Gln
  Variant (37)..(38): Xaa in position 37 to 38 is any amino acid
  Variant (39)..(39): Xaa in position 39 is Cys, Ser, Thr or Val
FGXXXRXHTCXXXXXXXXXLXXXLXXXXKXIXXXXXXXX

SEQ ID NO: 6609 - DNA, 1185 bp, ESCHERICHIA COLI
  CDS (1)..(1185): transl_table=11
atgtcttttcaccttcggcttttttcaaggcataagcaaatgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataa

SEQ ID NO: 6610 - protein, 394 aa, ESCHERICHIA COLI
MSFHLRLFSRHKQMTNNESKGPFEGLLVIDMTHVLNGPFGTQLLCNMGARVIKVEPPGHGDDTRTFGPYVDGQSLYYSFINHGKESVVLDLKNDHDKSIFINMLKQADVLAENFRPGTMEKLGFSWETLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFNTQDKPITICCGNDKLFSALCQALELTELVNDPRFSSNILRVQNQAILKQYIERTLKTQAAEVWLARIHEVGVPVAPLLSVAEAIKLPQTQARNMLIEAGGIMMPGNPIKISGCADPHVMPGAATLDQHGEQIRQEFSS

SEQ ID NO: 6611 - DNA, 1538 bp, Bombyx mori
  CDS (112)..(1386)
caacgtagctacgacatgtaccttcttatcactatttgcgtgatatgttaataaagttgttgtattgttgatgacttcacagaaactctttacttgtggcttgtcattaaaatggagattttccaaaacttcagacgttgcgttctaagatcgcaaatcgtgatttcaaaattgaaatactcaacgaaattagatggactacttaatgacgttcatgttttggacttaagtcgtatagtagctggtccgttttgtactatgaccttgggcgatttaggcgcgaatgtaataaaagtggaaagcctaagcggagacgaggcccgaaaatggggccccccttttatgaaggactgcggggattcttattattttcaatctgtgaataggaataagaaaagcatttgtattgacttcaagtcacaggaaggaaagaaaataatatatgatctagcaaagaaatgtgatgtgctagtagagaacttcattcctgggaaactggaccagatggatgtaggatatgaaaagcttaaaactgtcaaccctaagcttatatactgtgctatcacaggtttgggacctagaggaccatatacaaaaaaacctggatatgatgtaatagcagcagctatgggtggactgctacacactacaggtgaacgcaatgggaacccagtaaaaacaggtgtagcaatcactgacattacaaagggcctgcatgccttcggagcgatcatggcggcattataccaccgtaatagcactggccgtggtcaaaagattgactgtaatttactctccactcagatatcaagtatgatcaatatagccacaatttatttgaactgtggtgttgagggtcaacgttggggaacggcacatgctaatctggtcccttaccaggctttcaaaactaaagatggttatatggttattggtacaggatcgaatccacaatttgctgacttctgtaagctcataaatcgtgaagatcttataaccgatgaaaggttcaaggataattctaatagagtggaaaatagagatgaaattatcaaaatcattagtgatgttatcattacaaagacaagcagagaatggagtgctttatttaaagatgcaacctttcccaatggaccaattaatactatgaaagatgtctttgatgatgagcatgtaaaagaaataggattggttaaagaattacagcacacaagtgcagggactctgaaggtagttggtcctccaacagagtttagcgaaggtggtaacttagcccgtactgcaccccctacattgggccaacatacaacagacattttatccgatttccttggttaccctgagagtaaaattcaaggattatttgaaaagaacatccttagataatgctttttttatttgttatttgtttcagttttgataatttgtaattttcatacttgttttcaacaaagatgttacacaatgaaagtagtttattttatttaatgcaataaaaatgtttattttgtgaaaaaaaaaaaaaaaaaaaaaaaaaa

SEQ ID NO: 6612 - protein, 424 aa, Bombyx mori
MEIFQNFRRCVLRSQIVISKLKYSTKLDGLLNDVHVLDLSRIVAGPFCTMTLGDLGANVIKVESLSGDEARKWGPPFMKDCGDSYYFQSVNRNKKSICIDFKSQEGKKIIYDLAKKCDVLVENFIPGKLDQMDVGYEKLKTVNPKLIYCAITGLGPRGPYTKKPGYDVIAAAMGGLLHTTGERNGNPVKTGVAITDITKGLHAFGAIMAALYHRNSTGRGQKIDCNLLSTQISSMINIATIYLNCGVEGQRWGTAHANLVPYQAFKTKDGYMVIGTGSNPQFADFCKLINREDLITDERFKDNSNRVENRDEIIKIISDVIITKTSREWSALFKDATFPNGPINTMKDVFDDEHVKEIGLVKELQHTSAGTLKVVGPPTEFSEGGNLARTAPPTLGQHTTDILSDFLGYPESKIQGLFEKNILR

SEQ ID NO: 6613 - DNA, 1167 bp, Novosphingobium aromaticivorans
  CDS (1)..(1167): transl_table=11
atggcgaaaccggcctggcgggccgcagtaaccggcgatccgtccaaaccgctcgatggggtacgggtgcttgagctcgcccgcattctggccggaccttggtgcgggcaattgctggcggacctgggcgccgaagtgatcaagatcgagcggcccggtgcgggcgacgacacgcggcattgggggccgccgttcgtgaccgcagaagacggtacgagtctgggcgcggcctatttccattcgaccaatcgcggcaagcgctccttcgcgatcgacatcgccagcgcggaaggccaggccatcatccgcgagctggcgaacggggccgacatcgtgatcgaaaactacaaggtcggcgggctggcgaaatacgggcttgaccatgccgcgctgtccgaactgaacccgcgcctgattacttgctcgatcaccgggttcgggcagaccgggccttatgcccaccgcgcgggctacgatttcatcgcccaggccatgggcggcatgatgtcgatgaccggcgaacccgatcgcgagccgcagaaggcgggcatcgcggtggccgacctgttcacgggcatgtacagcactgtggcgattctcgccgcgctcaaccgccgggaccgcaccggcagcggcgcccatatcgacatggcggtgctagatacccaggtggcggtcatggccaatcaggcgatgaactggatgacttcgggcaaagtcccgcgccggttcggcaacggtcatgccaatctggcaccgtatcaagccttccccacgcttgacggacccttggtgattgcggccggcaacgacggccagttcgccagcttgtgccgcgttttgcggtgttcactgcatgaagacccacgcttcgccacaaatcctgcccgtctcacgaaccgggcggaactggtcacaacggtcgaggggcgcacggcccagtggaaccgacaagcgctgttcgacgcgcttgaagaggttggcgtgccagccggaccgatcaacgaactcgacgaagtgttcgccgatccgcaggtcgtcgccagaggcctcgccgcaatggccggagggcgcaaaggcgtcgcgagcccgatcgtgatcgacggggtgcgaatggtttcgaatctggccgcgccgggaagtcccgagccggtcgaagatgaatag

SEQ ID NO: 6614 - protein, 388 aa, Novosphingobium aromaticivorans
MAKPAWRAAVTGDPSKPLDGVRVLELARILAGPWCGQLLADLGAEVIKIERPGAGDDTRHWGPPFVTAEDGTSLGAAYFHSTNRGKRSFAIDIASAEGQAIIRELANGADIVIENYKVGGLAKYGLDHAALSELNPRLITCSITGFGQTGPYAHRAGYDFIAQAMGGMMSMTGEPDREPQKAGIAVADLFTGMYSTVAILAALNRRDRTGSGAHIDMAVLDTQVAVMANQAMNWMTSGKVPRRFGNGHANLAPYQAFPTLDGPLVIAAGNDGQFASLCRVLRCSLHEDPRFATNPARLTNRAELVTTVEGRTAQWNRQALFDALEEVGVPAGPINELDEVFADPQVVARGLAAMAGGRKGVASPIVIDGVRMVSNLAAPGSPEPVEDE

SEQ ID NO: 6615 - DNA, 1176 bp, Mesorhizobium loti MAFF303099
  CDS (1)..(1176): transl_table=11
atggccgaaccacccctgaaaggcgtccgcgtcgtcgaactcgcccgcatccttgccgggccatgggccgggcaattgcttgccgatctcggcgccgacgtcatcaaggtcgaaagtcccgagggcggcgacgacacccgcaaatggggcccgcccttcgtcatgagccatgacggcgagaacctgtcggccgcttattaccattcctgcaaccgcggcaagcgctccatcgccatcgatttctcgacgccggagggtgcggagaccgtgcgccggctggtcgccacgtcggatgtgctgatcgagaacttcaagctcggcggcctgaagaaatacgggctcgactatgacagcctgcgcaagatcaacccgcgccttgtctattgctcgatcaccggcttcggccaggacgggccgtatgcgccgcgcgccggctacgacttcatcatccaggccatggccggtatgatgtcgatcaccggcgaagtcggccgcgagccgcaaaaggccggcgtcgccatctcggacatcttcaccgggctctattccgtcatcgccatacaggccgcgttgcgccatgccgaccggactggcgaaggccagcatatcgacatggcgctgtttgacacgcagatctcggcgctcggcaaccagaacctcaactacctcgtctccggcaagtcgccggtgcagatgggcaatgcgcatatgaacatcgcgccttacgaggtggtgccggttcgggacggccacatcatcctggcggtcggcaatgacggccagttcgccaaattctgtgccgcagtcgggttggatgaactgtcgaccaatcgcgactttgccaccaatccagcccgggtcgcgaaccgggtgaagctgcgcgaacgcatcgtcgaggcgctgagcacgctcgatcgcgacccgctgctggcaaagctggaagcggcaagtgtgccggcgagcccgatcaacacgatcggccagatgtttgccgacccgcagacgattgcgcgcggcatgcggctcgacctcgacgacggccatggcaatcttctgccttcggtgcgcgcgccgatggtgatgtcgggcacgccgctggtctacgagcgcccctcgccgcgcctgggcgaacacaccgacgaaatccttgccgaactggagagatcagcgacatga

SEQ ID NO: 6616 - protein, 391 aa, Mesorhizobium loti MAFF303099
MAEPPLKGVRVVELARILAGPWAGQLLADLGADVIKVESPEGGDDTRKWGPPFVMSHDGENLSAAYYHSCNRGKRSIAIDFSTPEGAETVRRLVATSDVLIENFKLGGLKKYGLDYDSLRKINPRLVYCSITGFGQDGPYAPRAGYDFIIQAMAGMMSITGEVGREPQKAGVAISDIFTGLYSVIAIQAALRHADRTGEGQHIDMALFDTQISALGNQNLNYLVSGKSPVQMGNAHMNIAPYEVVPVRDGHIILAVGNDGQFAKFCAAVGLDELSTNRDFATNPARVANRVKLRERIVEALSTLDRDPLLAKLEAASVPASPINTIGQMFADPQTIARGMRLDLDDGHGNLLPSVRAPMVMSGTPLVYERPSPRLGEHTDEILAELERSAT

SEQ ID NO: 6617 - DNA, 1200 bp, Thermoplasma volcanium GSS1
  CDS (1)..(1200): transl_table=11
atggataagccattgtctggcataaagatcatcgattttactagggcaatgtcaggtccattcgcaacaatgatcttaggagatcttggagcagaagtgataaaggtcgaaagcccagaaggtgatgaaacaagaagctgggtaccaccaatgatgaacggtcagagcgcttattttttaagtgtaaacagaaataagaagagcatagttgtagaccttaaaaagagtgaagggagagatatagcgctaaggctaattgaaggatctgacatagtagttgaaaattttaggccaggggtagctgaaaagctcggtatatcttacgaagatgcaaagagggtcaaccagaatgttatctactgcagcatctctggttacgggagcaccggtccttacatggggttatccggattcgatttaagtgttatggcgtttagcgggcttatgagtataactggggaacctaatggtgggcctgtaaaatttggagtgcctatagttgatatagttactggtatgtttgcagcaatatctataatatccgcattacgctttcgggataaaactggagaaggccagtacatagatacagcaatgatagattcagcagtaggtattcttacgcatcaggctacgtacttttttgcaacgggcaaagaccctgttaagctcggatcggcgcactccagcatagccccctatcaggccttccgaacaaaggatggatacattgtaataactgctggaagccaaaaaatatgggaaaatctatgtgatgcaattgaaatgccagaactgaagcaggatcctaggtttatgacaaacgagttgagggtaaaaaacaggtacgaacttgttcctgtaatagagcaatatctaacaaggctgtcgacttcacaagcatacagcaaactcacaaaatatggtgtaccttgttcaccggtaaacactgtatcagaagcgttgaagagtgatcaggtcaattatagggacatggtagtcggtgtgtttagcgacatttatggcaaggtaaagcttataaactcccctcttaagatgagcaggactcctgggcagatattttccgccccgcctgtattggggcagcatactatagatgtgctaaaggaatttggctttaggtcggaagaaatttctaatttaattgacagcaaaacaataatagcttatcaaaaataa

SEQ ID NO: 6618 - protein, 399 aa, Thermoplasma volcanium GSS1
MDKPLSGIKIIDFTRAMSGPFATMILGDLGAEVIKVESPEGDETRSWVPPMMNGQSAYFLSVNRNKKSIVVDLKKSEGRDIALRLIEGSDIVVENFRPGVAEKLGISYEDAKRVNQNVIYCSISGYGSTGPYMGLSGFDLSVMAFSGLMSITGEPNGGPVKFGVPIVDIVTGMFAAISIISALRFRDKTGEGQYIDTAMIDSAVGILTHQATYFFATGKDPVKLGSAHSSIAPYQAFRTKDGYIVITAGSQKIWENLCDAIEMPELKQDPRFMTNELRVKNRYELVPVIEQYLTRLSTSQAYSKLTKYGVPCSPVNTVSEALKSDQVNYRDMVVGVFSDIYGKVKLINSPLKMSRTPGQIFSAPPVLGQHTIDVLKEFGFRSEEISNLIDSKTIIAYQK

SEQ ID NO: 6619 - DNA, 1188 bp, Pseudomonas aeruginosa PAO1
  CDS (1)..(1188): transl_table=11
atgaccaatcagacgggcgccctgcgtggcctgaaaatcatcgatctcagccgggtcctcggcggaccctactgctcccaggcgctggccgaccacggcgccgaggtgatcaagctggaacccctcggcggcgacgagacccgtggctgggggccgcccttcgagggcgacacggcgtcctacttcaagggcgtgaaccgcaacaagaagggcatcgccgtcgacctggcgacggcggagggcatcgagctgctgctgcgcttgctggaggacgccgacgtactgctggagaacttcaagcccggcaccctggcgcgctgggggatcggctacgaggaggtgcttcgccagcgcttcccgcggctggtccactgcgcggtatcgggcttcggcgccgacggcccgctcggcggcctgcccggctacgacgcggcgatccaggcgatggccggactgatgagcgtgaacggcgaggccggcggcgacgcgttgcgcatcggcctgccgatcgtcgacatggtcaccgggctgaacgccatggccggcatcctcctcgccctccacgagcgccaggtcagcgggcgcgggcagtcggtggacatcaccctgtacgactgcggtatctccctgctgcacccgcacctgccgaactacttcgcttccggacgtacgccccggcgtagcggcaacgcccacccgaacatcgcgccctacgacagctaccgcaccggtaccgagccgatcttcctcgccgtcggcaacgaccgccagttcgcccgcctgtgcgagtacctgggagcggatgaactgccgggggacccgcgcttcgccgacaacggcaagcgctcggtcaaccgcgaggcgctgaagcgcgccctggaggactacctggcggcccacgacggtcgcgagctggccgagcggctgatccgtctcggcgtgccctgcggagccatcgccacggtggatcgggtggtggagcacccgcacacccgccatcgcgggatggtcgtcgaactcgagggctatcgcggcatcgcctcgccggtgaagctttcgcgcaccccggccagttaccgcgccgcgccgccggtgctgggcggagacacccgggaagtcctggcggaactgggattgagcgccgaggcgatcgacgcgctggtccggcgcggcatcgtccgcgcctga

SEQ ID NO: 6620 - protein, 395 aa, Pseudomonas aeruginosa PAO1
MTNQTGALRGLKIIDLSRVLGGPYCSQALADHGAEVIKLEPLGGDETRGWGPPFEGDTASYFKGVNRNKKGIAVDLATAEGIELLLRLLEDADVLLENFKPGTLARWGIGYEEVLRQRFPRLVHCAVSGFGADGPLGGLPGYDAAIQAMAGLMSVNGEAGGDALRIGLPIVDMVTGLNAMAGILLALHERQVSGRGQSVDITLYDCGISLLHPHLPNYFASGRTPRRSGNAHPNIAPYDSYRTGTEPIFLAVGNDRQFARLCEYLGADELPGDPRFADNGKRSVNREALKRALEDYLAAHDGRELAERLIRLGVPCGAIATVDRVVEHPHTRHRGMVVELEGYRGIASPVKLSRTPASYRAAPPVLGGDTREVLAELGLSAEAIDALVRRGIVRA

SEQ ID NO: 6621 - DNA, 1260 bp, Agrobacterium tumefaciens str. C58
  CDS (1)..(1260): transl_table=11
atgcggcgcggcaagcagcggtctataaaccggcaagcagaaaatcccgggggacagatgaccgacatgccgaacaggaaaccgccgctctcaggcatccgcgtcattgagctggcgcgtgttctggctggtccctgggcggggcagatgctggccgatatgggcgctgacgtcatcaaggtcgaaaaccccgaaggtggcgacgatacccgggcatgggggccacccttcgtcgaaagcgccgatggcgaaaacctgtctgccgcctattaccacgccaccaatcgtggcaaacgctccatcgtcgccgatctgaaaacgcccgaaggctgtgcgctggtgcgccggctggtccgcactgccgatgtcgttatcgaaaacttcaagcgcgacgggcttgccaaatatggcctcgattacgagagcctgagggtgctcaatccgaagctgatctattgctccatcaccggcttcggccagaccggaccttatgccgattttgccggatacgactatatcgtgcagggcatgtccggtttcatgtcgattacgggcgaaccggacggccagccgatgaaggccggcgtggcggtcgccgatatcttcaccggcatctattccgtgtcagccattcaggccgccctcatccacgccatgcgatcaggcgaggggcagcacatcgacatggcgcttctcgatgtgcaatcggccgtgctcgccaaccagaacatgaattacctgatctccggccgcccgcccatccggctcggtaacgcccacccgaatatttccccctatgaggtagtgccgacggccgatggtttcctgatcctcgcggtcggcaatgacggccagttccgccgcctctgcaacattctcggcattggcgcgattgccgatgacgaacgttatgcgacaaacaaggcccgcgtggcgcataaggtcgaagtgcggcagatcatttccaccgaaacgctgaaatggaacaagcgcgatcttctgactgcttgcgaaacgaacgccgtgccggccgggccgatcaactccatcgaggaaatgttcgccgatccgcaggttcaggcacgtggcctgcgcgtcgatctggaggcggaagacggcaccgtcatccccggtgtgcggacaccgattatcatgtcacagacgccgctgcgttatgagcgcccgagcccgaagctcggcgaacatcaggcgcaggtgctggccgaactggaaactatcgaaaggaccgcgacgccatga

SEQ ID NO: 6622 - protein, 419 aa, Agrobacterium tumefaciens str. C58
MRRGKQRSINRQAENPGGQMTDMPNRKPPLSGIRVIELARVLAGPWAGQMLADMGADVIKVENPEGGDDTRAWGPPFVESADGENLSAAYYHATNRGKRSIVADLKTPEGCALVRRLVRTADVVIENFKRDGLAKYGLDYESLRVLNPKLIYCSITGFGQTGPYADFAGYDYIVQGMSGFMSITGEPDGQPMKAGVAVADIFTGIYSVSAIQAALIHAMRSGEGQHIDMALLDVQSAVLANQNMNYLISGRPPIRLGNAHPNISPYEVVPTADGFLILAVGNDGQFRRLCNILGIGAIADDERYATNKARVAHKVEVRQIISTETLKWNKRDLLTACETNAVPAGPINSIEEMFADPQVQARGLRVDLEAEDGTVIPGVRTPIIMSQTPLRYERPSPKLGEHQAQVLAELETIERTATP

SEQ ID NO: 6623 - DNA, 1185 bp, Sinorhizobium meliloti 1021
  CDS (1)..(1185): transl_table=11
atggaagcgccgctcaagggcatccgcgtgctcgaacttgcccgcattctggcggggccctggatcgggcagaccctcgccgatctcggcgctgacgtcatcaaggtcgagagcccggccggagacgacacccggacctggggacctcccttcgtgacaggcgaagacgacgaaaggctggatgccgcctatttccacgcgtgcaaccgcggcaagaggtctgtcgttctcgattttacgaccgcagaggggcaggaggcggtgcgccgccttgccgcgcaatccgacgttttgctcgagaacttcaaggtcggcggcctcgccaaatacggcctcgattatgaaagtctgagcaaagtcaatccgcggctcatctattgctcggtgaccggattcggtcaggacgggccctatgctcatcgcgccggctacgactacatcgttcagggcatgagcggcatcatggacctgacgggcgagccggatcgcgaaccgcaaaaaatcggcgttgcctttgccgatattttcacggggctctatggtgtcatcgccgttcaggcggccctggcgcagcgggaacgcacgggcgagggccagcagatcgacatggcgctgctggactgcatgacgggcgtgctcgccaatcaggcgctgaactttctcgtttccggcaaggcgccgcgccggctcggcaatgcccatccgaatatcgcaccttaccaggtgttcccgacctccgacgggcacctgatcgtcgccgtcggcaacgaccggcaattcgtgaaattctgcgaactcctcggccgaccggacctcgcggccgacgcgcgctaccgcaccaatgcagaccgcgtgcagcaccgcgacagcctgacgccggaacttgcggcggaaaccgcgaagtacgagagggacacgctgctcgaaaagctcgaagcgtcaggcgttcccggcggccccatcaacaccgtcgccgacgtattcgccgatccgcagattgttcatcggcagatgcgggtggacacgccgcataccggtgcagcggcgggaacatcgccgggcgtcagaacgccgatccgcttttccggcgcaacccttgcgctggaccgtggcgtgcctcggctcggggaacatacggcggaggtgctggcggagatcggaatgaattcgccgaagggcggataa

SEQ ID NO: 6624 - protein, 394 aa, Sinorhizobium meliloti 1021
MEAPLKGIRVLELARILAGPWIGQTLADLGADVIKVESPAGDDTRTWGPPFVTGEDDERLDAAYFHACNRGKRSVVLDFTTAEGQEAVRRLAAQSDVLLENFKVGGLAKYGLDYESLSKVNPRLIYCSVTGFGQDGPYAHRAGYDYIVQGMSGIMDLTGEPDREPQKIGVAFADIFTGLYGVIAVQAALAQRERTGEGQQIDMALLDCMTGVLANQALNFLVSGKAPRRLGNAHPNIAPYQVFPTSDGHLIVAVGNDRQFVKFCELLGRPDLAADARYRTNADRVQHRDSLTPELAAETAKYERDTLLEKLEASGVPGGPINTVADVFADPQIVHRQMRVDTPHTGAAAGTSPGVRTPIRFSGATLALDRGVPRLGEHTAEVLAEIGMNSPKGG

SEQ ID NO: 6625 - DNA, 1203 bp, Agrobacterium tumefaciens str. C58
  CDS (10)..(1203): transl_table=11
atgaccgacatgccgaacaggaaaccgccgctctcaggcatccgcgtcattgagctggcgcgtgttctggctggtccctgggcggggcagatgctggccgatatgggcgctgacgtcatcaaggtcgaaaaccccgaaggtggcgacgatacccgggcatgggggccacccttcgtcgaaagcgccgatggcgaaaacctgtctgccgcctattaccacgccaccaatcgtggcaaacgctccatcgtcgccgatctgaaaacgcccgaaggctgtgcgctggtgcgccggctggtccgcactgccgatgtcgttatcgaaaacttcaagcgcgacgggcttgccaaatatggcctcgattacgagagcctgagggtgctcaatccgaagctgatctattgctccatcaccggcttcggccagaccggaccttatgccgattttgccggatacgactatatcgtgcagggcatgtccggtttcatgtcgattacgggcgaaccggacggccagccgatgaaggccggcgtggcggtcgccgatatcttcaccggcatctattccgtgtcagccattcaggccgccctcatccacgccatgcgatcaggcgaggggcagcacatcgacatggcgcttctcgatgtgcaatcggccgtgctcgccaaccagaacatgaattacctgatctccggccgcccgcccatccggctcggtaacgcccacccgaatatttccccctatgaggtagtgccgacggccgatggtttcctgatcctcgcggtcggcaatgacggccagttccgccgcctctgcaacattctcggcattggcgcgattgccgatgacgaacgttatgcgacaaacaaggcccgcgtggcgcataaggtcgaagtgcggcagatcatttccaccgaaacgctgaaatggaacaagcgcgatcttctgactgcttgcgaaacgaacgccgtgccggccgggccgatcaactccatcgaggaaatgttcgccgatccgcaggttcaggcacgtggcctgcgcgtcgatctggaggcggaagacggcaccgtcatccccggtgtgcggacaccgattatcatgtcacagacgccgctgcgttatgagcgcccgagcccgaagctcggcgaacatcaggcgcaggtgctggccgaactggaaactatcgaaaggaccgcgacgccatga

SEQ ID NO: 6626 - protein, 397 aa, Agrobacterium tumefaciens str. C58
MPNRKPPLSGIRVIELARVLAGPWAGQMLADMGADVIKVENPEGGDDTRAWGPPFVESADGENLSAAYYHATNRGKRSIVADLKTPEGCALVRRLVRTADVVIENFKRDGLAKYGLDYESLRVLNPKLIYCSITGFGQTGPYADFAGYDYIVQGMSGFMSITGEPDGQPMKAGVAVADIFTGIYSVSAIQAALIHAMRSGEGQHIDMALLDVQSAVLANQNMNYLISGRPPIRLGNAHPNISPYEVVPTADGFLILAVGNDGQFRRLCNILGIGAIADDERYATNKARVAHKVEVRQIISTETLKWNKRDLLTACETNAVPAGPINSIEEMFADPQVQARGLRVDLEAEDGTVIPGVRTPIIMSQTPLRYERPSPKLGEHQAQVLAELETIERTATP

SEQ ID NO: 6627 - DNA, 1203 bp, Brucella melitensis 16M
  CDS (1)..(1203): transl_table=11
ttggcccgctcgcaatttgcgggcgggctttcttatattcatttgggattgctgaacatgcagaacacaccgcttgacggtctcaaggtggtcgaactggcgcgtattctggccgggccatgggttggccagacgctctgcgatcttggtgccgatgtgatcaaggtcgaaagccctgagggtgatgacacacgcacctgggggccgcctttcattgatgtcgaaggcgaacggtcggctgcgtatttccatgcctgcaatcgcggcaaacggtccattacagccgattttcgcaccgaggagggcagggagctcgtgcgccgtctggtggcggaggctgacgtcgtcatcgagaatttcaagctgggtgggctcgacaaatacggtctggattatgaaagcctgaaagcgataaatccgcagctcatctattgctcaatcacggggttcggccataccggcccttatgcggagcgtgccggatatgacttcatgatccagggcatgggcggcatcatggatttgaccggcgagccagaccgcgagccgcagaaaatcggtgtggcctttgcggatatctttaccggcctttatagcgtgattgcgatccagtcggcccttatcatgcgcgcgcgtaccggcaagggccagcatatcgatatggccttgtttgattgcatgtcgggggtgctggccaatcaggccatgaattaccttgcttccggcaaatcgccgaagcgcatggggaacgcgcatccaaatatcgcgccttatcagacgctttctgtttcagatggttacttcatcatcgcctgtggcaatgatgggcaatttggaaagctttctacgctgctgggtatcggtgaactggcaaaggacgagcgtttcgctaccaattcggcacgcgtcgccaatcgtgcggcccttacggcgctattggaggaacgcacaaaacagtggaagcgtgacgacctgctggcagagcttgcgaaaataggcgtacccgccggcccgatcaatacggtggccgatgtcttcgccgatccgcaattcaaggcgagagggatgaagatcgacccgcagggtgttccgggattgcgcacgccgatccgcttctctgatgctgatttaaaactcgacagccgctcgccgaaactaaatgaacacggcgctgcgatccgcgccgaactcgacaaaggctga

SEQ ID NO: 6628 - protein, 400 aa, Brucella melitensis 16M
MARSQFAGGLSYIHLGLLNMQNTPLDGLKVVELARILAGPWVGQTLCDLGADVIKVESPEGDDTRTWGPPFIDVEGERSAAYFHACNRGKRSITADFRTEEGRELVRRLVAEADVVIENFKLGGLDKYGLDYESLKAINPQLIYCSITGFGHTGPYAERAGYDFMIQGMGGIMDLTGEPDREPQKIGVAFADIFTGLYSVIAIQSALIMRARTGKGQHIDMALFDCMSGVLANQAMNYLASGKSPKRMGNAHPNIAPYQTLSVSDGYFIIACGNDGQFGKLSTLLGIGELAKDERFATNSARVANRAALTALLEERTKQWKRDDLLAELAKIGVPAGPINTVADVFADPQFKARGMKIDPQGVPGLRTPIRFSDADLKLDSRSPKLNEHGAAIRAELDKG

SEQ ID NO: 6629 - DNA, 1248 bp, Brucella melitensis 16M
  CDS (1)..(1248): transl_table=11
atgataatgggtgctttaacgggatatcgcgttctcgatatgagccgtgttctggccgggccgtggtgcggtcagattctggccgatcttggcgcggaggtcatcaagatcgaacgcccgcgcacaggcgatgacacacgcgactgggggccgccatggatgaaggacgagcagggcaacccgacgcgcgaagcgtcctattaccagtcggccaaccggggcaagttttcggtcgcgctcaatattgcatcgcccgaagggcaggacctgctgcgcaagatggtcgccgaatgcgatgtcctgatcgaaaattacaaggccggatcgcttgccaaatatggcctcgattacgaaacgctctcggcaatcaatccgggcctcgtctattgttcggtcacggggtttggacagaccgggccgcgcgcgcctgaacctggctatgatttcatcatccagggtattggcgggctgatgagcatcaccggcgaaagggatgacaagccgggtggcggcccgcagaaggtgggtgttgccgtggccgatctgatgaccggcctttattcggccatcgcgatcgaggcagcgcttctcagccgcgccaaaacgggcaaagggcagcatatcgatatggcgctgcttgatgttcaggtggcggctctgtgcaaccagagccagaactatctggtatcgggaagaccgccgggacgatatggcaatgcacatgcgaatatcgtgccctatcaggtcttccgggccagtgaccgcgatttcattatcgcttgcggcaatgatgcgcagtttgtttccctttgtgatgccatcggcttgccggatctgccgaaagacccgcgttttacgcgcaattccgaccgggtgatccaccgcgatgaaatcatcggcattctcgcggcgcatttcctgacgggcacggcggatgagtggatcggcagaatccatccacgtggtgttccggttggcgctatcaatgatattgcgcgcaccctggacgaaccacaggtcaaggcgcgcaatatgctggtgcagattccgcatcctttgaacaaggatttcgtcacggtcggcagccccttcaagctttcgggaacgccggtggaatacaagcgtgccgcccccatgctgggtgaacataccgacacgcttctccagcaattggcgaaactggacgatgataggctgaacgacctcaagtcgcgcggcattatcgagcagttcaactctggcgaatga

SEQ ID NO: 6630 - protein, 415 aa, Brucella melitensis 16M
MIMGALTGYRVLDMSRVLAGPWCGQILADLGAEVIKIERPRTGDDTRDWGPPWMKDEQGNPTREASYYQSANRGKFSVALNIASPEGQDLLRKMVAECDVLIENYKAGSLAKYGLDYETLSAINPGLVYCSVTGFGQTGPRAPEPGYDFIIQGIGGLMSITGERDDKPGGGPQKVGVAVADLMTGLYSAIAIEAALLSRAKTGKGQHIDMALLDVQVAALCNQSQNYLVSGRPPGRYGNAHANIVPYQVFRASDRDFIIACGNDAQFVSLCDAIGLPDLPKDPRFTRNSDRVIHRDEIIGILAAHFLTGTADEWIGRIHPRGVPVGAINDIARTLDEPQVKARNMLVQIPHPLNKDFVTVGSPFKLSGTPVEYKRAAPMLGEHTDTLLQQLAKLDDDRLNDLKSRGIIEQFNSGE

SEQ ID NO: 6631 - DNA, 1146 bp, Oceanobacillus iheyensis HTE831
  CDS (1)..(1146): transl_table=11
ttgtcgatgagtttagaagggttaaagattttggatcttactcgtgttcttgctggtccttattgtactatgattctggctgatttaggcgctgaagtaattaaagtagaagctcctggaggaagtgatgaaactagagattggggtcccccatttcaacatggagtaagtgcatattacctttgtgcaaatcgaaataaaaagagtattacaattgaccttaaatcctcaagtggtattcattatttgaaggaacttgttaaagaatcagatgtaattgtaaataattttaagtctggcacgatggaacgttttggattagattatcaaacactttccacgcttaatccaagtattatatatgcatctataactggctttggtgaaactggtccatataaggatatgcctggatatgacttcattattcaagcaatgagcgggctaatgagtattacaggtagccccgaatctggaccgcaaaaagtcggtattgcaataacagatgtattaactggcttatatacttgtattggaatccaagcagccttgttagaaagacagcaatcaggtaaaggacaaaaaatagatatatccttatatgataccgctgttagttctttagtaaatgttgcaagtaattatttaatgtcaggtcaaaatccaaaatcactaggaaataatcacccaaatattgtaccttaccaaacatttaagaccgaagataaagatattgttatcgcggtaggaaatgatgcacaatttaagagattgtgccacatactccaattagatgacctattaaacgataatcgatttcgaacaaacgccagccgtgttcaacatcgtgacattttaatcccattacttcaagaatctctaatactccaaccagctgattactggataaaagctttacaagaagaaaaaattccatgtggtccaatccaaactatcgataaacttcccaaagacccacaattacaaagtagagaaatgtttgtatctatgcatcatcaaacggcaggtccaatcaaacttattggtaacccactgaaattttccaggacaccaattacctatcgtcacgcaccgcctaaccctggagaacataacaccgattatatacatttgaaaggagattag

SEQ ID NO: 6632 - protein, 381 aa, Oceanobacillus iheyensis HTE831
MSMSLEGLKILDLTRVLAGPYCTMILADLGAEVIKVEAPGGSDETRDWGPPFQHGVSAYYLCANRNKKSITIDLKSSSGIHYLKELVKESDVIVNNFKSGTMERFGLDYQTLSTLNPSIIYASITGFGETGPYKDMPGYDFIIQAMSGLMSITGSPESGPQKVGIAITDVLTGLYTCIGIQAALLERQQSGKGQKIDISLYDTAVSSLVNVASNYLMSGQNPKSLGNNHPNIVPYQTFKTEDKDIVIAVGNDAQFKRLCHILQLDDLLNDNRFRTNASRVQHRDILIPLLQESLILQPADYWIKALQEEKIPCGPIQTIDKLPKDPQLQSREMFVSMHHQTAGPIKLIGNPLKFSRTPITYRHAPPNPGEHNTDYIHLKGD

SEQ ID NO: 6633 - DNA, 1146 bp, Shigella flexneri 2a str. 301
  CDS (1)..(1146): transl_table=11
atgacaaataatgaaagcaaagggccgtttgaaggcttattagttatcgatatgacacatgtccttaatggacctttcggaactcaacttctttataatatgggcgcaagggtaattaaagttgagccaccaggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcctaggtacaatggaaaaactggggttttcatgggaaaggttacaagaaatcaacccgcgcctcatatatgcttcatcgtcaggtttcggacataccggtccgctaaaagatgctcctgcctacgataccatcattcaggcaatgagtgggataatgatggaaacagggtaccctgatgctccgccagtgcgtgttggtacctctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatattgcgacagggaagtcaccacaacgcctgggaaatcgccatccctacatggcaccttttgatgttttcgatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcgaacgttaaaaacgcaggcagctgaagtttggttagccaaaatacatgaagttggtgtgcccgtcgcgccgttattaagtgtggctgaggccattaatttgccacaaactcaggcgagaaatatgttgattgaagccggaggaataatgatgccgggtaatccgataaaaatcagcggctgcgcggacccgcatgttatgccgggagcggcaacgctcgaccagcatggggaacaaattcgccaggagttctcatcataa

SEQ ID NO: 6634 - protein, 381 aa, Shigella flexneri 2a str. 301
MTNNESKGPFEGLLVIDMTHVLNGPFGTQLLYNMGARVIKVEPPGHGDDTRTFGPYVDGQSLYYSFINHGKESVVLDLKNDHDKSIFINMLKQADVLAENFRLGTMEKLGFSWERLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFDTQDKPITICCGNDKLFSALCQALELTELVNDPRFSSNILRVQNQAILKQYIERTLKTQAAEVWLAKIHEVGVPVAPLLSVAEAINLPQTQARNMLIEAGGIMMPGNPIKISGCADPHVMPGAATLDQHGEQIRQEFSS

SEQ ID NO: 6635 - DNA, 1257 bp, Corynebacterium efficiens YS-314
  CDS (1)..(1257): transl_table=11
atgagtcatgtcgctaaaagccaaatggaagaggtcgatcacatgacaatccaggacaggcccgtccgcaccgggcacggccccctcgagggcatagtcgttgcagacttctcccgcgtgctcgccggcccctacggcaccatgctgctcgcggatctgggcgccaccgtgatcaaggtggaagcccccaacggggatgacacccgcgcctgggtccccccggcgcgcgacggggtgggcacctactacctctcggtcaaccgcaacaaggattcggtggtgctggatctgaaggatccggtggatctcgagaccgcctatgacatcatcgaccgcgccgatgtcttcgtggagaatttcaagccgggcggtctggcccagtacggcctggatccggagtccgtcgcgcgtcgctggccgcacctggtgcatgcctccatcaccggtttcggccttgagggcggcgcccacatgccgggttatgacctgctggtccaggcgatgtccggtctcatgcacgtcaccggcagccaacacggtcccccgcagcgcacgggtgtggccatcttcgatgtggtaacgggtatgcacgccgtcatcggtatcctcgccgccctgcgtgagcgcacggtctccggtctgggccagcacatcgtgcttgatctgttgtcgtccgcccagtccagcctggtcaaccagtccaccgggtacgccgcctgtgggaacgagccgatgcgcatgggcaatgagcaccccagcctctacccctatggcccgttcatggccgccgaccgcgaggtggtcatctgcgtgggcaatgactcccagttcacccgcctggtgacgctgctgggtctgcctgagctggccgatgatccgcgctactccaccatgcggggccgcaatctcaaccgcaccaccctggaaccgttgatcacgcaggcgctggcctcccggaccgccgatgagtggttcgaggccttccagtccatcaatgtcccctccgcccccattctcaccgttggggagggtgtgcgcttcgcccagaaactcgggctggagaccgtcgtggaggtcggtgacggtgaggcagcggtccccctgatcaagaacccgatctccttcagccgcagcgaggtgagctaccacaaggccccgccggcactggatcaggacggggaggcggtgcgcacctggctggccaacaccgcccccaccaccgccgccgcagtccgtctctcccgagtggaggtgtaa

SEQ ID NO: 6636 - protein, 418 aa, Corynebacterium efficiens YS-314
MSHVAKSQMEEVDHMTIQDRPVRTGHGPLEGIVVADFSRVLAGPYGTMLLADLGATVIKVEAPNGDDTRAWVPPARDGVGTYYLSVNRNKDSVVLDLKDPVDLETAYDIIDRADVFVENFKPGGLAQYGLDPESVARRWPHLVHASITGFGLEGGAHMPGYDLLVQAMSGLMHVTGSQHGPPQRTGVAIFDVVTGMHAVIGILAALRERTVSGLGQHIVLDLLSSAQSSLVNQSTGYAACGNEPMRMGNEHPSLYPYGPFMAADREVVICVGNDSQFTRLVTLLGLPELADDPRYSTMRGRNLNRTTLEPLITQALASRTADEWFEAFQSINVPSAPILTVGEGVRFAQKLGLETVVEVGDGEAAVPLIKNPISFSRSEVSYHKAPPALDQDGEAVRTWLANTAPTTAAAVRLSRVEV

SEQ ID NO: 6637 - DNA, 1221 bp, Pseudomonas putida KT2440
  CDS (1)..(1221): transl_table=11
atgggcgcgctatcacatctgcgggtgctagacctttcgcgcgtgttggccggcccgtggtctggtcagattctggctgaccttggtgccgacgtgatcaaggtcgagcgcccaggcagtggcgacgatacccgctcatgggggccgcctttcctcaaggatgtcgaaggtgaggacaccagtgaggcggcttactacttgtcggccaaccgcaacaagcgctcagtgaccatcgactttacccagccggaggggcaacggctggtgcgggagctggcggcgaagtgcgatatcgtcatagagaacttcaaggtgggtgggctggctgcctatggcctggactaccagagcctcaaggcggtaaacccgcagctcatctattgctccattaccggcttcggtcagaccgggccctatgccaagcgcgctggctatgacttcatgatccaggggttgggtgggctgatgagcctgaccggccgtccggagggtgaagaaggcgcagggccggtcaaggtgggtgtggcgcttaccgatattctgaccgggttgtattccgcggtcgccatgctggctgccctcgcccatcgggatcagacaggggtcggccagcatgtcgacatggcattgcttgatgtgcaggtggcctgtctggcgaaccaggcgatgaactacctgaccacgggcacccctccccgtcggctgggtaatgcgcatcctaatatagtcccttaccaggactttccgacggcagatggcgatttcattcttaccgtcggtaatgacagccagttccgcaagttcgctgaggtggccgggcagccgcaatgggcggaggaccctcggttcgttaccaataagctgcgggtcgccaaccgggctgagctgatacctttgattcgccaggctacggtgttcaagaccacggctgagtgggtggcccagttggaggctgcaggagtgccatgtgggcctatcaataacctggcgcagatgttccaggacccccaggtgctggcgcgcgggttggcgttgaatatcccgcatccattggcgggtagtgtgccgcaagttgcgagcccgatacggttgtcggagacgccagtggagtatcgccgggcgccaccactgctgggcgagcataccgaagtggtgctgggggaagtgttggggctggatgctggcgaggtacagcgtctgcgtgatgctggggtgctctag

SEQ ID NO: 6638 - protein, 406 aa, Pseudomonas putida KT2440
MGALSHLRVLDLSRVLAGPWSGQILADLGADVIKVERPGSGDDTRSWGPPFLKDVEGEDTSEAAYYLSANRNKRSVTIDFTQPEGQRLVRELAAKCDIVIENFKVGGLAAYGLDYQSLKAVNPQLIYCSITGFGQTGPYAKRAGYDFMIQGLGGLMSLTGRPEGEEGAGPVKVGVALTDILTGLYSAVAMLAALAHRDQTGVGQHVDMALLDVQVACLANQAMNYLTTGTPPRRLGNAHPNIVPYQDFPTADGDFILTVGNDSQFRKFAEVAGQPQWAEDPRFVTNKLRVANRAELIPLIRQATVFKTTAEWVAQLEAAGVPCGPINNLAQMFQDPQVLARGLALNIPHPLAGSVPQVASPIRLSETPVEYRRAPPLLGEHTEVVLGEVLGLDAGEVQRLRDAGVL

SEQ ID NO: 6639 - DNA, 1185 bp, Escherichia coli CFT073
  CDS (1)..(1185): transl_table=11
atgtcttttcaccttcggcttttttcaaggcataagcaaatgacaaataatgaatgcaaagggccgtttgaaggcttattagttatcgatatgacgcatgtccttaatgggcctttcggaactcaacttctttgtaatatgggtgcaagggtaattaaagttgagccgccgggtcatggtgatgatacccgcacatttggtccctatgtggatggacagtcgctctattacagttttattaatcatggaaaagagagtgtggttcttgatttaaagaatgatcacgataaaagtatatttataaatatgcttaaacaagctgatgtattagctgagaattttcgcccaggtacaatggaaaaactcgggttttcatgggaaaggttacaagaaatcaacccgcgccttatatatgcttcatcgtcaggtttcggacataccggtccgctaaaagatgctcctgcctacgataccatcattcaggcaatgagcgggataatgatggaaacaggataccctgatgctccgccagtgcgcgttggtacctctcttgcggatctctgtggcggtgtttatttattcagtggaatagtgagtgcactttatggccgcgaaaagagccagagaggggcgcatgtcgatatagcgatgtttgatgccactctgagttttctggagcatggactgatggcatatatcgcgactgggaagtcaccacaacgcctgggaaatcgccatccctacatggcaccttttgatgttttcgatactcaggataagccgattacgatttgttgtggtaatgacaagcttttttctgcgttatgccaggcactggagcttacggaactggttaatgatccccgatttagcagcaatattttacgcgtacataaccaggctattcttaaagaatatattgagcggacgttaaaaacgcaggtagctgaagtttggttagccagaatacatgaagttggtgtgcccgtcgcgccgttattaagtgtggctgaggccattaatttaccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataa

SEQ ID NO: 6640 - protein, 394 aa, Escherichia coli CFT073
MSFHLRLFSRHKQMTNNECKGPFEGLLVIDMTHVLNGPFGTQLLCNMGARVIKVEPPGHGDDTRTFGPYVDGQSLYYSFINHGKESVVLDLKNDHDKSIFINMLKQADVLAENFRPGTMEKLGFSWERLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFDTQDKPITICCGNDKLFSALCQALELTELVNDPRFSSNILRVHNQAILKEYIERTLKTQVAEVWLARIHEVGVPVAPLLSVAEAINLPQTQARNMLIEAGGIMMPGNPIKISGCADPHVMPGAATLDQHGEQIRQEFSS

SEQ ID NO: 6641 - DNA, 1203 bp, Bradyrhizobium japonicum USDA 110
  CDS (1)..(1203): transl_table=11
atgactgaagccgttatgggtgcaatgagcggactgcgcgtcatcgatctcacgcgcgtgctcggcggcccctactgcacccagatcctcgccgaccatggcgccgacgtgatcaaggtcgagccgcccgccggcgacgaggtgcgcgactggggccctcccttccacgacgaggacgcggcctatttcatcggcatcaaccgcaacaagcgctcgatcggcctcgacctcgcctccgagggcggccgcgtcgtgctgctcaagatgctggagacggccgacgtcctgatcgagaatttcaagccgggcacgctggagaaatggggcatcggcaacgaggtgctgcgcgagaaattcccgcgcctcgtgcattgccggatctgcggcttcggcgccgacggcccgcgcggcggcaatcccggctatgacgccatcatccaggccatgaccggcatgatcgcggcgaccggctcgcccgagagcgggccgatgcggatcggcgtgccgctggtcgacatcaccaccggcctctatgcggcgatcggcatcctgatggcgctgtcggagcggcagcgctcgggcaagggccagttcctggagaccacgctgtacgagaccggccttgccatcatgcatccgcacaccgcgaactatttcatgcatggcaagccgccgggcctcaccggcaacgagcatccgaatctcgtgccttacgcgatcttcccgaccaagaccgacaacatcttcatcggcgtcggcaatgacggcaccttccgcaagctcgccaacgagatcggcaagcccgaactcggcaccgatccgcgctttgcccgcaacaaggaccgcatcgccaatcgcgaggcgctgcgcgccgagcttgccgcggtgttcagccagcacgaggccgagccgctctgcaatcgcctgctcgcggcgggcctgcccgcaggcccggtgcagaagatcgaccaggcgttgacgaacccgcacacgatctaccgcggcgatattatcgagaaggactggtacaagggcgtcgcctcgccgatccggctcgatcgcagcaagccgagcctgcgccggctgccgccgaaattcagccagcactcggcggaggtgctgggcgagttcggatattccaaggccgagatcgacgcgatggtcgagaagggcacggtctgcggccccgagcgcaagcgctag

SEQ ID NO: 6642 - protein, 400 aa, Bradyrhizobium japonicum USDA 110
MTEAVMGAMSGLRVIDLTRVLGGPYCTQILADHGADVIKVEPPAGDEVRDWGPPFHDEDAAYFIGINRNKRSIGLDLASEGGRVVLLKMLETADVLIENFKPGTLEKWGIGNEVLREKFPRLVHCRICGFGADGPRGGNPGYDAIIQAMTGMIAATGSPESGPMRIGVPLVDITTGLYAAIGILMALSERQRSGKGQFLETTLYETGLAIMHPHTANYFMHGKPPGLTGNEHPNLVPYAIFPTKTDNIFIGVGNDGTFRKLANEIGKPELGTDPRFARNKDRIANREALRAELAAVFSQHEAEPLCNRLLAAGLPAGPVQKIDQALTNPHTIYRGDIIEKDWYKGVASPIRLDRSKPSLRRLPPKFSQHSAEVLGEFGYSKAEIDAMVEKGTVCGPERKR

SEQ ID NO: 6643 - DNA, 1173 bp, Bradyrhizobium japonicum USDA 110
  CDS (1)..(1173): transl_table=11
atgcagctagcagataagcatgagagcacgacgacaaaggccttcgccggactcagggtgctggatttttcgaccaccatcgccggtccccattgcacgcggatgctcgccgatatgggcgccgaggtcatcaagatcgagaccgacggcggcgagacaatgcggacccggccgccgctgcgcaaggggtgcagcaccgtattcggccagctcaatgtcggcaagaagagcgtcgtgctcgacctcaagtccgaggacggcagggaggcgatcctccggctggccgcgaccgccgacatcctggtcgagaacttccggcccggcgtgatgcaccggctgcggctcgactacgacagaatgcgcccggtcaatccaaggctgatttattgctcgatctcgggctacggccagagcggcccctcggccgagctgccggcctatgcgccggtgatccacgcggcctccggctatgacatggcgcatctcgcctaccagcccggccgtaaccgccccgactattgcggcatctaccatgccgacgtcgtcaccggcacctacggttttggggcgattgcgtcggcgctctatcagcgcacggtgaccgggcttggccagcacatcgacgtctccatgctggagtcgatgctgacgctgactctgatcgagttgcagagctcgcagttcgcggtgaagccgccaccgcgcccgatgttcgggccgaccgagacggccaatggctatgtcatgatcacggtcgcgagcgaaaagacgtttcagtgtttgatgggcgtgatcggacgccccgactggatttccgatccgcgcttctccgcctacgctgcgcgccgcgagaactgggccgacttgatggacggcgtcgaggcctggtcgcggcagctctcgaccgaggcatgcctcgtcgcactcggtgcggccggcgtgccggcctcggcctatcgcaccgtctccgaggcgctggccgatccgcagctcgcgcaccggcaggcgctctcgtcggtggaggatgggggcggctcgttccaggttctcaacctgccgttccggatgtccggcgccgatacgacgccggccagggcgatggccgcgctcggcgagcacacgggtgcgttgcgcgacgagattggcctcgccgatgacgcgtcaattccgtga

SEQ ID NO: 6644 - protein, 390 aa, Bradyrhizobium japonicum USDA 110
MQLADKHESTTTKAFAGLRVLDFSTTIAGPHCTRMLADMGAEVIKIETDGGETMRTRPPLRKGCSTVFGQLNVGKKSVVLDLKSEDGREAILRLAATADILVENFRPGVMHRLRLDYDRMRPVNPRLIYCSISGYGQSGPSAELPAYAPVIHAASGYDMAHLAYQPGRNRPDYCGIYHADVVTGTYGFGAIASALYQRTVTGLGQHIDVSMLESMLTLTLIELQSSQFAVKPPPRPMFGPTETANGYVMITVASEKTFQCLMGVIGRPDWISDPRFSAYAARRENWADLMDGVEAWSRQLSTEACLVALGAAGVPASAYRTVSEALADPQLAHRQALSSVEDGGGSFQVLNLPFRMSGADTTPARAMAALGEHTGALRDEIGLADDASIP

SEQ ID NO: 6645 - DNA, 1260 bp, Bradyrhizobium japonicum USDA 110
  CDS (1)..(1260): transl_table=11
atgcaaagcgatcgatcgcaatccacctctcgccgttcgggaccgcttgccggcctcaaggtcatcgatctcacccatgtcatggcggggccgacctgcaccttgatgctcgccgacatgggcgcggacgtcatcaagatcgagaaatggccgaacggcgacgacacccgccattcggtgccgcccaagatcggcgatgaggcggcctccttcctgatgatgaaccgcaacaagcgcggcatcgtgctggacctcaagaccgatggcggcaagaaggtgctgcggcggctgatcgcggacgccgacgtgctggtcgagaattttgctccgggcgccatggagcgcctcggcttcggctatgaagacctgcacaagcagtatccatcgctgatctactgctcgctgtccggcttcggccgcaccggcccctacaagcaccgccgcggttttgacctcgtcgcgcaggcgatgagcggcatcatgagctttaccggcgaacgcccggatggtccgcccgtcaaatgcggcccgccgctgtccgacatcaccgccggcctgctcgcgagcatgggtatccttgccgcctatacgcatcgcctcaagactggcgaagggcagtgggtcgagacctcgctttacgaggcggccctggtgcagacctactggcagtccacgatcgcgctggccgcgggcaccgcgccgcgcgcgatgggctcggcgcatccgctcaacgcgccgtaccaggccttcgaggcctcggacggctggctggtggtcggcggcgccaacaagaagcattggctgttgatgctggaggcgctcggtgccagcgagcttgcctccgatccgcgcttcgtcaccggggcggaccgcatggcgcatctgaaggagcttgaggccgtcctgagcgagcgcttccgcacccggtcgcggatgcattggcttgcggcactcgacgagaagggcgtgccgtgcggccccgtgcacgacatgctggaggcgctccgcgatccgcagacgctggcgcgcgagatggtcgtcgaggtcgagcattccacgctcggtccggtgaagacgatcgggcttcccgtcaagttttcggagaccccaggcaaagtgctctcgggcgcgccggtctacggtgagcatacccgcgaggtgctggccgaacatgggttcgaccagaagcagatcgaagcgctcgagcaagaaggcgcaatcgtttcagccgcagacagacgcgaggaacgcgtcgcctga

SEQ ID NO: 6646 - protein, 419 aa, Bradyrhizobium japonicum USDA 110
MQSDRSQSTSRRSGPLAGLKVIDLTHVMAGPTCTLMLADMGADVIKIEKWPNGDDTRHSVPPKIGDEAASFLMMNRNKRGIVLDLKTDGGKKVLRRLIADADVLVENFAPGAMERLGFGYEDLHKQYPSLIYCSLSGFGRTGPYKHRRGFDLVAQAMSGIMSFTGERPDGPPVKCGPPLSDITAGLLASMGILAAYTHRLKTGEGQWVETSLYEAALVQTYWQSTIALAAGTAPRAMGSAHPLNAPYQAFEASDGWLVVGGANKKHWLLMLEALGASELASDPRFVTGADRMAHLKELEAVLSERFRTRSRMHWLAALDEKGVPCGPVHDMLEALRDPQTLAREMVVEVEHSTLGPVKTIGLPVKFSETPGKVLSGAPVYGEHTREVLAEHGFDQKQIEALEQEGAIVSAADRREERVA

SEQ ID NO: 6647 - DNA, 1212 bp, Bradyrhizobium japonicum USDA 110
  CDS (1)..(1212): transl_table=11
atgacggcggacaatgcgatgccgcgactgggagttttacggaaaatggcgaagatcgacagccctctcgaaggcatcacggtcgtcgaacttgggcacagcgtggcggctccctatgcagggctgatattggccgatctgggcgcccgcgtcatcaaggtcgaaaatccccgcagcggcgactacgcgagaggttgggggccgccattctggcgtgatacggcgagcctctttcacgctctcaaccggggaaaggaaggcgtgaccgtcgatttcggcgatgcgcaggactgcgcgaggctgaaatcgctcatcgtggagcaggcggatgcggtcatccaaaatctgcggccgggcatcctcgacaaattcggtttgaccgccgaaacgctgcgcgcggagaagcccgaattgatctggtgcgatatcggagctttcggagccaaaggccctcttgccaacaagccgggctatgatccgctggcgcaggccaccacgggaatcatgagcgtgacgggagagggcgaccgtccgccggtgcgggtgggcgtttcgctcgttgacatgggatccggcatgtgggccattatcgggctgctcgcggggttgatcgcacgcatgaacggccgtgaagggcgaacagtctcgacctcgctctacgagacaggtcttgcctggatgaccgggccgctcgcaggctttgccgcgtccggagaggtgcgcaaaccccatggctcgggcgccgccgaaatcgtgccctatcaggctttccaggccagtgacggttggctcatgattgccgcaggcaacgacaacctctttcgcaagctgtgcggcgcgctcggccttgaagctctgagtgtcgatccggccttcgtgacgaacgccgcgcgtgtcgcgaaccgcgaccggttgatcccgcagattgaagtggcggcgcttcggtactctgccgaggcccttggcaagcttctggatgaagccggcgtgcccaacgcgccgcttctcagcgtcgatcaggtcgcgatgcatccccagaccagcgcgctcgagatgaccgtgcggtgtgtcggcgacgagatcgacctcgtcggtataccgctcgccttcgatggcgcgcgcccgcgagcccgcacgcaagctccgagactgggtgagcacaacgcaatcctccggacacaagcgagcaaggaggcggtcaatgcgaagtga

SEQ ID NO: 6648 - protein, 403 aa, Bradyrhizobium japonicum USDA 110
MTADNAMPRLGVLRKMAKIDSPLEGITVVELGHSVAAPYAGLILADLGARVIKVENPRSGDYARGWGPPFWRDTASLFHALNRGKEGVTVDFGDAQDCARLKSLIVEQADAVIQNLRPGILDKFGLTAETLRAEKPELIWCDIGAFGAKGPLANKPGYDPLAQATTGIMSVTGEGDRPPVRVGVSLVDMGSGMWAIIGLLAGLIARMNGREGRTVSTSLYETGLAWMTGPLAGFAASGEVRKPHGSGAAEIVPYQAFQASDGWLMIAAGNDNLFRKLCGALGLEALSVDPAFVTNAARVANRDRLIPQIEVAALRYSAEALGKLLDEAGVPNAPLLSVDQVAMHPQTSALEMTVRCVGDEIDLVGIPLAFDGARPRARTQAPRLGEHNAILRTQASKEAVNAK

SEQ ID NO: 6649 - DNA, 1221 bp, Bradyrhizobium japonicum USDA 110
  CDS (1)..(1221): transl_table=11
atgaacacacagcgcctgccgttgaagggcattcgtgtcatcgattatagccactttctggctggccccttcatgggccgctgcctcgcagcgttgggggcggaggtgatcaaggtggagcgcccgaaggagggcgatgccgggcgcgcgcatccgtatttcaaagacggacagtccggctacttcctgcagcagaacgtgggcaaacagggactttgcatcgacctgcgtgacaaacgcggcctcgagctgatgctgaagctggtcgaaaccgcggacgtgttcatcgagaactatcgccctggcgcacttgagcgcctcggccttggctacaaggcactgtctgagcgcaatccgaggctggtctattgctcggtttccgcctatggccacaccggcccgtacgctgaccgtccgggcttcgggctaattgcagaggcgatgtccggcgctatggcgcaactcggcaatcccggtgaagcgccgccgctgctgcgtatgccgttggccgatatgtataccggcattcatggcgtggctgcgatcaatgcggcgctcgtcggtcgtacttcgtccggccatggccaacacatcgatctggcactctacgactgcatggtgtcgatgcacgacttcgccgtgcagcgctacttcctctcaggcggcaccgatgttccgaagcagaccggcagcggccagccggattcgaccgtctacggggtctttccggccagggacggcaatctcgtgatcgccgcgcaggtcgatgatgcgtggaaaagattggcgacgctgatcggcgggaatgcattggcgtccgacgagcgcttcgccaagccggcctcccgcaacgcgcactatgctgacgcgatggagatcgtgcgcaactggacgctgtcacagccttcgcgtgacgcgtgtcttgccgctcttgaagacgcaggtgtgccgtccgccccggtgcagaccatcgcggaagtcgtgaaggatccacagatccacgcccgcggtatgttggtcgagcaggagcatcccgtgctcggcaaggtgacattgcctaacctgccttttcatttctccgattgcgacacgacggtgcgcacgccggcgccgttgctcggtcaggacaatcgccgcatcgcagcctcgctgggattctctaccgaacaggtcgacgaaatggtgcgcgacggcgtcctctacaacgaagccgcggtgtag

SEQ ID NO: 6650 - protein, 406 aa, Bradyrhizobium japonicum USDA 110
MNTQRLPLKGIRVIDYSHFLAGPFMGRCLAALGAEVIKVERPKEGDAGRAHPYFKDGQSGYFLQQNVGKQGLCIDLRDKRGLELMLKLVETADVFIENYRPGALERLGLGYKALSERNPRLVYCSVSAYGHTGPYADRPGFGLIAEAMSGAMAQLGNPGEAPPLLRMPLADMYTGIHGVAAINAALVGRTSSGHGQHIDLALYDCMVSMHDFAVQRYFLSGGTDVPKQTGSGQPDSTVYGVFPARDGNLVIAAQVDDAWKRLATLIGGNALASDERFAKPASRNAHYADAMEIVRNWTLSQPSRDACLAALEDAGVPSAPVQTIAEVVKDPQIHARGMLVEQEHPVLGKVTLPNLPFHFSDCDTTVRTPAPLLGQDNRRIAASLGFSTEQVDEMVRDGVLYNEAAV

SEQ ID NO: 6651 - DNA, 1254 bp, Clostridium tetani E88
  CDS (1)..(1254): transl_table=11
atgctcatagtatttactgtaattaatatttataaaacaataaattatttgaggaggattattatgagaaaagcgttatcaggattaaaggtattagatttaactcatgcttataatggcccattttgcacaactcttttagcagataatggagcagatgtaataaaaatagaaagtccaaagggtgatcaatgtagaacctggggacctttagatcctaaaagtggagaaagtggattttatgcatttttaaatagaaataaaaaaggtattactttaaatttaaaaacagaaagaggaaaagaaatcttttataaaatggcaaaagaagcagatgttgtagtagaaaactttagagtaggagttatggagaaattaggaatagattatgaaactttaaagaaaataaatcctaaaataatttatgcatcaggatcaggctttggacaatatggccctttatccaatagaccttgttatgatatagtggctcaatccatgggaggaatggttaatttaacaggattcccagaaggacctcctacaaaagttggaccatcagtagctgataatgttactggaatatatctttgcgtgggagttttaatggcactttacaatagagagaaaacaggagtaggtcaaactgtagatgtagcaatgctagacacaatatttactcttttagaaaattcaataattgtaaatacaatgacaggagttgttccagaaaggcaaggtaacatagacccttctatagctcctttcgatatatatgaagttcaagatggatatatagcagtaggagttggaaatgataagctttgggaaaaattctgtaacctaatggagaaacctgaattaattaatgacgaaagatttaaaactaatgatttaagatgtcaaaactatcttccagatttaaaaaatattatagttgactggattaaaattaaaaataaaaaagaattagaagaaatgtttgataaggcaggaattccttgtggaccagtacttaatatgcaagaagctatagatcatccacatataaaggcaagagaaatgatggttactatagagcatccaactataggggaaatgtacttccaaggtgttcctataaaattatcccaaacaccaggcagtgtagaaacaccagcaccattacttggacaacacaatgcagaggttcttaaagaatttggagtagatgaaaaagaacttaaaatattagaagagcaagggataatttaa

SEQ ID NO: 6652 - protein, 417 aa, Clostridium tetani E88
MLIVFTVINIYKTINYLRRIIMRKALSGLKVLDLTHAYNGPFCTTLLADNGADVIKIESPKGDQCRTWGPLDPKSGESGFYAFLNRNKKGITLNLKTERGKEIFYKMAKEADVVVENFRVGVMEKLGIDYETLKKINPKIIYASGSGFGQYGPLSNRPCYDIVAQSMGGMVNLTGFPEGPPTKVGPSVADNVTGIYLCVGVLMALYNREKTGVGQTVDVAMLDTIFTLLENSIIVNTMTGVVPERQGNIDPSIAPFDIYEVQDGYIAVGVGNDKLWEKFCNLMEKPELINDERFKTNDLRCQNYLPDLKNIIVDWIKIKNKKELEEMFDKAGIPCGPVLNMQEAIDHPHIKAREMMVTIEHPTIGEMYFQGVPIKLSQTPGSVETPAPLLGQHNAEVLKEFGVDEKELKILEEQGII

SEQ ID NO: 6653 - DNA, 1221 bp, Pseudomonas syringae pv. tomato str. DC3000
  CDS (1)..(1221): transl_table=11
atgggtgcgctttcacatataagagtgctcgatctttcgcgtgttctggccggaccctgggccgggcagatccttgctgatctgggcgctgacgtcatcaaggtcgagcgtccgggctgtggcgatgacactcgcgcctgggggcctccgtttcttaaggatgcggccgggcataacaccagtgaggcggcttattacctgtcggccaatcgtaacaagcagtcggtcaccatcgacttcacgcgacctgaagggcagaagctggtcagggagctggcggcgaagtccgatatcgtcatagaaaacttcaaggttggtgggttggcggcgcatggcctggattacgcgtcgctcaaggcaatcaacccccgactgatctattgctccattaccggtttcggtcaaagcggtccatatgcgactcgtccgggttacgacttcatgattcaggcgcttggcggtctgatgagccttaccggtttgccggggggcgaggaaggtgcaggtccggtgaaggtcggcgtcgcgctgaccgacattctgaccggcctgtattcaacgaccgcaatccttgcagctctggctcatcgcgatcaaagcgatgtagggcagcatattgatatggcgttgctggacgtacaggtggcctgcctggccaatcaggccatgaactacctgactaccggggtcgcaccagagcgtctgggcaatgcccatcccaatatcgtgccctatcagagttttccgactgccgatggcgaccttatccttacggtgggtaacgacagtcagttcaggaagtttgccgaagtggcggggcagtcgcagtgggcagatgatccgcgttttctgaccaacacgctgcgagttgctcatcgtgctgaactgatcccgctgattcggcaggtgacggttttcaaggcgaccgctcagtgggtggccgtactggaggctgtgggtgtgccgtgcgccccggtcaatgatctggccaaggtgtttgccgatccgcaagttgtggcacgcgggttggcgattgagctgccccatgcactgggtggcaaggtcccgcaggttgccagcccgattcgtttgtccgagacgccggttgaataccgcagggcgccgcctatgctgggcgaacatacagctgtggtactggaggagcttctcggtttgggcggtgatgaggttgcatcgctgcgagcggcaggtgtgctgtag

SEQ ID NO: 6654 - protein, 406 aa, Pseudomonas syringae pv. tomato str. DC3000
MGALSHIRVLDLSRVLAGPWAGQILADLGADVIKVERPGCGDDTRAWGPPFLKDAAGHNTSEAAYYLSANRNKQSVTIDFTRPEGQKLVRELAAKSDIVIENFKVGGLAAHGLDYASLKAINPRLIYCSITGFGQSGPYATRPGYDFMIQALGGLMSLTGLPGGEEGAGPVKVGVALTDILTGLYSTTAILAALAHRDQSDVGQHIDMALLDVQVACLANQAMNYLTTGVAPERLGNAHPNIVPYQSFPTADGDLILTVGNDSQFRKFAEVAGQSQWADDPRFLTNTLRVAHRAELIPLIRQVTVFKATAQWVAVLEAVGVPCAPVNDLAKVFADPQVVARGLAIELPHALGGKVPQVASPIRLSETPVEYRRAPPMLGEHTAVVLEELLGLGGDEVASLRAAGVL

SEQ ID NO: 6655 - DNA, 1224 bp, Bordetella pertussis Tohama I
  CDS (1)..(1224): transl_table=11
atgaaacaagcacttgagcacatcaaggtcgtggacctcacccgcgtcctggccggcccctgggccacgcagatcctggccgacatgggcgcccgggtcatcaagatcgagcgccccggcgcgggcgacgacctgcgcggctgggggccgccgttcctgaagaacgcgcacggcgaggaaaccaccgatgccgcctacttcctcagcaccaaccggggcaaggagtcggtgacgctggacatctccagcgccgaaggccaggagatcgtccgccagctcgccaaggacgcggacgtgctggtcgagaactacaaggtcggcacgctggcgcgcttcggcctggactatgagtcgctgcgcaagatcaatccgcggctcgtgtattgctcggtgaccgggttcggccagaccggcccgcacgcccacctgcccggctacgactacatattccagggcatgggcggactgatgagcatcaccggcctgccggacgccgagcccggcggcggtccgctcaagaccggcatcccgatcaccgatgtggtcacgggcatctacgcctcgacggcgatcctgggcgcgctggagcaccgcaacctcagcggcgaaggacaggccatcgacatctcgctgctcgattgcctggtcaacgtcaccggctgcgccgtcatgaactacttcctgtcgggcaggattccgcagcggctgggcaacacgcactccaacatggttccgtaccaggtgttccgttgcaaggaaggcgacgtgatcgtggcggtcggcaacgacacccagttcgtgacgttcgccggattgatcggcatgccgcagctggccaccgacagccgcttctcgaccatggcgcaacgcagccgcaaccgcgaaacgctgattcccatcatcgcccaggccatgcaggcgcgcaccatgcaggaatgggtgtccctgctcgaggccgccaacgtgccgtgcgggcccatcaacaatctgcagcaggtgttcgaggacccgcaggtgcagcatcgcggactcaagctgtcgctgccgcatggctcgggcgtggacgcgccgggcgtcgccagcccgatccgctactcggccacgcccatcgcctatggcagggccgcgccctgcctgggagagcatacggacgacgtactgcaatcggagctcggcatggcgccggcggcgatcggcgcgctgcgcgcgcgcggcatcgtctga

SEQ ID NO: 6656 - protein, 407 aa, Bordetella pertussis Tohama I
MKQALEHIKVVDLTRVLAGPWATQILADMGARVIKIERPGAGDDLRGWGPPFLKNAHGEETTDAAYFLSTNRGKESVTLDISSAEGQEIVRQLAKDADVLVENYKVGTLARFGLDYESLRKINPRLVYCSVTGFGQTGPHAHLPGYDYIFQGMGGLMSITGLPDAEPGGGPLKTGIPITDVVTGIYASTAILGALEHRNLSGEGQAIDISLLDCLVNVTGCAVMNYFLSGRIPQRLGNTHSNMVPYQVFRCKEGDVIVAVGNDTQFVTFAGLIGMPQLATDSRFSTMAQRSRNRETLIPIIAQAMQARTMQEWVSLLEAANVPCGPINNLQQVFEDPQVQHRGLKLSLPHGSGVDAPGVASPIRYSATPIAYGRAAPCLGEHTDDVLQSELGMAPAAIGALRARGIV

SEQ ID NO: 6657 - DNA, 1212 bp, Bordetella pertussis Tohama I
  CDS (1)..(1212): transl_table=11
atggctgcagtctcttcttccgtgccgcccactccgctgggcggcgtgcgcgtgctggacctgtccaaggtcctggccgggccgctgtgcacgcaatacatggccgacatgggcgccgacgtgatcaaggtcgaagcggccgggcagggcgacgatacgcgcggctggccgccgttccaggatggccaggcggcggtgttcctcagctgcaaccgcaacaagcgcagcatcgcgctggacctgaaatcggcgcacgggcgcgccgtggtgcagcggctggccgcctgggccgacgtggtggtccacagcttcggtccgggcgtggcgcaaaagctgggcgtcgattgggaggccctgtccgaaatcaatccccgcctcgtgtactgcgccatctccggcttcggcccggtcggcagcctgagccacggcaaggggttcgatgtggtgctgcaggcgttctgcggcatgatctcgatcaccggcgagaccgagggcggcgcggtgcgcagcccgttctcgccggtggaccaggccaccggcctgcatgccctgatcggcatcctggcggccttgcgccagcgcgacgccagcggccgcggcgtcaccgtggacgcctcgctgttcgataccgcgctcggtttcatgggctacttcatgcagggttactgggcccgcggcaccgagccggcgcgcgcgggcgccgggcacgagtcgctgtgcccgtaccaggatttcgcgaccgccgacaagcccatcatcctgggcatcgccaacgatgcgctgtggcgcgccttctgcgccctggccgagcgtcccgaactggccagcgacccgcgctttgccaccaacgcgcagcgcgtggccaaccgcgcgcagaccctggcggccacgcgcgcactgctggcggcgcgcacgcgcggcgaatggctgcccgcgctcgagcaggccggcattccctgttcgcccatccatacgctggtcgaggtcgatgcgcatccgcacacgcgcgaatcgggcatggtgttcgactaccccgagaccggtaccgatgccgggccgctcaagggcgtggcccagccggtgcgctttgacggcatgcgcctgaccacgcccaagcggccgccgagcctcaatcaggactgggcgtcggtgcttgccgacgccggctactccgatccggaagtccgggatctattgcaacagatggcctga

SEQ ID NO: 6658 - protein, 403 aa, Bordetella pertussis Tohama I
MAAVSSSVPPTPLGGVRVLDLSKVLAGPLCTQYMADMGADVIKVEAAGQGDDTRGWPPFQDGQAAVFLSCNRNKRSIALDLKSAHGRAVVQRLAAWADVVVHSFGPGVAQKLGVDWEALSEINPRLVYCAISGFGPVGSLSHGKGFDVVLQAFCGMISITGETEGGAVRSPFSPVDQATGLHALIGILAALRQRDASGRGVTVDASLFDTALGFMGYFMQGYWARGTEPARAGAGHESLCPYQDFATADKPIILGIANDALWRAFCALAERPELASDPRFATNAQRVANRAQTLAATRALLAARTRGEWLPALEQAGIPCSPIHTLVEVDAHPHTRESGMVFDYPETGTDAGPLKGVAQPVRFDGMRLTTPKRPPSLNQDWASVLADAGYSDPEVRDLLQQMA

SEQ ID NO: 6659 - DNA, 1188 bp, Bordetella pertussis Tohama I
  CDS (1)..(1188): transl_table=11
atgcttgcacaatctgcaccggccaagcctctggctggcctcaaagtcctcgacatcacccatatgctcgccggcccctactgcacatggctgctcgggctgctcggcgccgaggtcatcaaggtcgagcggccgggcgaaggagacttcgcccgcgccatcgctccctttcacggcggtgaaagcctgtatttcatgagcgtcaaccgcaacaagcgcagcatcgcagtcaatctgaaaaccgaggaaggcaagcagatcctgcgcgacctgatcgctcgcagcgacatcctggtcgagaacaaccgggccggcgtcatggaccggctgggcctggggtatgacgatgccaaggcactgaacccgggcctggtctacgcctcgatctccggctatggccagaccggcccttatcgccacaaacccgccttcgacgtgattgcccaggccatatccggcatgatgagcatcaccggccaggaaggcggcccgccggcccgcgtgggcgtctcgatcggcgacatcgcttccggcctgttcgccacggtggcgatcctggcggcgatcgaaggccggcacggcagcggcgaaggcgccttcatcgacgtctcgatgatggattgccagatggcgctgatggaaaacgcgatttcgcgctacctgaacgcgggcgacgttcccgagcgcctgggcagccggcaccccctgattgcgccgttccagtctttcgagacccaggactttccgatcgcggtatgcgtcgataccgaaccgcaatggcagcgcttctgcgcggcgctggacctggagcccctgctgcacgacccgcggttccaggacggcccgatgcgcgcgctcaatcacagccagctcgagccgctgctcaatgccttgttcgccagcggccgccgcgatgacttcatcgcgcgcctggaggcggccgatgtgccatgcagcccgatcaacagcattcccgaagtggcccgggacccgcaggtggcgcaccgccagatcctggtcgataacgagggcgtcaagtatgtgggcgcgccctttcactacaaccgcgcgccggtgggcggcgaaaccagcccgcccgccctgggcgccgacagcgtgtcgatcctgcgcgaactgggccgcagcgaagcgcagatcgccgacctgcagcgcaccggcgtactgtaa

SEQ ID NO: 6660 - protein, 395 aa, Bordetella pertussis Tohama I
MLAQSAPAKPLAGLKVLDITHMLAGPYCTWLLGLLGAEVIKVERPGEGDFARAIAPFHGGESLYFMSVNRNKRSIAVNLKTEEGKQILRDLIARSDILVENNRAGVMDRLGLGYDDAKALNPGLVYASISGYGQTGPYRHKPAFDVIAQAISGMMSITGQEGGPPARVGVSIGDIASGLFATVAILAAIEGRHGSGEGAFIDVSMMDCQMALMENAISRYLNAGDVPERLGSRHPLIAPFQSFETQDFPIAVCVDTEPQWQRFCAALDLEPLLHDPRFQDGPMRALNHSQLEPLLNALFASGRRDDFIARLEAADVPCSPINSIPEVARDPQVAHRQILVDNEGVKYVGAPFHYNRAPVGGETSPPALGADSVSILRELGRSEAQIADLQRTGVL

SEQ ID NO: 6661 - DNA, 1227 bp, Bordetella parapertussis 12822
  CDS (1)..(1227): transl_table=11
atgccaaacaaaccactgcagaaatatcgcgtactggacctgaccagggtgctggccggcccctggtgcacccagaacctggccgacctgggcgccgaggtcatcaaggtggagcgccccggcgtcggcgacgaaacgcgcggctggggacctccctggatcccggccggagcggccagcaagcgccgcgactccgcctacttcggctcggccaaccgcggcaagaaatcgatcaccatcgacttcaccaccgcgcaggggcaagccctggtccggcagctggcggccgactgcgacgtcctggtggagaactacaagaccggcaccctggcgcgctatggcctggggtacgaggacctgaaggccgtcaaccccggcctggtgtattgctcggtcacgggcttcggccacaccgacccataccgccacaagcccgggtacgacttcgtgttccaggccatgagcggactgatgagcatcaccggcgaacgcgatgatctgcccggcggcgggccgcagaaggtgggcatcgccgtcgcggacatcaccaccggcatgtattcgaccgtggccgtgctcgccgcgctgctcgagcgcgaaagccacggccggggccagcacctggacatggcgctgctggactgcgccatggcgttcaacagcaaccaggcggtcaattacatggcctcgggcagcatgccccgccgttacgggaacgcccattcgaacgccgtgccgtaccaggtattcgacacccgcgacggccagatcgtggtggccgtcggcaacgatgccttgttcgcggcgtactgccgcgccgcgcaacgccccgacctgtgcgccgatgcgcgcttcgtaaccgtgtccgggcgcctgcagaaccgcgacgagctgctctcgcagctggccgtcgtcatggcaggcaagaccagcgcgcaatggctcgccgtgctggacgccgcgggcgttccctgcgccccgatcaacgacttcgagcaggcgctggcggacccgcaggtcaaggcgcgcaacatcgagacccacatcgcgctggaagacggcgcggtctttcgcaccatcgccagccccttgcggttctccgagaccccgctcgaccacctggccggcccgcccatgctgggccagcacacggccgatgtgctgcgcgagcgcctgggcctggatgaagcgcaacaggccggcctgcgccaggccggcgtgatctga

SEQ ID NO: 6662 - protein, 408 aa, Bordetella parapertussis 12822
MPNKPLQKYRVLDLTRVLAGPWCTQNLADLGAEVIKVERPGVGDETRGWGPPWIPAGAASKRRDSAYFGSANRGKKSITIDFTTAQGQALVRQLAADCDVLVENYKTGTLARYGLGYEDLKAVNPGLVYCSVTGFGHTDPYRHKPGYDFVFQAMSGLMSITGERDDLPGGGPQKVGIAVADITTGMYSTVAVLAALLERESHGRGQHLDMALLDCAMAFNSNQAVNYMASGSMPRRYGNAHSNAVPYQVFDTRDGQIVVAVGNDALFAAYCRAAQRPDLCADARFVTVSGRLQNRDELLSQLAVVMAGKTSAQWLAVLDAAGVPCAPINDFEQALADPQVKARNIETHIALEDGAVFRTIASPLRFSETPLDHLAGPPMLGQHTADVLRERLGLDEAQQAGLRQAGVI

SEQ ID NO: 6663 - DNA, 1308 bp, Bordetella parapertussis 12822
  CDS (1)..(1308): transl_table=11
ttgcacaagcagtgcatcaaatgcacggatgcgcgacaaactaagcgattgtgctggagcgaagcaggctgcaacatcgttgcatctcagccctcatggcgccctgtcgcccatctctccatgcttgcacaatctgcaccggccaagcctctggctggcctcaaagtcctcgacatcacccatatgctcgccggcccctactgcacgtggctgctgtggctgctcggcgccgaggtcatcaaggtcgagcggccgggcgaaggtgacttcgcccgcgccatcgcgccctttcacggcggtgaaagcctgtatttcatgagcgtcaaccgcaacaagcgcagcatcgcggtcaatctgaaaaccgaggaaggcaagcagatcctgcgcgacctgatcgctcgcagcgacatcctggtcgagaacaaccgggccggcgtcatggaccggctgggcctggggtatgacgatgccaaggcactgaacccgggcctggtctacgcctcgatctccggctatggccaaaccggcccttatcgccacaaacccgccttcgacgtgattgcccaggccatatccggcatgatgagcatcaccggccaggaaggcggcccgccggcccgcgtgggcgtctcgatcggcgacatcgcttccggcctgttcgccacggtggcgatcctggcggcgatcgaaggcaggcacggcagcggcgaaggcgccttcatcgacgtctcgatgatggattgccagatggcgctgatggaaaacgcgatttcgcgctacctgaacgcgggcgacgttcccgagcgcctgggcagccggcaccctctgattgccccgttccagtctttcgagaccaaggacttcccgatcgcggtatgcgtcgataccgaaccgcaatggcagcgcttctgcgcggcgctggacctggagcccctgctgcacgacccgcggttccaggacggcccgatgcgcgcgctcaatcacagccagctcgagccgctgctcaatgccgtgttcgccagcggccgccgcgatgacttcatcgcgcgcctggaggcggccgatgtgccatgcagcccgatcaacagcattcccgaagtggcccgggacccgcaggtggcgcaccgccggatcctggtcgataacgagggcgtcaagtatgtgggcgcgccctttcactacaaccgcgcgccggtgggcggcgagaccagcccgcccgccctgggcgccgacagcgtgtcgatcctgcgcgaactgggccgcagcgaagcgcagatcgccgatctgcagcgcaccggcgtactgtaa

SEQ ID NO: 6664 - protein, 435 aa, Bordetella parapertussis 12822
MHKQCIKCTDARQTKRLCWSEAGCNIVASQPSWRPVAHLSMLAQSAPAKPLAGLKVLDITHMLAGPYCTWLLWLLGAEVIKVERPGEGDFARAIAPFHGGESLYFMSVNRNKRSIAVNLKTEEGKQILRDLIARSDILVENNRAGVMDRLGLGYDDAKALNPGLVYASISGYGQTGPYRHKPAFDVIAQAISGMMSITGQEGGPPARVGVSIGDIASGLFATVAILAAIEGRHGSGEGAFIDVSMMDCQMALMENAISRYLNAGDVPERLGSRHPLIAPFQSFETKDFPIAVCVDTEPQWQRFCAALDLEPLLHDPRFQDGPMRALNHSQLEPLLNAVFASGRRDDFIARLEAADVPCSPINSIPEVARDPQVAHRRILVDNEGVKYVGAPFHYNRAPVGGETSPPALGADSVSILRELGRSEAQIADLQRTGVL

SEQ ID NO: 6665 - DNA, 1200 bp, Bordetella parapertussis 12822
  CDS (1)..(1200): transl_table=11
atgccgatggacggcatccgggtgctggatttgtcgcgcgtgctggcgggcccgtggtgcacgcagatgctggccgatttcggcgccgatgtgatcaagatcgagcggccagggcagggcgacgacagccgggcctgggggccgccgttctacgagtcggccgacggccatgaacgggtgtcggcgtacttctgcgccgccaaccggggcaagcgctccgtgtgcctggacctggagtccgaggcggaccgccaggcgctgcgcgaactggcgctgcgcagcgacgtcctggtcgagaatttcaaggccggctcgctggcgcggcatgggctggattacgccacgctgtcggcgctgaatccgcgcctggtgtactgctcgatcacgggctatgggcagaccggcccgtatgcggccaggccgggctacgactcgatcatccaggccgtgggcggaatgatgagcgtgacgggcctgcccgatgacgccgctggcggcggtccgcagaaaaccgggattcccatcatcgacctgatgaccggggtctacgcctgctgcggcgtgctgatggccttgcgcgagcgcgaggccagagggcagggccagcacctggatctctcgctgatggacgtgcaggtatcggcgctgtccaccctggccgccaacttcctggcgtgcggccaggcgccgcaacgcaacggcaacgaacatccgaccgtcgtgccgggcgacgccgtccagtgcctggacggcccgctcatgctgatggtgggcaacgaccggcagttccagcgcctttgccgccatctggaccgcgagtcgctggcgcgcgatcctcgctatgcgaccaacgagctgcgcgtccagggcaagaatgcattgatggcgcaactgcgcgaggccttccgcggccagacacgccagtactggctggaacgcctgctggccgaaggcattccctgcgggccgatccagaccgtggcggaggtgctggccgatccgcacgtgcgccaccgggcgctcgtggccgcagcgccggacccggtgttcggcgaaatccgcgcgatgggcagcgcgttgcgcatgtcgcgcacgccggcccgccacgggcgggcgccaaccgtgctgggcgagcacaccgaagcggtgctgtcgtcgctggcctcgtcccgtcttcaatccaacccgcaaaccaaatga

SEQ ID NO: 6666 - protein, 399 aa, Bordetella parapertussis 12822
MPMDGIRVLDLSRVLAGPWCTQMLADFGADVIKIERPGQGDDSRAWGPPFYESADGHERVSAYFCAANRGKRSVCLDLESEADRQALRELALRSDVLVENFKAGSLARHGLDYATLSALNPRLVYCSITGYGQTGPYAARPGYDSIIQAVGGMMSVTGLPDDAAGGGPQKTGIPIIDLMTGVYACCGVLMALREREARGQGQHLDLSLMDVQVSALSTLAANFLACGQAPQRNGNEHPTVVPGDAVQCLDGPLMLMVGNDRQFQRLCRHLDRESLARDPRYATNELRVQGKNALMAQLREAFRGQTRQYWLERLLAEGIPCGPIQTVAEVLADPHVRHRALVAAAPDPVFGEIRAMGSALRMSRTPARHGRAPTVLGEHTEAVLSSLASSRLQSNPQTK

SEQ ID NO: 6667 - DNA, 1140 bp, Bordetella parapertussis 12822
  CDS (1)..(1140): transl_table=11
atggcggcgggcagcgcattggacggcatacgcgtcgtggacctgtcgcgggtgctgagcgggccttattgcacccagatactggccgaccacggcgcggacgtggtcaagatcgaaccgccgggcggcgacgagacgcgcgcctgggggccgccgttcgccggcgaggttgccgcctattaccagggcatcaatcgcaacaagcgcggcgcctggctggatctgtcgtccgaggccgggcgcgccgcgctgctggcgcagctcgacggcgccgatgtgctggtggagaacttcaagtgcggcaccatggagcgctgggggttgggcttcgaggtgttgagcgggcggtttccgcgcctgatccattgccgggtatcgggcttcggcgccgacggccccatggggggcatgcccggctacgacgcggcgatccaggccatgtccggcatcatgagcgtcaacggcgatcccggcggcgagcctacccgcgtgggggtgcccatcgtggacatggtgaccggcatgaacgcggccatcggggtgctgctggcgttgcaggagcgccagcgcagcggccgcgggcagttcgtcgatatcgcgctgttcgattgcgcgctatccatcctgcatccgcatacggccagccattttgccgccggcgtcacgcccggccgcaccggcaatgcccatcccaacatcaccccttacgacattttccccacggcgaccgatccgctgttcctggcggtcggcaatgaccggcaattccggatcctgtgcgaggcgctgggcgcggcggcgctggccgacgatccgcgctacgcctccaacggccagcgttgcgccaaccggcaggcgctgacccggtcattggccgcgctgctgagccggcacgcggcgcagggactggccgagcgcctcatccgcgcaggcgtgccttgctccagcgtcctggacattccccaggcgttgcggcatccgcaggccgtgcatcgggaaatggtcgtgcaacgcgacggctatgccggcgtggcttcgcccgtcaagctgggccgcacgccggcgcgctaccgcatgccgccgccgcgcttcggccagcaccagctcgagctcgacttccccgccgcctcgggccgctga

SEQ ID NO: 6668 - protein, 379 aa, Bordetella parapertussis 12822
MAAGSALDGIRVVDLSRVLSGPYCTQILADHGADVVKIEPPGGDETRAWGPPFAGEVAAYYQGINRNKRGAWLDLSSEAGRAALLAQLDGADVLVENFKCGTMERWGLGFEVLSGRFPRLIHCRVSGFGADGPMGGMPGYDAAIQAMSGIMSVNGDPGGEPTRVGVPIVDMVTGMNAAIGVLLALQERQRSGRGQFVDIALFDCALSILHPHTASHFAAGVTPGRTGNAHPNITPYDIFPTATDPLFLAVGNDRQFRILCEALGAAALADDPRYASNGQRCANRQALTRSLAALLSRHAAQGLAERLIRAGVPCSSVLDIPQALRHPQAVHREMVVQRDGYAGVASPVKLGRTPARYRMPPPRFGQHQLELDFPAASGR

SEQ ID NO: 6669 - DNA, 1125 bp, Bordetella parapertussis 12822
  CDS (1)..(1125): transl_table=11
atggctgttgccgcattgccccccggcgccctgcaaggctgccgcgtcatcgacctgtcgcgcgtgctgggcggcccgtactgcacccagatcctcgccgaccacggcgccgacgtgctgaagatcgaaccgcccggcggcgacgagacgcgcggctgggggccgccgttctccggccagaccgcctcctacttcatcggcgtcaaccgcaacaagcgtggcatggcgctggacctgtcgcagcctgccggccaggagctgctgcgcggcctgctggccgacgccgacgtgctggtggagaatttcaagcccggcacgctggagaagtgggggctgggctacgacacgctgagccaggcctttccgcgcctggtgcattgccgcgtcagcggcttcggcgccgacggcccgctgggcggcctgccgggctacgacgcctgcgcccaggccatgtgcgggctgatgagcgtcaacggcgaggccgacggcccggccacgcgggtgggcctgccggtcgtggacatggtgaccggcctgaacgcggccgtcgccgtgctgctggccctgcaggagcgccagcgcagcggcctgggccagttcctggacatcacgctgtacgactgcgcgctgtcgctgctgcatccgcacgcgccgaactacttctacagcggccgggtgcccacgcgcaccggcaacgcgcatccgaacatcgcgccgtatgaaaccctgcccaccggcgccgggccgatcttcctggcggtgggcaacaaccgccagttcgcggcgctggccgacgcgctgggcgccccgcaactggcgcaggacgcgcgctttgccagcaacgccgagcgcctggcgcatcgcgacgccctgtgcgccgcgctgaccgaactgctgcggccgcacgaagcggcctcgctggccgagcgcctgctgcggctgggcgtgccggccgcggccgtgctggacgtggcgcaggcgctcgaccatccgcacgcccgccaccgcggcatgctgctggaagccggcgactaccggggcatcgcctcgcccatcaagctgtcgcgcacccccgcgcgcctgcgcagcgtgccgccgaccttgcaggaaccggccggggcctga

SEQ ID NO: 6670 - protein, 374 aa, Bordetella parapertussis 12822
MAVAALPPGALQGCRVIDLSRVLGGPYCTQILADHGADVLKIEPPGGDETRGWGPPFSGQTASYFIGVNRNKRGMALDLSQPAGQELLRGLLADADVLVENFKPGTLEKWGLGYDTLSQAFPRLVHCRVSGFGADGPLGGLPGYDACAQAMCGLMSVNGEADGPATRVGLPVVDMVTGLNAAVAVLLALQERQRSGLGQFLDITLYDCALSLLHPHAPNYFYSGRVPTRTGNAHPNIAPYETLPTGAGPIFLAVGNNRQFAALADALGAPQLAQDARFASNAERLAHRDALCAALTELLRPHEAASLAERLLRLGVPAAAVLDVAQALDHPHARHRGMLLEAGDYRGIASPIKLSRTPARLRSVPPTLQEPAGA

SEQ ID NO: 6671 - DNA, 1209 bp, Bordetella parapertussis 12822
  CDS (1)..(1209): transl_table=11
atgtcgccgctgcacggaatacgcgtcctggagctgacgcgggtggtgtccggcccgttctgcaccatgctgctgggcgacctgggcgccgaggtcatcaagatagaagagccggtccatggcgacgacagccgcgccttcgggcctccgttcagcggcggcgaaagcgcctatttcctttcggtaaaccgcaacaagcgcagctgcgccatcgacctcaagcagcccgaaggcaaggagctgctgcgcgcgctggcgcgcgccagcgacgtcgtcatcgacaacttccggcccggcacgatggcgcggctcggcctcggatacgacgcgctgcgggccgccaacccgcgcctggtcagctgctcgatcaccggcttcggcgacagcggccccgatgcgcagcggcccggctatgacctgatcatccagggcgaatcgggcatcatggacatcacgggcgacccggccggcctgccgaccaagatcggcacctccatcgccgacctgatcaccggccagttcgcctcccaggccatcaccgcggcgctgctggaacgcgcgtccagcggacagggccgccacgtcggcatcgccatgctcgactgcatggcgtcgctgctgaccttcaacgccggcatctacttcaccaccggcgccagccccacgcggcgcggcaacgcgcacccgaccatcgcgccgtacgagacgttccaggccgccgacggctggctgaacatcggcgtggccaacgacaagttctggcaattgttctgcggcgtgatcgcgcgccccgacctggccgacgacccgcgctacgcgcgcgccgccgaccgcgtcgcgctgcgcgccgaactggtgccgcgcatcgccgccctgatcgccgcgaaaccgcgcgcatactggatcgccgcgctgcgcgaagccggcgtgccgtgcggcgacatacgctcggtggccgaggtctgcgaggccgagcaactggtgtcgcgcggcatggtgttcgacatgccgcacccgagcgccggacaggtgcgcaacatcgccagcccgttccgcttcgacggggccgggacggcggcgcatcgcgcgcccccgctgctgggcgagcacacggcggcgatcctgtgcgaacatgccggcttgcagcccgaacgcgtggcggacctggccgcgcgcggcatcatacgcacccacgccaccagcaactga

SEQ ID NO: 6672 - protein, 402 aa, Bordetella parapertussis 12822
MSPLHGIRVLELTRVVSGPFCTMLLGDLGAEVIKIEEPVHGDDSRAFGPPFSGGESAYFLSVNRNKRSCAIDLKQPEGKELLRALARASDVVIDNFRPGTMARLGLGYDALRAANPRLVSCSITGFGDSGPDAQRPGYDLIIQGESGIMDITGDPAGLPTKIGTSIADLITGQFASQAITAALLERASSGQGRHVGIAMLDCMASLLTFNAGIYFTTGASPTRRGNAHPTIAPYETFQAADGWLNIGVANDKFWQLFCGVIARPDLADDPRYARAADRVALRAELVPRIAALIAAKPRAYWIAALREAGVPCGDIRSVAEVCEAEQLVSRGMVFDMPHPSAGQVRNIASPFRFDGAGTAAHRAPPLLGEHTAAILCEHAGLQPERVADLAARGIIRTHATSN

SEQ ID NO: 6673 - DNA, 1242 bp, Bordetella bronchiseptica RB50
  CDS (1)..(1242): transl_table=11
atgggtgcattgccaagcatcggagacagacgggtgacatcaaccattcctggcagccccgcgttggatgggctggtcgtactggacatatcgcgcgtgctggcgggccctttggccggccagatcctgggggaccacggcgccaatgtcatcaaggtcgaatcgttcaacggcgacgacacgcggggatacggcccgccgttcgtcggcgaggacgcggcctatttcctgggcctgaatcgaaacaagcgcagcatcgccgtcgacctgtcccggccgcagggccgggacctgttgctggatatggtgctgggcgccgacgtgctgatcgagaacttcaagcgcagcacgtggcgcaagtggggcatcacggacttcggccagctcagcgcgcgcaacccgcggctggtccattgccgcatttccggtttcggcgacgatggccagctcggtggcatgccgggctatgacgcggcggtccaggcgctgaccggattcatgacgatcaacgggcccgccgaggcggacccgaccaagctgggcgtgcccatcatcgacgtcagcacgggcttgaatgcggcgatcgcgatatcgatggcgctgttcgagcggtcgaaatccggcaaggggcagttggtggaggtcagcctgttcgacacggcgctggccatcctgcacccgcacgcggccaatgtgctggccggcgggaaggccgagcgcagcggcaacctgcatccgaacatctatccctatgacttgttcccgacccgcacggcggatatctatctggccgtgggcaacgacggccagtttcgctacctgtgcaagtcgctcggctgcccgcagctcgccgatgacggccgcttttcgtccaaccggctgcgggtcgccaaccgcgcggccttgcgcgagatcctgacgcagcgcctgaaggacgtggatggttccgagctgttccagggcttgctgagcaacggggtgccgtgcgcgccggtgcattcggtgcaggaggcgctcgagctcgagcatctgcggcagcgcgacggcctggtgcgggtgggggaataccaggggctgcgctcgcccatccggatgcagcgcacgccgccttcggtacgggcccgtccgcccggcatcggagagcatacggacgagttgctgggcgagctgggtttgccgccggggcagatcgccaggctggtggacgagggcgtggtcaaggtttccaaggagcgagcatga

SEQ ID NO: 6674 - protein, 413 aa, Bordetella bronchiseptica RB50
MGALPSIGDRRVTSTIPGSPALDGLVVLDISRVLAGPLAGQILGDHGANVIKVESFNGDDTRGYGPPFVGEDAAYFLGLNRNKRSIAVDLSRPQGRDLLLDMVLGADVLIENFKRSTWRKWGITDFGQLSARNPRLVHCRISGFGDDGQLGGMPGYDAAVQALTGFMTINGPAEADPTKLGVPIIDVSTGLNAAIAISMALFERSKSGKGQLVEVSLFDTALAILHPHAANVLAGGKAERSGNLHPNIYPYDLFPTRTADIYLAVGNDGQFRYLCKSLGCPQLADDGRFSSNRLRVANRAALREILTQRLKDVDGSELFQGLLSNGVPCAPVHSVQEALELEHLRQRDGLVRVGEYQGLRSPIRMQRTPPSVRARPPGIGEHTDELLGELGLPPGQIARLVDEGVVKVSKERA

SEQ ID NO: 6675 - DNA, 1239 bp, Bordetella bronchiseptica RB50
  CDS (1)..(1239): transl_table=11
atggcagtaacaggacctttggaaggtatacgcgttcttgatttgaccgtggcgctggccggcccgttgggctcgctgctgctgggcggcctgggcgccgaagtgatccgggtcgaatcgccgggcggcggcgacatcgcgcgcaacaatccgccctatgtcggcaaggacggcattcacttcggcgtcaggcatgaggacgaggtgtccttgaccacgctcaaccgggcgcgcaacaagaaaagcgtcaccttgaacctgaagaccgagcagggccgggcgctgttcatggagctggccaaggagtgcgatgtcctgatcgagaacgccagcgagggcaccacggcccgcctgggcgtggattatgagagcgtgcgcaaggccaacccgaagatcatctacgcttcggtcaaggccttcggcgagcccagcccgtatcccaagctcaagggcatggatatcatcgtgcaggcgctgtcgggcatcatggacgtgaccggcgtcgccgatggtccgcccacgcgctgggcgctgccgattgccgacatggtcgcgcccctgtacgcggtaaacgggattctcgccgcgctgatccatcgcggcaagacgggcgaggggcagtgcgtgcaggtatcgatgctcgattgcctggcctcgctggtggccgaagagcatttcgacgtgttcatggcgcacggctatcccaagcgctcgggcaacttccacgaccggctcgtgccgttcggggtttatggcacctccgacggccatgtggcgatggtggccttccagccggattggttcggcagtctcatgcaggccatcggcaagcccgagctggccgaggacccgcgctatgccacgcgggggccgcggatgaagcacgcgaccgagatcaacgccatgatcgaggactggacgcgccgccataccagcgccgaagtcatacacgagctgcaggaaaagcgcggcgtgccggccgcgccggtgcgctcgccccaggaggtgctgcaggatccggcattgcggcaacgcggcgcggtggtcaagctggagcacccgggcctggccaatatcgatgccatgggcatgggcctgcccatccagttttccggcacgccttccagcttcgggcaacccgcccaggagctcggggcatccaacaacgagatctaccagggcctgctcaagctgtccgacgcccagctcgaccagttgcgcggcgcaggggtgatctga

SEQ ID NO: 6676 - protein, 412 aa, Bordetella bronchiseptica RB50
MAVTGPLEGIRVLDLTVALAGPLGSLLLGGLGAEVIRVESPGGGDIARNNPPYVGKDGIHFGVRHEDEVSLTTLNRARNKKSVTLNLKTEQGRALFMELAKECDVLIENASEGTTARLGVDYESVRKANPKIIYASVKAFGEPSPYPKLKGMDIIVQALSGIMDVTGVADGPPTRWALPIADMVAPLYAVNGILAALIHRGKTGEGQCVQVSMLDCLASLVAEEHFDVFMAHGYPKRSGNFHDRLVPFGVYGTSDGHVAMVAFQPDWFGSLMQAIGKPELAEDPRYATRGPRMKHATEINAMIEDWTRRHTSAEVIHELQEKRGVPAAPVRSPQEVLQDPALRQRGAVVKLEHPGLANIDAMGMGLPIQFSGTPSSFGQPAQELGASNNEIYQGLLKLSDAQLDQLRGAGVI

SEQ ID NO: 6677 - DNA, 1212 bp, Bordetella bronchiseptica RB50
  CDS (1)..(1212): transl_table=11
atggctgcagtctcttcttccgtgccgcccaccccgctgggcggcgtgcgcgtgctggacctgtccaaggtcctggccgggccgctgtgcacgcaatacatggccgacatgggcgccgacgtgatcaaggtcgaagcggccgggcagggcgacgatacgcgcggctggccgccgttccaggatggccaggcggcggtgttcctcagctgcaaccgcaacaagcgcagcatcgcgctggacctgaagtcggcgcacgggcgcgccgtggtgcagcggctggccgcctgggccgacgtggtggtccacagcttcggtccgggcgtggcgcaaaagctgggcgtcgattgggaggccctgtccgaaatcaatccccgcctcgtgtactgcgccatctccggtttcggcccggtcggcagcctgagccacggcaaggggttcgatgtggtgctgcaggcgttctgcggcatgatctcgatcaccggcgagaccgagggcggcgcggtgcgcagcccgttctcgccggtggaccaggccaccggcctgcatgccctgatcggtatcctggcggccttgcgccagcgcgacgccagcggccgcggcgtcaccgtggacgcctcgctgttcgataccgcgctcggtttcatgggctacttcatgcagggttactgggcccgcggcaccgagcccgcgcgcgcgggcgccgggcacgagtcgctgtgcccgtaccaggatttcgcgaccgccgacaagcccatcatcctgggcatcgccaacgatgcgctgtggcgcgccttctgcaccctggccgggcgtcccgaactggtcagcgacccgcgctttgccaccaacgcgcagcgcgtggccaaccgcgcgcagaccctggcggccacgcgcgaactgctggcggcgcgcacgcgcggcgaatggctgcccgcgctcgagcaggccggcatcccctgttcccccatccatacgctggccgaggtcgatgcgcatccgcacacgcgcgaatcgggcatggtgttcgactaccccgagaccggcgccgataccgggccgctcaagggcgtggcccagccggtgcgctttgacggcatgcgcctgaccacgcccaagcggccgccgagcctcaatcaggactgggcgtcggtgctggccgacgccggctactccgatccggaagtccgggatctattgcaacagatggcctga

SEQ ID NO: 6678 - protein, 403 aa, Bordetella bronchiseptica RB50
MAAVSSSVPPTPLGGVRVLDLSKVLAGPLCTQYMADMGADVIKVEAAGQGDDTRGWPPFQDGQAAVFLSCNRNKRSIALDLKSAHGRAVVQRLAAWADVVVHSFGPGVAQKLGVDWEALSEINPRLVYCAISGFGPVGSLSHGKGFDVVLQAFCGMISITGETEGGAVRSPFSPVDQATGLHALIGILAALRQRDASGRGVTVDASLFDTALGFMGYFMQGYWARGTEPARAGAGHESLCPYQDFATADKPIILGIANDALWRAFCTLAGRPELVSDPRFATNAQRVANRAQTLAATRELLAARTRGEWLPALEQAGIPCSPIHTLAEVDAHPHTRESGMVFDYPETGADTGPLKGVAQPVRFDGMRLTTPKRPPSLNQDWASVLADAGYSDPEVRDLLQQMA

SEQ ID NO: 6679 - DNA, 1227 bp, Bordetella bronchiseptica RB50
  CDS (1)..(1227): transl_table=11
atgccaaacaaaccactgcagaaatatcgcgtactggacctgaccagggtgctggccggcccctggtgcacccagaacctggccgacctgggcgccgaggtcatcaaggtggagcgccccggcgtcggcgacgaaacgcgcggctggggaccgccctggatcccggccggagcggccagcaagcgccgcgactccgcctacttcggctcggccaaccgcggcaagaaatcgatcaccatcgacttcaccaccgcgcaggggcaagccctggtccggcagctggcggccgactgcgacgtcctggtggagaactacaagaccggcaccctggcgcgctatggcctggggtacgaggacctgaaggccgtcaaccccggcttggtgtattgctcggtcacgggcttcggccacaccggcccataccgccacaagcccgggtacgacttcgtgttccaggccatgagcggactgatgagcatcaccggcgaacgcgatgatctgcccggcggcgggccgcagaaggtcggcatcgccgtcgcggacatcaccaccggcatgtattcgaccgtggccgtgctcgccgcgctgctcgagcgcgaaagccacggccggggccagcacctggacatggcgctgctggactgcgccatggcgttcaacagcaaccaggcggtcaattacatggcctcgggcagcatgccccgccgttacgggaacgcccattcgaacgccgtgccgtaccaggtattcgacacccgcgacggccagatcgtggtggctgtcggcaacgatgccttgttcgcggcgtactgccgcgccgcgcaacgccccgacctgtgcgccgatgcgcgcttcgtaaccgtgtccgggcgcctgcagaaccgcgacgagctgctctcgcagctggccgtcgtcatggcaggcaagaccagcgcgcaatggctcgccgtgctggacgccgcgggcgttccctgcgccccgatcaacgacttcgagcaggcgctggcggacccgcaggtcaaggcgcgcaacatcgagacccacatcgcgctggaagacggcgcggtctttcgcaccatcgccagccccttgcggttctccgagaccccgctcgaccacctggccggcccgcccacgctgggccagcacacggccgatgtgctgcgcgagcgcctgggcctggatgaagcgcaacaggccggcctgcgccaggccggcgtgatctga

SEQ ID NO: 6680 - protein, 408 aa, Bordetella bronchiseptica RB50
MPNKPLQKYRVLDLTRVLAGPWCTQNLADLGAEVIKVERPGVGDETRGWGPPWIPAGAASKRRDSAYFGSANRGKKSITIDFTTAQGQALVRQLAADCDVLVENYKTGTLARYGLGYEDLKAVNPGLVYCSVTGFGHTGPYRHKPGYDFVFQAMSGLMSITGERDDLPGGGPQKVGIAVADITTGMYSTVAVLAALLERESHGRGQHLDMALLDCAMAFNSNQAVNYMASGSMPRRYGNAHSNAVPYQVFDTRDGQIVVAVGNDALFAAYCRAAQRPDLCADARFVTVSGRLQNRDELLSQLAVVMAGKTSAQWLAVLDAAGVPCAPINDFEQALADPQVKARNIETHIALEDGAVFRTIASPLRFSETPLDHLAGPPTLGQHTADVLRERLGLDEAQQAGLRQAGVI

SEQ ID NO: 6681 - DNA, 1209 bp, Bordetella bronchiseptica RB50
  CDS (1)..(1209): transl_table=11
atggtgctggacctgacgcgcatcctggccggcccctggtgcacccagatcctggccgatttcggcgcgcgggtcatcaaggtcgaacggcccggcgtgggcgacgatacgcgcagctggggaccgccatggatgcccggcgccgacggggagcaggcgcgccattccacctacttcgcggccgccaaccgcaacaagcaatcggtgtcggtggacatagccacggccgagggccaggagatcgtgcgcgcgctggcgatgcgcgccgatgtgctgatcgagaatttcaaggtcggcgacctggcccgccacggcctggactacgcctcgctgtcggccgtgaacccgcgcctggtctattgctcgatcaccggctacgggcagaccggcccgtatgccgaccgtcccggatacgacctgattttccagggcgagggcggcctgatgagcgtgaccggcgagcgtgacgaccggcctggcggcgggccgcagaaggtcggcgtggccatcgccgacatcgtgaccggcatgtacgcgtccagcgccgtgctggccgcgctgcagcggcgggccgccaccggcgcgggccaatacatcgatatcgcgctgctcgactgcatggcggcgttcggcgccaacctggccttcaaccacgtggcgaccggcgctgtgccgccgcgctacggcaacgcgcatcccaccctggtgccgtacgaagtgctggccgccagcgacggccacgtcatcgtggccgcgggcaacgacgcgcaatggcggcgcttctgcgccgcgctgggccggcccgacctggcggccgatgcgcgctatgccaccggcagcggccgcatcgtgcaccgcgacgcgttgatgccggagatcgcgcgcaccttcgcgaccgaaccggcggcgcactggctggcgcggcttaccgagcacggcataccgaacggccgcatcaacgattacaagcaggtgttcgagcatccccagctgctgcatcgcggcatgcgggtcgaaatgccggatggcgagggcaatccggtcgcgggcgtggccaacccggtgaagttctccgcctcggcggtggcttaccggcacgccgcgccggccctgggccagcacacccgcgaagtcctgtgcggcctgctgcgcatggacgaggcccgcgtgcaggcgctggccgcgcgcggcgtgctcggcgcgcgctaa

SEQ ID NO: 6682 - protein, 402 aa, Bordetella bronchiseptica RB50
MVLDLTRILAGPWCTQILADFGARVIKVERPGVGDDTRSWGPPWMPGADGEQARHSTYFAAANRNKQSVSVDIATAEGQEIVRALAMRADVLIENFKVGDLARHGLDYASLSAVNPRLVYCSITGYGQTGPYADRPGYDLIFQGEGGLMSVTGERDDRPGGGPQKVGVAIADIVTGMYASSAVLAALQRRAATGAGQYIDIALLDCMAAFGANLAFNHVATGAVPPRYGNAHPTLVPYEVLAASDGHVIVAAGNDAQWRRFCAALGRPDLAADARYATGSGRIVHRDALMPEIARTFATEPAAHWLARLTEHGIPNGRINDYKQVFEHPQLLHRGMRVEMPDGEGNPVAGVANPVKFSASAVAYRHAAPALGQHTREVLCGLLRMDEARVQALAARGVLGAR

SEQ ID NO: 6683 - DNA, 1122 bp, Bordetella bronchiseptica RB50
  CDS (1)..(1122): transl_table=11
atggccggcctgggattcgaacctcattcgccaggacagacgggcgccctggcgggcatccgcgtcctggatctgtcgcgggtgctgggcggtccgtactgcacccagatcctgggcgaccatggcgccgacgtgctcaagatcgagccgccgggcggcgacgagacgcgcgcctggggcccgccgttccaggacgggaccgcctcgtactaccttgccgtcaaccgcaacaagcgcaccgcgcggctggacctgtccacgcagcaggcgcagcaggccgtgctgggcctgctgcccgaatgcgatgtggtggtcgagaatttccgcgccggcacgatggagaaatgggggctggggccgcaggcgctgcaggagcgcttcccgcgcctggtctattgccgcgtgacggggttcggcgagaccggccccatgggcgggctgcccgcgtatgacaccgccgtccaggccatggtgggcctgatgagcctgaacgggcccgccgacgggggcccgtgccgggtcggctttccggtcatcgacctggtgacgggcatgaacgccgccctgggcgtcatgatggcgctgcaggaacgccagcgcagcggccgcgggcagtacgtcgaggcggccctgtacgacagcggcatttccctgctgcacccgtacgcgggcaattacttcctgagcggccagccgccggcgcgcgtgggcaacgcgcactcgaacatctacccctacgacgtgttcgataccgctaccgtgccgatctacctggcggtgggcaacgacatgcagttcgagcgcctgatgcgccacctgggccgggccgatgtgctcgacgacccgcgcttcggcgccaaccgctcgcgctcggaacatcgcgccgcgctgcgcgcgctgctggccggcctgttccaggccctggacggcgaaacgctggcgcaggcgctgctcgatgcgggcgtgccctgcagccccgtgctgacggtggagaaagtgctggcgcatccgcaaacggccgagcgcgccatggtggccaggataggcgagcactacaccgggctggcctcgccgatcaagctgggacgcacgcccgccagctaccgcatcgcgcccgcgtaa

SEQ ID NO: 6684 - protein, 373 aa, Bordetella bronchiseptica RB50
MAGLGFEPHSPGQTGALAGIRVLDLSRVLGGPYCTQILGDHGADVLKIEPPGGDETRAWGPPFQDGTASYYLAVNRNKRTARLDLSTQQAQQAVLGLLPECDVVVENFRAGTMEKWGLGPQALQERFPRLVYCRVTGFGETGPMGGLPAYDTAVQAMVGLMSLNGPADGGPCRVGFPVIDLVTGMNAALGVMMALQERQRSGRGQYVEAALYDSGISLLHPYAGNYFLSGQPPARVGNAHSNIYPYDVFDTATVPIYLAVGNDMQFERLMRHLGRADVLDDPRFGANRSRSEHRAALRALLAGLFQALDGETLAQALLDAGVPCSPVLTVEKVLAHPQTAERAMVARIGEHYTGLASPIKLGRTPASYRIAPA

SEQ ID NO: 6685 - DNA, 1137 bp, Bordetella bronchiseptica RB50
  CDS (1)..(1137): transl_table=11
atgcaaagcagcgatagcggcggcgcgctggccggcctgcgcgtcatcgacgcctcgcgcgtcctggccgggccgttctgcggccagatgctgggcgaccacggcgccgaggtcatcaagatcgagtcgcccgaaggcgacgagtgccgcggtttcgggccgcccttcgtcgacggcgcgtcggcgtacttccgggcggtcaaccgcaacaagcgcagcatggtgctggacctgaacagcgaggccgggcgcgagacgctgtggcagctgctggagacggccgatgtgctgatcgagaatttcaaggccagcacgctgcgcgcctggggaattgccgacccggccgagatcaccgcgcgctttccccggctggtgcattgccgcatcacgggcttcggcgacgacgggccgctgggccagctgccgggctacgacgcggcggtgcaggccatcgcgggcctgcttagcatcaacggcgaggccggcggcccgccggtgcgcctgggcgtgccggtggtggacctgaccaccggcatgaacgcggccatcgcggtgctgctggcgctgcaggcgcgccaccgcaccggccgcggccagatggccgacgtggcgctgtacgactcggcggtctcggtggcgcatccgttcctgaccaactacctggcctcgggcaagacgcccggccccagcggcaacggccaccccaacatcgtgccgtacaacgtgtaccgcacgcgcacctgcccgctgttcatcgcggtggccaacgaccggctgttcgccaagctgtgcgcgcaactgggcgtggccgagctggccgccgacgcgcgctttgcgaccaacggccagcgcgtggtcaaccgcgaggcgctggacgccgcgctgtcgcaggctttcgcgcaggtcgacggcgagccgttcggccagcagctgctggcgcagaatgtgccggccgcgcccatcctggacattgccgccgtggcggccgcgccgcacacggcgcaccgccgcatggtggtgcaacagcccgactacaccggcccgggcattccgatcaagctgtcgcacaccccggcggcgatccggcgcggtccgcccgcgctgggcgaaatggcggccccgccgcccaagcgctga

SEQ ID NO: 6686 - protein, 378 aa, Bordetella bronchiseptica RB50
MQSSDSGGALAGLRVIDASRVLAGPFCGQMLGDHGAEVIKIESPEGDECRGFGPPFVDGASAYFRAVNRNKRSMVLDLNSEAGRETLWQLLETADVLIENFKASTLRAWGIADPAEITARFPRLVHCRITGFGDDGPLGQLPGYDAAVQAIAGLLSINGEAGGPPVRLGVPVVDLTTGMNAAIAVLLALQARHRTGRGQMADVALYDSAVSVAHPFLTNYLASGKTPGPSGNGHPNIVPYNVYRTRTCPLFIAVANDRLFAKLCAQLGVAELAADARFATNGQRVVNREALDAALSQAFAQVDGEPFGQQLLAQNVPAAPILDIAAVAAAPHTAHRRMVVQQPDYTGPGIPIKLSHTPAAIRRGPPALGEMAAPPPKR

SEQ ID NO: 6687 - DNA, 1227 bp, Bordetella bronchiseptica RB50
  CDS (1)..(1227): transl_table=11
atgcatgaagttcaacagcagtcccccgcgccggccgccaagcccttggccggctatcgcgtgctggacctgacgacctttctgtcaggccccttctgcacgcagatcctcgccgacctcggcgccgaggtcatcaaggtggaggcgccggacggcgactccagccggcacattccgccgcacttcgtggacggcgacagcgcctactacctcgggatcaaccgggacaagaagagcctggccgtcgacatgaagcagcccgaggggctggccctggtcaagtcgctgatcgcccgcagccacgtggtggtcgagaactaccggccaggggtggcggcgcggatcggcctggatattgccgccctgatggcgcagcacccgagcctggtctgggcgtcgatcagcggtttcggccaggtcggcccgctgcgcgaccgtcccgcctacgacatgatcgtgcaggccatgtcgggcgtcatgagcctgacgggcgaagccggccgtcccgccgtccgcctgggcattcccgccggcgacctggcggccggcatgtacgccgccatcgccgtcaatgccgcgctggccgacgccgcgcgcggcggacggggacgccacatcgacatttccatgctcgattgccaactggccatgctctcgtaccaaagcacctacgcgctggtggccggcgtgacgccgcaacgccaggcggcccggcacgactccatccccacctatcggtcgttcctcgccggcgacggccgcgaactggtggtcaccgccaacaccgagcgcatgtggaagggcctgtgcgaggcattggggttgcgcgagctggcccaggatgcccggttctgcgacgcggagatgcgcctgcagaaccgcgagccattgtgggatttgctcgaggcggccttcctcgcccgtcccgccgccgaatggatagaaccgctggcggccaacggcgtgccggtggccttgatcaagaccgtacccgaggcgctgagcgaagcgcgcgccagcggacgcggcatggtcatgcccctgcggcggccaggcggaccggagatcgaagtggtcggcaacccgatcaagttcctgggcgaagccgagccgccggcccgctacccgccgcgcctgggcgaggacgcgccggcgatcctggcgcaatggctcggctggagcgaacaggagatccaggccatgcaggccaggaaagtcgtcatgtag

SEQ ID NO: 6688 - protein, 408 aa, Bordetella bronchiseptica RB50
MHEVQQQSPAPAAKPLAGYRVLDLTTFLSGPFCTQILADLGAEVIKVEAPDGDSSRHIPPHFVDGDSAYYLGINRDKKSLAVDMKQPEGLALVKSLIARSHVVVENYRPGVAARIGLDIAALMAQHPSLVWASISGFGQVGPLRDRPAYDMIVQAMSGVMSLTGEAGRPAVRLGIPAGDLAAGMYAAIAVNAALADAARGGRGRHIDISMLDCQLAMLSYQSTYALVAGVTPQRQAARHDSIPTYRSFLAGDGRELVVTANTERMWKGLCEALGLRELAQDARFCDAEMRLQNREPLWDLLEAAFLARPAAEWIEPLAANGVPVALIKTVPEALSEARASGRGMVMPLRRPGGPEIEVVGNPIKFLGEAEPPARYPPRLGEDAPAILAQWLGWSEQEIQAMQARKVVM

SEQ ID NO: 6689 - DNA, 1248 bp, Bordetella bronchiseptica RB50
  CDS (1)..(1248): transl_table=11
atgacccaagaaggagcgaagatgagtggtggcggtgcaagcaagcccatgccgatggacggcatccgggtgctggatttgtcgcgcgtgctggcgggcccgtggtgcacgcagatgctggccgatttcggcgccgatgtgatcaagatcgagcggccagggcagggcgacgacagccgggcctgggggccgccgttctacgagtcggccgacggccatgaacgggtgtccgcgtacttctgcgccgccaaccggggcaagcgctccgtgtgcctggacctggagtccgaggcggaccgccaggcgctgcgcgaactggcgctgcgcagcgacgtactggtcgagaatttcaaggccggctcgctggcgcggcatgggctggattacgccacgctgtcggcgctgaatccgcgcctggtgtactgctcgatcacgggctatgggcagaccggcccgtatgcggccaggccgggctacgactcgatcatccaggccgtgggcggaatgatgagcgtgacaggcctgcccgatgacgccgctggcggcggtccgcagaaaaccgggattcccatcatcgacctgatgaccggggtctacgcctgctgcggcgtgctgatggccttgcgcgagcgcgaggccagcgggcagggccagcacctggatctctcgctgatggacgtgcaggtatcggcgctgtccaccctggccgccaacttcctggcgtgcggccaggcgccgcaacgcaacggcaacgaacatccgaccgtcgtgccgggcgacgccgtccagtgcctggacggcccgctcatgctgatggtgggcaacgaccggcagttccagcgcctttgccgccatctggaccgcgagtcgctggcgcgcgatcctcgctatgcgaccaacgagctgcgcgtccagggcaagaatgcattgatggcgcaactgcgcgaggccttccgcggccagacacgccagtactggctggaacgcctgctggccgaaggcattccctgcgggccgatccagaccgtggcggaggtgctggccgatccgcacgtgcgccaccgggcgctcgtggccgcagcgccggacccggtgttcggcgaaatccgcgcgatgggcagcgcgttgcgcatgtcgcgcacgccggcccgccacgggcgggcgccaaccgtgctgggcgagcacaccgaagcggtgctgtcgtcgctggcctcgtcccgtcttcaatccaacccgcaagccaaatga

SEQ ID NO: 6690 - protein, 415 aa, Bordetella bronchiseptica RB50
MTQEGAKMSGGGASKPMPMDGIRVLDLSRVLAGPWCTQMLADFGADVIKIERPGQGDDSRAWGPPFYESADGHERVSAYFCAANRGKRSVCLDLESEADRQALRELALRSDVLVENFKAGSLARHGLDYATLSALNPRLVYCSITGYGQTGPYAARPGYDSIIQAVGGMMSVTGLPDDAAGGGPQKTGIPIIDLMTGVYACCGVLMALREREASGQGQHLDLSLMDVQVSALSTLAANFLACGQAPQRNGNEHPTVVPGDAVQCLDGPLMLMVGNDRQFQRLCRHLDRESLARDPRYATNELRVQGKNALMAQLREAFRGQTRQYWLERLLAEGIPCGPIQTVAEVLADPHVRHRALVAAAPDPVFGEIRAMGSALRMSRTPARHGRAPTVLGEHTEAVLSSLASSRLQSNPQAK

SEQ ID NO: 6691 - DNA, 1197 bp, Bordetella bronchiseptica RB50
  CDS (1)..(1197): transl_table=11
ttggcgctgcaacacattaccgtgctggacctgacccacatgctttccggcccctacggcacgatgctgcttgccgacctgggcgcgcgcaccatcaaggtggagccgcccggcgccggcgagggcacccgccgcctgctcgagcacgatcccgattattcgcgcgacggcatgggcgcctactacctgacgctgaaccgcaacaagcaaagcgtctgcgtggacctcaagagcgaggccggcaaggcggtcttcctggacctggtgcgccaggccgacgtggtgttcgacaacttcggcgtgggcgtgacgcagcgcctgggcatcgatcatgcgtcgctggcgcgggtcaacccgcgcatcatcacctgttcggtgaccggcttcgggcagaccggaccgcagacgcagcgtcccgcgttcgaccaggtggtccagggcatgggcggcggcatgtccatcaccggaacgcccgagacgggaccgatgcgcagcggcatccccatcggcgacctgggcggcggcctgttcggcgccatgggcgtgctggcggcgctggccgagcgcgagcgcaccgggcgcggacagcatgtggatgtctcgatgctggacgcgcagatctcgatgctcaactacatggcgaccatgtacctcatgtcgggacaggtgccggcgggcatcggcaacggccacttcgtgcacgtgccgtacaacacctatcccacctccgatgggcacatcatcatcgcctgcatcggcgacgccttcttcgagcgcttcgtcgagtgcatcgacctgcccgaactgcgcgatcccgcctaccgccagcagccggcgcgcttcgcggccaaggcgcggatcgacgccatcgtcggcgcggcgctgcaggccaggccgacggcgtactggctggagcggctgggcgcggcgcgcattccgtgcggcccggtcaacgattttgcgcaggcgctcaacgacgcgcaggtgcgcgcgcgcgacatggtggtcgaggtgccgctcaagagcggcgagcggctcggcatgccgggcaacccggtcaagctgtcggcggccgcgccgcgcgcctttacctgcccgcccgcgctgggcgagcataccgaagccgtgctggccgagctggccggctatggtcccgcgcaactggagcgcctgcgtgccgccggcgcgatcgggtga

SEQ ID NO: 6692 - protein, 398 aa, Bordetella bronchiseptica RB50
MALQHITVLDLTHMLSGPYGTMLLADLGARTIKVEPPGAGEGTRRLLEHDPDYSRDGMGAYYLTLNRNKQSVCVDLKSEAGKAVFLDLVRQADVVFDNFGVGVTQRLGIDHASLARVNPRIITCSVTGFGQTGPQTQRPAFDQVVQGMGGGMSITGTPETGPMRSGIPIGDLGGGLFGAMGVLAALAERERTGRGQHVDVSMLDAQISMLNYMATMYLMSGQVPAGIGNGHFVHVPYNTYPTSDGHIIIACIGDAFFERFVECIDLPELRDPAYRQQPARFAAKARIDAIVGAALQARPTAYWLERLGAARIPCGPVNDFAQALNDAQVRARDMVVEVPLKSGERLGMPGNPVKLSAAAPRAFTCPPALGEHTEAVLAELAGYGPAQLERLRAAGAIG

SEQ ID NO: 6693 - DNA, 1170 bp, Bordetella bronchiseptica RB50
  CDS (1)..(1170): transl_table=11
atgagaaacgccgcagacacgcccgcggccatggcggcgggcagcgcattggacggcatacgcgtcgtggacctgtcgcgggtgctgagcgggccttattgcacccagatactggccgaccacggcgcggacgtggtcaagatcgaaccgccgggcggcgacgagacgcgcgcctgggggccgccgttcgccggcgaggttgccgcctattaccagggcatcaatcgcaacaagcgcggcgcctggctggatctgtcgtccgaggccgggcgcgccgcgctgctggcgcagctcgacggcgccgatgtgctggtggagaacttcaagtgcggcaccatggagcgctgggggttgggcttcgaggtgttgagcgggcggtttccgcgcctgatccattgccgggtatcgggcttcggcgccgacggccccatggggggcatgcccggctacgacgcagcgatccaggccatgtccggcatcatgagcgtcaacggcgatcccggcggcgagcctacccgcgtgggggtgcccatcgtggacatggtgaccggcatgaacgcggccatcggggtgctgctggcgttgcaggagcgccagcgcagcggccgcgggcagttcgtcgatatcgcgctgttcgattgcgcgctatccatcctgcatccgcatacggccagccattttgccgccggcgtcacgcccggccgcaccggcaatgcccatcccaacatcaccccttacgacattttccccacggcgaccgatccgctgttcctggcggtcggcaatgaccggcaattccggatcctgtgcgaggcgctgggcgcggcggcgctggccgacgatccgcgctacgcctccaacggccagcgttgcgccaaccggcaggcgctgacccggtcattggccgcgctgctgagccggcacgcggcgcagggactggccgagcgcctcatccgcgcaggcgtgccttgctccagcgtcctggacattccccaggcgttgcggcatccgcaggccgtgcatcgggaaatggtcgtgcaacgcgacggctatgccggcgtggcttcgcccgtcaagctgggccgcacgccggcgcgctaccgcatgccgccgccgcgcttcggccagcaccagctcgagctcgacttccccgtcgcctcgggccgctga

SEQ ID NO: 6694 - protein, 389 aa, Bordetella bronchiseptica RB50
MRNAADTPAAMAAGSALDGIRVVDLSRVLSGPYCTQILADHGADVVKIEPPGGDETRAWGPPFAGEVAAYYQGINRNKRGAWLDLSSEAGRAALLAQLDGADVLVENFKCGTMERWGLGFEVLSGRFPRLIHCRVSGFGADGPMGGMPGYDAAIQAMSGIMSVNGDPGGEPTRVGVPIVDMVTGMNAAIGVLLALQERQRSGRGQFVDIALFDCALSILHPHTASHFAAGVTPGRTGNAHPNITPYDIFPTATDPLFLAVGNDRQFRILCEALGAAALADDPRYASNGQRCANRQALTRSLAALLSRHAAQGLAERLIRAGVPCSSVLDIPQALRHPQAVHREMVVQRDGYAGVASPVKLGRTPARYRMPPPRFGQHQLELDFPVASGR

SEQ ID NO: 6695 - DNA, 1194 bp, Bordetella bronchiseptica RB50
  CDS (1)..(1194): transl_table=11
atggacctcacccgcgtcctggccggaccctgggccacgcagatcctggccgacatgggcgcccgggtcatcaagatcgagcgccccggcgcaggcgacgacctgcgcggctgggggccgccgttcctgaagaacgcgcacggcgaggaaaccaccgatgccgcctacttcctcagcgccaaccgaggcaaggagtcggtgacgctggacatctccagcgccgaaggccaggaaatcgtccgccagctcgccaaggacgcggacgtgctggtcgagaactacaaggtcggcacgctggcgcgcttcggcctggactatgagtcgctgcgcaagatcaatccgcggctcgtgtattgctcggtcaccggattcggccagaccggcccgcacgcccacctgcccggctacgactacatattccagggcatgggcggactgatgagcatcaccggcttgccggacgccgaacccggcggcggcccgctcaagaccggcatccctatcaccgatgtggtcacgggcatctacgcctcgacggcgatcctgggcgcgctggagcaccgcaacctcagcggcgaaggacaggccatcgacatctcgctgctcgattgcctggtcaacgtcaccggctgcgccgtcatgaactacttcctgtcgggcaagataccgcagcggctgggcaacacgcactccaacatggttccgtaccaggtgttccgttgcaaggaaggcgacgtgatcgtggcggtcggcaacgacacccagttcgtgacgttcgccggattgatcggcatgccgcagctggccacagacagccgcttctcgaccatggcgcaacgcagccgcaaccgcgaaacgctgattcccatcatcgcccaggccatgcaggcgcgcaccatgcaggaatgggtgtccctgctcgaggccgccaacgtgccgtgcgggcccatcaacaatctgcagcaggtgttcgaggacgcgcaggtgcagcatcgtggactcaagctgtcgctgccgcatggctcgggcgtggacgcgccaggcgtcgccagcccgatccgctactcggccacgcccatcgcctatggcagggccgcgccctgcctgggagagcatacggacgacgtactgcaatcggagctcggcatggcgccggcggcgatcggcgcgctgcgcgcgcgcggcatcgtctga

SEQ ID NO: 6696 - protein, 397 aa, Bordetella bronchiseptica RB50
MDLTRVLAGPWATQILADMGARVIKIERPGAGDDLRGWGPPFLKNAHGEETTDAAYFLSANRGKESVTLDISSAEGQEIVRQLAKDADVLVENYKVGTLARFGLDYESLRKINPRLVYCSVTGFGQTGPHAHLPGYDYIFQGMGGLMSITGLPDAEPGGGPLKTGIPITDVVTGIYASTAILGALEHRNLSGEGQAIDISLLDCLVNVTGCAVMNYFLSGKIPQRLGNTHSNMVPYQVFRCKEGDVIVAVGNDTQFVTFAGLIGMPQLATDSRFSTMAQRSRNRETLIPIIAQAMQARTMQEWVSLLEAANVPCGPINNLQQVFEDAQVQHRGLKLSLPHGSGVDAPGVASPIRYSATPIAYGRAAPCLGEHTDDVLQSELGMAPAAIGALRARGIV

SEQ ID NO: 6697 - DNA, 1230 bp, Bordetella bronchiseptica RB50
  CDS (1)..(1230): transl_table=11
atgtcgcaacgtcctgctcccctgaccggcattcgcgtgctggatctcacccgcgtgctggcgggcccctggtgtacccagaacctggccgacctgggtgcggaagtcatcaagatcgaacggcccggcgcgggcgacgacacgcgcgcctgggggccgccctatctgaaggatgcggccggcaacgacaccaccgaggcggcctactacctctcggccaaccgcaacaagctgtcggtggcgctggacatcgccacgccgcgcggggcggagctggtgcgcgaactggcgcagcaatgcgacatcctggtcgagaacttcaaggtcggcggcctgcgcaagtacgggctggactacgaaagcgtcaaggccatcaacccgcgcctgatctattgctcgatcacgggcttcggccagaccggcccgtatgccagccgccccggctacgatttcatgatccagggcatgggcggcctgatgagcatcaccggcgagcgcgatgacctgcccggcggcggcccgcagaaggcgggcgtggcggtgaccgacctgatgaccggcatgtattccacggttggcatcctggccgcgctgcacgagcgcaaccgcagcgggctgggccagcatatcgacatggccctgctcgattgccaggtggccatgctggccaaccagaatctcaattacatgacttccggcaaggcgccgcgccgcgccggcaacgcacaccagaacctggtgccctaccaggtgttcgcggtcagcgacggccacctgatcgtggcggtgggcaacgacagccagttccgcaactattgccgcgtgatcgacctgcccgaactggccgacgatccgcgctttgccaccaatccgcagcgggtgcagaaccgcgatgagctggtgccgctgctggccgagcgcatggccaccggcgagcgcgatgcctggctggccgcgctggagagcgccggcgtgccggccgggcccatcaatacgctggaccaggtcttcgaagacccgcaggtggtggcccgccagatcaggcgcgagctgccgcacccgagcgccggcaccgtgccgaccgccagcagtccgctgcgtttctccgacagccccgtcgagtaccgccgcgccccgccgctgctgggcgagcacacccgccaggtgctcagcgagcgtctcgggctgtccgagaccgaaatccaggccctggccgcgggacagggctga

SEQ ID NO: 6698 - protein, 409 aa, Bordetella bronchiseptica RB50
MSQRPAPLTGIRVLDLTRVLAGPWCTQNLADLGAEVIKIERPGAGDDTRAWGPPYLKDAAGNDTTEAAYYLSANRNKLSVALDIATPRGAELVRELAQQCDILVENFKVGGLRKYGLDYESVKAINPRLIYCSITGFGQTGPYASRPGYDFMIQGMGGLMSITGERDDLPGGGPQKAGVAVTDLMTGMYSTVGILAALHERNRSGLGQHIDMALLDCQVAMLANQNLNYMTSGKAPRRAGNAHQNLVPYQVFAVSDGHLIVAVGNDSQFRNYCRVIDLPELADDPRFATNPQRVQNRDELVPLLAERMATGERDAWLAALESAGVPAGPINTLDQVFEDPQVVARQIRRELPHPSAGTVPTASSPLRFSDSPVEYRRAPPLLGEHTRQVLSERLGLSETEIQALAAGQG

SEQ ID NO: 6699 - DNA, 1209 bp, Bordetella bronchiseptica RB50
  CDS (1)..(1209): transl_table=11
atgtcgccgctgcacggaatacgcgtcctggacctgacgcgggtggtgtccggcccgttctgcaccatgctgctgggcgacctgggcgccgaggtcatcaagatagaagagccggtccatggcgacgacagccgcgccttcgggcctccgttcagcggcggcgaaagcgcctatttcctttcggtaaaccgcaacaagcgcagctgcgccatcgacctcaagcagcccgaaggcaaggagctgctgcgcgcgctggcgcgcgccagcgacgtcgtcatcgacaacttccggcccggcacgatggcgcggctcggcctcggatacgacgcgctgcgggccgccaacccgcgcctggtcagctgctcgatcaccggcttcggcgacagcggccccgacgcgcagcggcccggctacgacctgatcatccagggcgaatcgggcatcatggacatcacgggcgacccggccggcctgccgaccaagatcggcacctccatcgccgacctgatcaccggccagttcgcctcccaggccatcaccgcggcgctgctggaacgcgcgtccagcggacagggccgccacgtcggcatcgccatgctcgactgcatggcgtcgctgctgaccttcaacgccggcatctacttcaccaccggcgccagccccacgcggcgcggcaacgcgcacccgaccatcgcgccgtacgagacgttccaggccgccgacggctggctgaacatcggcgtggccaacgacaagttctggcaattgttctgcggcgtgatcgcgcgccccgacctggccgacgacccgcgctacgcgcgcgccgccgaccgcgtcgcgctgcgcgccgaactggtgccgcgcatcgccgccctgatcgccgcgaaaccgcgcgcatactggatcgccgcgctgcgcgaagccggcgtgccgtgcggcgacatacgctcggtggccgaggtctgcgaggccgagcaactggtgtcgcgcggcatggtgttcgacatgccgcacccgagcgccggacaggtgcgcaacatcgccagcccgttccgcttcgacggggccgggacggcggcgcatcgcgcgcccccgctgctgggcgagcacacggcggcgatcctgtgcgaacatgccggcttgcggcccgaacgcgtggcggacctggccgcgcgcggcatcatacgcacccacgccaccagcaactga

SEQ ID NO: 6700 - protein, 402 aa, Bordetella bronchiseptica RB50
MSPLHGIRVLDLTRVVSGPFCTMLLGDLGAEVIKIEEPVHGDDSRAFGPPFSGGESAYFLSVNRNKRSCAIDLKQPEGKELLRALARASDVVIDNFRPGTMARLGLGYDALRAANPRLVSCSITGFGDSGPDAQRPGYDLIIQGESGIMDITGDPAGLPTKIGTSIADLITGQFASQAITAALLERASSGQGRHVGIAMLDCMASLLTFNAGIYFTTGASPTRRGNAHPTIAPYETFQAADGWLNIGVANDKFWQLFCGVIARPDLADDPRYARAADRVALRAELVPRIAALIAAKPRAYWIAALREAGVPCGDIRSVAEVCEAEQLVSRGMVFDMPHPSAGQVRNIASPFRFDGAGTAAHRAPPLLGEHTAAILCEHAGLRPERVADLAARGIIRTHATSN

SEQ ID NO: 6701 - DNA, 1191 bp, Chromobacterium violaceum ATCC 12472
  CDS (1)..(1191): transl_table=11
atggcaggagcgttgtcgggtatcaaggtggtggacctgagccgggtgctggccgggccgtgggccagccagttgctggcggatctgggcgcggaggtgatcaagatagagaagccgggcagcggggacgacacccggcagtgggcgccgcccagcctgccggacggcagggccgcctatttcctgtgcaccaaccgcggcaagcgctcgctgacggtggacatcgcccagccggccggccaggagatcgtgcgcaagctggtcgccgacgccgatgtggtgctggagaactacaaggtgggcggcttgaggaagtacgggctggattacgacagcctgaaggccgtcaaccccaggctggtgtattgctcgatcaccggtttcggccagaccggcccctacgccagcctggccggctacgactacatcgtgcagggcatgtccggcctgatgagcatcaccggcccggccgacggcgagccgcacaaggtgggcgtggcggtatccgacctgttcaccggcctctacgccgccaacgcggtgcaggcggcgctgatcgcccgcgagcgcaccggcgccggccagcacatcgacatggcgctgttcgactgctcgctggcgatgctggccaatgtcgcctccaactggctggtcgggcataatgtgccgccgcggctgggcaacgcccacgccaacatcgtgccctaccaggtgttcgccgcctccgacggccacttcatcctggcctgcggcaacgacaagcagttcgccgaggtgtgccgtctggtcggccaggcgcaatgggcgcgcgatccgcgctacgcgaccaatccgcagcgcgtcgcccaccgcgtgcagttggtgccgctgctggcgcaggctttccgccaccacggccgcgactactggctgtcggcgctggacaaggccggcgtgccctgcgggccgatcaacaatgtggccgaggcattcgccgatccgcaggcgcaggcgcggcagatgcagctggacatgcgggacgacgccgggcggcaagtgccgctggtagggtgtccgatcaaactttccggcacgccggtcgagtacaatctagcccctcccgagctgggagaacatactgagcagatcttgcgcgcgttgggttacgtggattcggacattgtcgcattgcgcaacaatggcaccgtttaa

SEQ ID NO: 6702 - protein, 396 aa, Chromobacterium violaceum ATCC 12472
MAGALSGIKVVDLSRVLAGPWASQLLADLGAEVIKIEKPGSGDDTRQWAPPSLPDGRAAYFLCTNRGKRSLTVDIAQPAGQEIVRKLVADADVVLENYKVGGLRKYGLDYDSLKAVNPRLVYCSITGFGQTGPYASLAGYDYIVQGMSGLMSITGPADGEPHKVGVAVSDLFTGLYAANAVQAALIARERTGAGQHIDMALFDCSLAMLANVASNWLVGHNVPPRLGNAHANIVPYQVFAASDGHFILACGNDKQFAEVCRLVGQAQWARDPRYATNPQRVAHRVQLVPLLAQAFRHHGRDYWLSALDKAGVPCGPINNVAEAFADPQAQARQMQLDMRDDAGRQVPLVGCPIKLSGTPVEYNLAPPELGEHTEQILRALGYVDSDIVALRNNGTV

SEQ ID NO: 6703 - DNA, 1206 bp, Rhodopseudomonas palustris CGA009
  CDS (1)..(1206): transl_table=11
atgacctctgcatcgatgcccggcgcaatcgccggattgcgcgtgatcgatctcactcgcgtgctcggcggcccctattgcacccaaatcctcgccgaccacggcgccaacgtcatcaaggtcgaacctccggccggcgacgaagtgcgcgactggggccctcccttccatgacgaggacgcggcgtattttctcggcgtgaatcgcaacaagcgttccatcggtctcgatctcgcctcacccggcgggcgcgaggtgctgttgaagatgctcgaagacgccgacgtgctgatcgagaacttcaaacccggcacgctcgacaaatggggcctctccaacgaggtgattcgcgagaagtttccgcggctggtgcattgccggatttcgggcttcggcgccgacggcccgcgcggcggcaatcccggttatgacgccatcatccaggcgatgaccggcatgatcgctgcgaccggctcgccggagaccggcccggtgcgaatcggtgtgcccctggtcgacatcaccaccggcctgtatgcgaccatcgctattctgatggcgctggcggagcgtgagcgctccggcaagggccagttcgtggagaccacgctgtacgaaaccggtctcgcgatcatgcatccgcataccgcgaattacttcctgcatggcaagccgccggcgctcaccggtaacgagcacccgaatctggtgccgtattccaccttcaacgcccgcgacggccagatcttcaccggcgtcggcaatgacggtaccttccgcaagctgtgcaaggagatcggcaagccggaactcggcaccgatccgcgcttcgcgcgcaacaaggaccgcatcgccaaccgcgccgccctccgcgcagaactcgaagcggtgttcagccagcacgacgccgtgccgctgtgcgaccggctgctcaatgcgggccttccggccggcccagtgcagacgatcgacaaggcgctgaccagcccccacaccgcctaccgcggcgatgtgatcgagaaggactggtacaagggcgtagcctcgccgatcaggttcgagcgcaccaaggcgagcctgcgcggcctgccgccgaaattcagccagcacgccagcgaagtgttgggcgagttcggctattcggcggacgatatctccaagctggtcgccgacggcatcgtcagcggcccagagcgcaagcgctga

SEQ ID NO: 6704 - protein, 401 aa, Rhodopseudomonas palustris CGA009
MTSASMPGAIAGLRVIDLTRVLGGPYCTQILADHGANVIKVEPPAGDEVRDWGPPFHDEDAAYFLGVNRNKRSIGLDLASPGGREVLLKMLEDADVLIENFKPGTLDKWGLSNEVIREKFPRLVHCRISGFGADGPRGGNPGYDAIIQAMTGMIAATGSPETGPVRIGVPLVDITTGLYATIAILMALAERERSGKGQFVETTLYETGLAIMHPHTANYFLHGKPPALTGNEHPNLVPYSTFNARDGQIFTGVGNDGTFRKLCKEIGKPELGTDPRFARNKDRIANRAALRAELEAVFSQHDAVPLCDRLLNAGLPAGPVQTIDKALTSPHTAYRGDVIEKDWYKGVASPIRFERTKASLRGLPPKFSQHASEVLGEFGYSADDISKLVADGIVSGPERKR

SEQ ID NO: 6705 - DNA, 1197 bp, Magnaporthe grisea 70-15
  CDS (1)..(1197)
atgacgcgggtcttggcgggtccttattgcacacaaattcttggtgatttgggcgccgaggtgatcaaaatagaacaccccgttcgcggagatgacacccgcgcctggggccctccctatgccgcctacaagccggattcgcctctcgccgggacatcccccggcgagtcggcatactacctaacggtgaaccggaacaaaaagtccatcgggctaagcttccaggacccagctggcgtggagatcctgcacaagctcatggcaaagtgcgacatcctggtcgagaactacctccccggcgcgctcaaaaagtacaaactggactacgccacggccgccaagatcaatccttctctcatctatgccagcatcacggggtacggacagactggtccctactccgacagggccggctatgacgttatggtcgaggccgagttcggcttgatgcacatcacgggcacgagggacgggccgcccgtcaaggtcggcgtcgccgtcacggacctgacgacgggcttgtacaccagcaacagcatcatggcggcgctgctcgccaggcaaaagtcgggcaggggtcagcacctcgacgtcgcgctgagcgactgccagaccgctacgctcgccaacattgcgagcagctgtttgataagtggaaagaaggacacgggccggtgggggacggcgcatccctcgatcgttccctaccgagccttccagacccgcgacagcgccgtcctcctcggcggcggcaacgaccgcctgtttgccgtcctctgcgaccgcatcggccggccggacctcaagacgaacgagcggtacacgaccaacgcgctgcgcgtacagcaccgcgacgagctcgaggagcagatcgaggccgtgacgcgctcccggacgacgcaggagtggctcgacgtcctggccggctgcggcatgccttatgcggccgtcaacgacgttcagggcgcgctgaaccacgagcacacaatcgctagggacatggtggtcgaggtcgagcacccgagctgcggcacggtcaagatggtcaacacgcccgtcaagtacagcgagagcacgccggggatcaggacggcgccgccgactttgggccagcatactaatgaggttttgggagaattgttggggatggatggggagcagattgagggtttgagggagaaaggtgtggtgaggtaa

SEQ ID NO: 6706 - protein, 398 aa, Magnaporthe grisea 70-15
MTRVLAGPYCTQILGDLGAEVIKIEHPVRGDDTRAWGPPYAAYKPDSPLAGTSPGESAYYLTVNRNKKSIGLSFQDPAGVEILHKLMAKCDILVENYLPGALKKYKLDYATAAKINPSLIYASITGYGQTGPYSDRAGYDVMVEAEFGLMHITGTRDGPPVKVGVAVTDLTTGLYTSNSIMAALLARQKSGRGQHLDVALSDCQTATLANIASSCLISGKKDTGRWGTAHPSIVPYRAFQTRDSAVLLGGGNDRLFAVLCDRIGRPDLKTNERYTTNALRVQHRDELEEQIEAVTRSRTTQEWLDVLAGCGMPYAAVNDVQGALNHEHTIARDMVVEVEHPSCGTVKMVNTPVKYSESTPGIRTAPPTLGQHTNEVLGELLGMDGEQIEGLREKGVVR

SEQ ID NO: 6707 - DNA, 1272 bp, Nasonia vitripennis
  CDS (1)..(1221)
atgaggctcagttcgacaaatgtagatgatacgtctcctctgggaggtattagagtgttggacctgtctcggatagtggctggaccatattgcaccatgatcctgggagacttgggagctgaaatattgaagatcgagcagccaggagttggagatgaggctcgcaaatggggaccaccgttttttcagaataccaacgagtctacttattttgccagtgtgaatcgaaataaaaagagtgtctgcattgatttaaagaagggaaaacatgttgtttatgatttagctagaaagtctgacattctgattgagaattacgtacctggaaaactgtcaaagatgggtttgggttacgatgagataaagaacgttgctccgcatttaatatattgctcgttgactggatatggatcagaggggccttattcaaagagaccaggatacgatgttattgctgcttccttgggtggtctgatgcacataacaggaccaaaggatggtgccccttgtaaacctggtgtggcattaactgatcttgccactggtttgtacgctcatggtgcaattatggcagcactacttcaacggatgaagactaataaaggccagtggattcagtgtaatcttttgtcaactcaagtggccactctaataaacattggctccaattatcttaatgctggtaaggaggcaaaaagatgggggtctgaacacgaaagtattgtcccttatgaagcttttccaaccaaagatggttatatgactgttgggactggcagtgacttacaattttctgatcttctcagaaagttaggaatgcctgaactacagtctgaagaaaaatttaaaaataacatcaacagagttaaaaatagaggtgaactattggaaatattgcgaagaaaattcaaggaaaaaactaatgaagaatggaataaaattttggaaggctcaacatttccttatggacaaatcaatacaatgaaacaagtatttgaggatccacacattaaacacataaaattggtaaaagaaattgatcatcctgtagcaggaaaaatgaaagttgtaggcccacctgtgaaatattctcatgctaaaaatgaggtacgacttcctccgccgggactaggtcaacacacttctgaaattttgaaaaatgttttgaattactctgagcaaaccatagaagaattgaggagcaataaagttatacaataatattttttataaactacattcctattgtaatatatttttatatgatattgt

SEQ ID NO: 6708 - protein, 406 aa, Nasonia vitripennis
MRLSSTNVDDTSPLGGIRVLDLSRIVAGPYCTMILGDLGAEILKIEQPGVGDEARKWGPPFFQNTNESTYFASVNRNKKSVCIDLKKGKHVVYDLARKSDILIENYVPGKLSKMGLGYDEIKNVAPHLIYCSLTGYGSEGPYSKRPGYDVIAASLGGLMHITGPKDGAPCKPGVALTDLATGLYAHGAIMAALLQRMKTNKGQWIQCNLLSTQVATLINIGSNYLNAGKEAKRWGSEHESIVPYEAFPTKDGYMTVGTGSDLQFSDLLRKLGMPELQSEEKFKNNINRVKNRGELLEILRRKFKEKTNEEWNKILEGSTFPYGQINTMKQVFEDPHIKHIKLVKEIDHPVAGKMKVVGPPVKYSHAKNEVRLPPPGLGQHTSEILKNVLNYSEQTIEELRSNKVIQ

SEQ ID NO: 6709 - DNA, 1441 bp, Aedes aegypti
  CDS (61)..(1359)
ccagattacaataattttattaagttgaagatagctcagagctattttcatttttgcgaaatgttcagaaactgtagcagattattgcgccgggacggcctgcagttaggagattattctagaaaattccacctgactaaagtgcttccaagtagtgtcgatccgagcaagtaccctttggatgggataaagattctagacttgacccggattgtggctgggccatattgcacaatggtactatccgatctgggagcagaggtgtacaaagttgaacgacccttccacggagacgagtcacgaaagtggggtcccccattcctgagagattccgaagattcggtttacttcatggcttcgaatcgaaacaagaagagtgtttgtgtggatttgaagaaggggaaagatgtgatatacgacatggcgcgaaagtgtgatgtgctggtggagaactacattcccgggaagctggacgagttcggattgggttacgaagatctgaagcagattgccccatcgttgatttactgttccatcacggggtacggatcggtgggaccctatcggaacaaacccggatacgacgtgatagctgcatcgatgggaggattgctgcacatcactggaagtgaggatggtcctccctcaaaggttggcgtggcaataaccgacatagcaacgggattatatgcccatggagcgatcttggccgctctgctgcaacgaaccagaaccaattgcggtcagaagatcgatgtaaatctgctatcgacgcaggtggcttgtctcatcaacgtggccagtaactatttgaacgccggaaaggaagccaagcgttggggtacggcccatgctagtatcgtaccttatgaggctttcccaacaagcaacggttacataacgataggatgcggaagtaacgttcaattcgaggcattgtgcaactatcttcaaatccaagaagtagccaaagatgcccgcttcgtaacaaatcagactcgtgtcaagcatcgtaaagaactgatcgccattctggcgccaatcattcagcagcgaagctcagccgaatggatggaaatttttgccgatgctccatttccggtgggaccgataaacagcatggccgaagtatttcgtgatcctcatatcgaggccattgggctggtgaagagtctcgaccatccgacatcgggtgaggtcaaagtcgttggtccaccggtcatctacagcgaagctaacaattgtgcacggactgctccgcctttattgggggaacacacggatcgggttttgcgtgagctgctcgactatccggatgataagatcgataagcttcgccagaaaggcattatacagtgatactatagttacatgcattgttgcagtaaaacagatattatatattgtttctcagaatttgataaaataaagcatttatttt

SEQ ID NO: 6710 - protein, 432 aa, Aedes aegypti
MFRNCSRLLRRDGLQLGDYSRKFHLTKVLPSSVDPSKYPLDGIKILDLTRIVAGPYCTMVLSDLGAEVYKVERPFHGDESRKWGPPFLRDSEDSVYFMASNRNKKSVCVDLKKGKDVIYDMARKCDVLVENYIPGKLDEFGLGYEDLKQIAPSLIYCSITGYGSVGPYRNKPGYDVIAASMGGLLHITGSEDGPPSKVGVAITDIATGLYAHGAILAALLQRTRTNCGQKIDVNLLSTQVACLINVASNYLNAGKEAKRWGTAHASIVPYEAFPTSNGYITIGCGSNVQFEALCNYLQIQEVAKDARFVTNQTRVKHRKELIAILAPIIQQRSSAEWMEIFADAPFPVGPINSMAEVFRDPHIEAIGLVKSLDHPTSGEVKVVGPPVIYSEANNCARTAPPLLGEHTDRVLRELLDYPDDKIDKLRQKGIIQ

SEQ ID NO: 6711 - DNA, 1197 bp, Gibberella zeae PH-1
  CDS (1)..(1197)
atggccgacaacaccaaaccttacaagccgtattgtactcagattttgggtgatcttggcgctgaggtgatcaaaatcgagcatcctactcgaggcgatgacaccagagcatggggacctccgtacgccaaatacaaagaaggatcatcagcaaaagggcctggagagtcggcatacttcataggggcaaaccgaaacaaaaagtcacttggcctatccttccagcatgaagaaggcgttcaggttcttcacaagcttgcagcgaaatgcgacgtcttggtcgagaattacctcccaggaacactgaagaagtattcaatggactatgaaaccctccgcaagatcaacccgggtctaatatacgcctccatcactgggtatggtcagacaggaccgtacgcaagccgggcaggctacgacgttatggtggaagccgaatttggtcttatgcacatcaccggagaaagggatggtcctccagtaaaggttggtgttgcagtgacagacttgacgactggtctttacaccagcaatagcgttatggccgctctccttggtagggccaagtccggaaagggccagcatatcgacattgcattgagtgattgtcagacagcaacattggcaaacatcgccagcagctgtttgatcagtggaaagaaggattcggggcgttggggcacagctcatccatccattgtgccatacaagtcattcgagaccaaagacggaggtattctctttggtggaggtaacgatcgcctttttggtgttctctgcgatggtctgggtcaaccccagtggaaggacgacgtgcggtacaagaccaatgccgacagagtcaaaaaccgcaacgatttagaggccaggatcgaggccatgaccaaactcaagacaacacaggaatggcttgagattttcgagggcaagggtttgccttatgctgccatcaatgatgtccaaggaacgctcaaccacgaacatacaaaagcccgcaacatggtgatcgagatggaacatgatgagtgcggtccattaaaaatggtcaacacgcctatcaagttctcagaaacgcctcctacaattcgcagcgcaccgcccatgctgggacaacacacgaatgaagtgctgcaagagcatcttgggttcactgaagctgaagttgatgttttgagagaaaagggtgttgtcggatag

SEQ ID NO: 6712 - protein, 398 aa, Gibberella zeae PH-1
MADNTKPYKPYCTQILGDLGAEVIKIEHPTRGDDTRAWGPPYAKYKEGSSAKGPGESAYFIGANRNKKSLGLSFQHEEGVQVLHKLAAKCDVLVENYLPGTLKKYSMDYETLRKINPGLIYASITGYGQTGPYASRAGYDVMVEAEFGLMHITGERDGPPVKVGVAVTDLTTGLYTSNSVMAALLGRAKSGKGQHIDIALSDCQTATLANIASSCLISGKKDSGRWGTAHPSIVPYKSFETKDGGILFGGGNDRLFGVLCDGLGQPQWKDDVRYKTNADRVKNRNDLEARIEAMTKLKTTQEWLEIFEGKGLPYAAINDVQGTLNHEHTKARNMVIEMEHDECGPLKMVNTPIKFSETPPTIRSAPPMLGQHTNEVLQEHLGFTEAEVDVLREKGVVG

SEQ ID NO: 6713 - DNA, 1362 bp, Yarrowia lipolytica CLIB122
  CDS (1)..(1362)
atgcttcgtatcaatcgcgttcgacagttctcacacatcagaagcttctccagcacgtcacgtgccctgaactccggctcgtcgcttcctctggctggggtcagagtggtggacatgtctcgggttctggccggaccctactgcacacaattgctggctgatctgggagcagacgtgatcaaaatcgaacacccgactcgtggcgatgacactcgagcctggggtccgccgtttgcgccatacacaaagacggatgactctcttggagtcagtagggatatggtggaggttgcaggcacagcacctggcgagtcggcttactttctttgcgtgaaccgaaacaaaaagtccgtcggcctgtccttccagtcggacgagggcaaggctgctctcaaacgtcttattgcttctgctgacgtgtttgtcgaaaactacgttcctggcactctcaaacggtatggactcagttacgatgatctcaaggatgctaaccccaagctcatctacacatccatcacaggatacggccagactggaccttactcgcaccgacccggctacgatgtcatggttgaagcggaaatgggactcatgcatatcaccggagaaccggatggagctccctccaaggtcggagtagccgtgactgatctcaccaccggcctctacgcatctaactccgtgctggcagctctcattaagcgaggcgtttccggcaagggcacgcatatcgatgcctctctagccgactgtcaggtggcttctcttgccaacatcgcctctcaggtgctcatcagtggcaagcctgactcgggccgacagggaactgcgcatccgtccatttgcccctaccaggcctttgataccgccgatggaagcattatgatcggaggaggcaacgacaatctgttcaagttggcctgtgacgctctgggcaagcctgagtggaaaactgacccccggttcttgtccaacgcccttagagtcaagaacagagacattctggtgcctgccattcacgaggtgaccaagaccaaaaagaccaacgactgggttgaaatcttcaaggtcttcaacttcccatttgccgctatcaacgacattcagaccacgctgagcaacgagcacgttgtggcacgagacatgatccagactgtggatcaccccgtttgtggtcccatgaaactcgtcggtgtccccgtcaagttttctgacaagacgtcgcagcccaacattcgaatgcccccgcctctgcttggtcagcacacctttgaggtcttccgagaggtcgggtactctgatgccgagatcaacaagctcgtccaggacggcgttattcggggccgaagtgactcggtttag

SEQ ID NO: 6714 - protein, 453 aa, Yarrowia lipolytica CLIB122
MLRINRVRQFSHIRSFSSTSRALNSGSSLPLAGVRVVDMSRVLAGPYCTQLLADLGADVIKIEHPTRGDDTRAWGPPFAPYTKTDDSLGVSRDMVEVAGTAPGESAYFLCVNRNKKSVGLSFQSDEGKAALKRLIASADVFVENYVPGTLKRYGLSYDDLKDANPKLIYTSITGYGQTGPYSHRPGYDVMVEAEMGLMHITGEPDGAPSKVGVAVTDLTTGLYASNSVLAALIKRGVSGKGTHIDASLADCQVASLANIASQVLISGKPDSGRQGTAHPSICPYQAFDTADGSIMIGGGNDNLFKLACDALGKPEWKTDPRFLSNALRVKNRDILVPAIHEVTKTKKTNDWVEIFKVFNFPFAAINDIQTTLSNEHVVARDMIQTVDHPVCGPMKLVGVPVKFSDKTSQPNIRMPPPLLGQHTFEVFREVGYSDAEINKLVQDGVIRGRSDSV

SEQ ID NO: 6715 - DNA, 1278 bp, Apis mellifera
  CDS (1)..(1278)
atggagagatcagtaacatctgaacaatcagctactcaaatacaaacagaaacagatgttacagattctgtatctcaggtatatgataaatcacctttatccggaattcgtgttttggatttgactcgaattgttgccggaccttattgtaccatgattcttggagatcttggtgctgaaatcttaaaaattgaaaaaccagagagtggggatgaagcacgaaaatggggtccaccatttatacaaggaactgaagaagcaacttattttcttagtgttaatagaaataaaaaaagtatatgtattgatttaaaaaaaggcaaagatatcatttatgagttagcaaaaaaatctgatgtattagtagaaaattatgtaccaggaaaattgaaaaaaatgggtttaggatatgaagatatttccaaagtagcacctcatctaatatattgttctttgactggttatggatataaaggaccttatgcaaatagaccaggatatgatatgattgctgcttccataggaggattattacatataacaggttcaaaaaatggtccaccatgtaaagttggaatagcagtaactgatttagcaacaggtttatatgctcatggtgctatattagctgcattatatcaaagaatgacaactaagaaaggacaatggattcaatgtaatttattggcaacacaagttgctagtttaataaatataggatcaaattatttaaatgctaataaagaagcagtacgttggggttcagaacatgaaagtattgtaccttatgaagcttttcatacaaaagatggttatatgactgtaggaactggaagtgatacacaatttttagatttacttaaaagaatgcatttaatagaattatctaaaatagataaatacaaaaataacaagactagagtggaaaatagagatgaattattatctattctcagaaaaaaatttgaaacaaaaactaataaagaatgggcaattgtttttgaaggtgcttcattcccatatggaccaataaatacaataaaacaggtttttgaagatcctcatataaactatatgaaaatggtacaagaaatggagtattctacaggaaaaaaaattaaagttattggtcctgctgtaacttatagttattctacaaataaagttcgatgtgcacctcctgtaatgggtcaacatactacagaaatattaaaaaatattttaaactataccgatgataaaatagaagctttaaagaaagtcaagattgtgcaataa

SEQ ID NO: 6716 - protein, 425 aa, Apis mellifera
MERSVTSEQSATQIQTETDVTDSVSQVYDKSPLSGIRVLDLTRIVAGPYCTMILGDLGAEILKIEKPESGDEARKWGPPFIQGTEEATYFLSVNRNKKSICIDLKKGKDIIYELAKKSDVLVENYVPGKLKKMGLGYEDISKVAPHLIYCSLTGYGYKGPYANRPGYDMIAASIGGLLHITGSKNGPPCKVGIAVTDLATGLYAHGAILAALYQRMTTKKGQWIQCNLLATQVASLINIGSNYLNANKEAVRWGSEHESIVPYEAFHTKDGYMTVGTGSDTQFLDLLKRMHLIELSKIDKYKNNKTRVENRDELLSILRKKFETKTNKEWAIVFEGASFPYGPINTIKQVFEDPHINYMKMVQEMEYSTGKKIKVIGPAVTYSYSTNKVRCAPPVMGQHTTEILKNILNYTDDKIEALKKVKIVQ

SEQ ID NO: 6717 - DNA, 1341 bp, Aspergillus nidulans FGSC A4
  CDS (1)..(1341)
atgaatgcaacatttaggttacaaagggtgctgattgcccagcgccctagcatacaacgatcaaccagaaccaacatcttcagacacgcgacacaatggcgctcctactctagtccgctgcctccagcggatgggacattgcctctacagggcatccgggtacttgatatgacgagagttctcgcggggattctgggggacctaggggccgaagtgatcaaggtagaacatcctgtgcggggagacgacactcgagcgtggggtccaccatacgcaaaatacgcaaacgactcaaaagaaggccctggggagagcgcctattatttagcggtcaaccggaacaagaagtcgattggtctctcgttcgcccacaagtccggcgtcgatattctccacaaactcgtcaaggagtgcgatgtcctagtagagaattatctccctggaagcctcaagaagtataacatggactatgagaccttacgggaaatcaatccgagcctgatctacgcgagtattacagggtacggccagaccgggccatacagcaaccgcgctgggtacgatgtgatggtggaagctgagatgggattgatgcacatcactggaagcagaggaggtgaccccgtcaaggtcggagtggccgtcacagatttgacaacggggctatacacatccaatgccatcatggctgctttgcttgcccgagtaagaacagggaagggacaacacattgacgcatgtctcagcgattgccaagttgcaacattatccaacattgcgagttctgctctgatcagtggacagaaggattcaggacggtggggtactgagcatccatccattgttccgtaccggagttaccaaaccctcgacggggatattctctttggcggcggtaacgacagacttttcggtgtcctgtgcgatcggctagggcaccccgagtggaaggaggacccccgatttctaaccaacagagaccgcgtaaagcaccgagccgtgatcgacggcttgatcgaagactgtgtcaagcaaaagaccacgcaacagtggttggagatcatggaaggcagtggaatgccctatgcagctgtcaatgacattcaggggacgttgaaccacgagcacgtccgagcccgcggaatggtcaccgagattgatcatccagcatgtgggcctgtcaagttagtaaacacaccgatcaaatattcccatgcaacccctggcgtgcgcactcctcctcctactctcggacaacacaccgatgaggtcctcggagaactccttcaatatggcgagaaacagatttcccaattgaaacaagacggcgttgtctcatag

SEQ ID NO: 6718 - protein, 446 aa, Aspergillus nidulans FGSC A4
MNATFRLQRVLIAQRPSIQRSTRTNIFRHATQWRSYSSPLPPADGTLPLQGIRVLDMTRVLAGILGDLGAEVIKVEHPVRGDDTRAWGPPYAKYANDSKEGPGESAYYLAVNRNKKSIGLSFAHKSGVDILHKLVKECDVLVENYLPGSLKKYNMDYETLREINPSLIYASITGYGQTGPYSNRAGYDVMVEAEMGLMHITGSRGGDPVKVGVAVTDLTTGLYTSNAIMAALLARVRTGKGQHIDACLSDCQVATLSNIASSALISGQKDSGRWGTEHPSIVPYRSYQTLDGDILFGGGNDRLFGVLCDRLGHPEWKEDPRFLTNRDRVKHRAVIDGLIEDCVKQKTTQQWLEIMEGSGMPYAAVNDIQGTLNHEHVRARGMVTEIDHPACGPVKLVNTPIKYSHATPGVRTPPPTLGQHTDEVLGELLQYGEKQISQLKQDGVVS

SEQ ID NO: 6719 - DNA, 1491 bp, Ustilago maydis 521
  CDS (1)..(1491)
atgcatgtggtctctagcggtctgagatcgctgctgtgcgaatatactagcaaatgtatgcccaacgcaagagctggtctgcgaactcttgcagtgataccagatacgactgcagttacgaagccagtggcggccagcgcgataatacgaggcgtacaagaccaccgacgcggcttaactacgactccagccagacgatcagaggcgagcgctgaagagcgtccttcgattccgcctcctctcaagggcatccgaattgttgacttgacccgtgtcctcgctggtccgtattgtaccatgttgctagccgatcttggtgcagatgtgatcaaagttgagcatccaaaaggtggagatgatacacgagcgtggcttccaccgtttgccaagcctccgaccggcaagcacgctcccaaggcaccaacaggcaaggaagactattgggcttcgctaccaccagagtcggcctattttctgagtgtcaaccgctccaagcgatccatcacagtagacctcaaatcgaaggccggaaagaagatcatctacgatttggtggccaaggccgacgttgtggtagaaaactatttgcccggcaaactcgccagcatgggtctcggatacgaagacttgaaaaaggtcaaacccgacattatctacgccagtcttacgggctatggacagactgggtcgtatcgcgataaagcaggttacgatgtcatcattgcggccgatgcggggatgatgcacatcacgggcgaagctgatcgaccgcctgtcaagattggtgttgccatgaccgaccttaccacaggactgtacgttcatggagccatcatggccgcgctgctcggacgcgctcagactggcaaaggtgtgcacattgacgcgagtctgttcgaatcgcagatcgcatcgctggccaacattgcgtccaactatctcatcgcaggtcaggaagctggacgacacggcgacaagcatccgtctatcgtgccctaccagaccttccaggcaaaagacggccggatcatgctgggtgcaggtaacgacggccagttcagattcctctgcaatctgctcgagcgacctgagctgtcgatggacgaaaaatacgctaccaatgcggcacgtgtagcgcaccgcgacacacttatcccactgctcgacgagctgctgcaaaaaaagacggtgcaggaatggtgcgatctcatcaacggtaaaattccagccgcacccatccgaaacatcaaaggcacgttcgacgagcatccacagagcaaagacagaaaagtggtggccgaagtagaacacccaagggcgggaaagatcaagattgtggcgccggcggtgagatatggcaacggcaagatgaaaatcaccagaccaccaccggtcttggggcagcatacggatgagattctgacgcaggagttgggcatgtcggaagacgaggttgccgagttgcgcaaggctgggtctattggacagtga

SEQ ID NO: 6720 - protein, 496 aa, Ustilago maydis 521
MHVVSSGLRSLLCEYTSKCMPNARAGLRTLAVIPDTTAVTKPVAASAIIRGVQDHRRGLTTTPARRSEASAEERPSIPPPLKGIRIVDLTRVLAGPYCTMLLADLGADVIKVEHPKGGDDTRAWLPPFAKPPTGKHAPKAPTGKEDYWASLPPESAYFLSVNRSKRSITVDLKSKAGKKIIYDLVAKADVVVENYLPGKLASMGLGYEDLKKVKPDIIYASLTGYGQTGSYRDKAGYDVIIAADAGMMHITGEADRPPVKIGVAMTDLTTGLYVHGAIMAALLGRAQTGKGVHIDASLFESQIASLANIASNYLIAGQEAGRHGDKHPSIVPYQTFQAKDGRIMLGAGNDGQFRFLCNLLERPELSMDEKYATNAARVAHRDTLIPLLDELLQKKTVQEWCDLINGKIPAAPIRNIKGTFDEHPQSKDRKVVAEVEHPRAGKIKIVAPAVRYGNGKMKITRPPPVLGQHTDEILTQELGMSEDEVAELRKAGSIGQ

SEQ ID NO: 6721 - DNA, 1362 bp, Cryptococcus neoformans var. neoformans B-3501A
  CDS (1)..(1362)
atgttacgtatggctttcttcaggattcaacccttgcattttggcaagactttattagcacgatccggtgtgcaacattacgcatcctcagtatcacgcctgcgaggcttctctactccagccattgtgaatgatgataggccactcgctggtatcaaggttgtagacttgacaaggattcttgctgggccgcttgccacaatgatgctttctgatcttggggccgatgtcattaagattgaatcgcctaagaacggtgatgacacacgctcatggctccctccttctgccccagtcccacctgagggttatccaaggcctgatcttcctcctgaatccgcctactttttgcaagccaatagaaacaagcgatctctgacgcttaacctcaaatctgcagaaggacaaaaaatcatcaaaaaattgatcgaaaaagcagatgtactcgtagaaaattacgtcccaggaaaactcaaaaaattcggtctctcatgggaagaagtgaaagaaatgaatccccggttaatctattgctccattacaggatatggatcaaccggaccttattctcagtcaccgggatacgacgttgttattgaagctgaagcaggactaatgcatatcacgggagagaaaggcggtaaacctgtcaaggttggggtggcggtcacagacgtcctgactgggcaccatgcacagtccggtattttggcagctcttttgaagcgtcagaagacagggaaaggctctcgcgttgagtgtagtctgtttgaaagtcagattgcttctctctgcaatataggtgccaattatctcattgcgggagaagaagctacccgttggggcacatcgcacccctccatagtcccttaccaagtgtttcccacgaaggattcttttataatgctctcggctggcaatgattcccaattcgcgattctttgctcgtctgccgtgcttaacaagcctgattggttaaatgacgaccgattttctagtaaccgtaagagagtggagcacagagatgtcatgatcgcacttattgaggaagttctctctgaaaaaacaaccgaggaatggtgccagaaactcgtaggaaaaggactaccgtttgcaccaatcaacaatatcgctcaaacattctcgcatccacaagctatagcgagagaggtagtagaagaagtgattcatcctcgggctggtaagatcaagcttgcagcaccagccgtcacatatgatggtagcaaaccgaagttgtatcgcccaccgccgtacttgggtgaacatactgaggaagtcttaacagaactcggctgcagctcgggtgaaataaagaagatgaagttggacggcgttatatga

SEQ ID NO: 6722 - protein, 453 aa, Cryptococcus neoformans var. neoformans B-3501A
MLRMAFFRIQPLHFGKTLLARSGVQHYASSVSRLRGFSTPAIVNDDRPLAGIKVVDLTRILAGPLATMMLSDLGADVIKIESPKNGDDTRSWLPPSAPVPPEGYPRPDLPPESAYFLQANRNKRSLTLNLKSAEGQKIIKKLIEKADVLVENYVPGKLKKFGLSWEEVKEMNPRLIYCSITGYGSTGPYSQSPGYDVVIEAEAGLMHITGEKGGKPVKVGVAVTDVLTGHHAQSGILAALLKRQKTGKGSRVECSLFESQIASLCNIGANYLIAGEEATRWGTSHPSIVPYQVFPTKDSFIMLSAGNDSQFAILCSSAVLNKPDWLNDDRFSSNRKRVEHRDVMIALIEEVLSEKTTEEWCQKLVGKGLPFAPINNIAQTFSHPQAIAREVVEEVIHPRAGKIKLAAPAVTYDGSKPKLYRPPPYLGEHTEEVLTELGCSSGEIKKMKLDGVI

SEQ ID NO: 6723 - DNA, 1316 bp, Strongylocentrotus purpuratus
  CDS (12)..(1316)
tctacgtaaaaatgaatatgaatcttgcacatgcaaagtgcatgcgggtcgttggttttagaggaaatttcacatcttggttagcaaggagacagaaacttagatgtctctcatctgtttcctcaccgcttgctggcatcagagtagttgatctaacaagagttttagcaggccctttctgctctatgctcttgggagatctaggggctgaggtaatcaagattgaaaggccgggtgttggagatgagactagacattggggtccaccattcatcaatggagaaagctgctactttctatcggtcaatagaaataaaaagagtctcgctgtaaatctgaagcatcccaaaggaatagaggtggttaagaagttagttgcatccagtgatgtgctcctggagaactacatccctggcaagctggaggagctaggtctagggtatgacagcctcagagaaaccaatcctggtctaatctactgttcaattacaggttatggccagactggaccatactcggagaggggtggctatgacctcatagcagcaggcttgggaggactgatgaatatcacaggcccacaggaaggggatccatgcaaagtaggtgtggcgatgacagatctgtccaccggtctctatgccaaaggtgccattctagcagctctattacacagaatgcagacaggagaaggccagagaattgataccaatctcttatcaacacaggtttcattattgacccatctcgctacaaattacctaatggatggcagggaggctaagaggagaggcacccaacatgaaagcatagtaccatatcaggcattcaagactgctgatgggtatctgatcataggcgctggtaatgacagagcatttcagaccttatgtaagaggatatgtctctcggagctagctgaagaccctcagtacaagaccaacgcacaaagggttctaaatagagatgtgcttctacctgtcttgtcgaaaaggttatctgagaagaagaccagcgattggatggaagtgctggaggggtgtggcttcccctacggaccaatcaacacgatgggtcaggtgtttgatgacccccaggtcaagcataatgatctggttcaggagattgatcatccgacagcgggaacgatgagggtaccaggccatgccgtccagtacagcaccatatcaaccaaagaaaattttccctctcccttgcttggacagcatacagcagacattctcaccaatcttcttggatacacaaaatctcaggtggaagagcttcacagggataaagctatagctctcccatga

SEQ ID NO: 6724 - protein, 434 aa, Strongylocentrotus purpuratus
MNMNLAHAKCMRVVGFRGNFTSWLARRQKLRCLSSVSSPLAGIRVVDLTRVLAGPFCSMLLGDLGAEVIKIERPGVGDETRHWGPPFINGESCYFLSVNRNKKSLAVNLKHPKGIEVVKKLVASSDVLLENYIPGKLEELGLGYDSLRETNPGLIYCSITGYGQTGPYSERGGYDLIAAGLGGLMNITGPQEGDPCKVGVAMTDLSTGLYAKGAILAALLHRMQTGEGQRIDTNLLSTQVSLLTHLATNYLMDGREAKRRGTQHESIVPYQAFKTADGYLIIGAGNDRAFQTLCKRICLSELAEDPQYKTNAQRVLNRDVLLPVLSKRLSEKKTSDWMEVLEGCGFPYGPINTMGQVFDDPQVKHNDLVQEIDHPTAGTMRVPGHAVQYSTISTKENFPSPLLGQHTADILTNLLGYTKSQVEELHRDKAIALP

SEQ ID NO: 6725 - DNA, 1374 bp, Tribolium castaneum
  CDS (1)..(1374)
atgacggacccatctccttctcaaacgatgcaagaaccgactacttccactgtgacagtcgtcgaaactgtcgagcccgatgaacagtcgaaaatgttggccactgtgtacaaatccatccctcatgttaaattcgcccgtttaaaaatagcaaacagcgcgtttagatcaatacactcgcgtaatttcccgctggaaggcgtgcgagttctagatttaacccgaatagtggcagggccgtactgcaccatgattttggccgacctgggggccgaagtcctcaaaatcgagcggcccgggggcggcgacgaggcccgcaaatggggcccgccgttcatcaacaacacggcggaaacggcgtacttcgtctgcctcaaccgcaacaaaaaaagtgtctgtgttgatctcaaaaaaggccgcgatattctgtacaaactggccgaaaagtcggacgtgttggtggaaaattacgtgccgggaaaactagacgagatgcagctgggttacgagcacctcaaggcagttgccccccatttaatctactgttccatcactgggtttggccccgatggcccgtacaggaccaagcctgggtacgacgtcattgcggcctcgatggggggcttcctgcacatcacggggccccaagggggcgagccctgcaaggccggcgtcgccatgaccgacctatcgaccggcttgtacgcgcatggggctatcatggccgcgctctttcagcgcacaaggaccggaaaggggcaaaaaatcgactgcaatctcctctcaacccaagtggcctcactcatcaacattggctcaaattacctaaacacggggaaagaggcaagtcgctggggcaccgcccacgagagcatagtcccatacgaagcgttcccgaccaaggacgggtactacaccataggcactgggtccgacttgcaattccaagacctttgcaggaaactaaaacggccagatttggccgaaaacgacaaatttaaaaccaaccagctgcgagttaagcacaggactgaattgatcggtctgttacggtctataatggccactaaaaccaaaaaagagtggagtgaaatttttgccggcgggtcttttccgtcagggcctgtgaattccttaaaagaaactttcgatgacccgcatatcaaggaaatcggattggtgcaaaatttggagcatcctgtggctggcaacataaaagttgttggacctccggtcaagtatagcgatgggggaaacagtgtgagatctccgccaccgactttaggccaacacactcaagaagtcctggagactattttaaactattcaaccgaacaaattaatgatctgaaaaagcaaagtgtcattcagtga

SEQ ID NO: 6726 - protein, 457 aa, Tribolium castaneum
MTDPSPSQTMQEPTTSTVTVVETVEPDEQSKMLATVYKSIPHVKFARLKIANSAFRSIHSRNFPLEGVRVLDLTRIVAGPYCTMILADLGAEVLKIERPGGGDEARKWGPPFINNTAETAYFVCLNRNKKSVCVDLKKGRDILYKLAEKSDVLVENYVPGKLDEMQLGYEHLKAVAPHLIYCSITGFGPDGPYRTKPGYDVIAASMGGFLHITGPQGGEPCKAGVAMTDLSTGLYAHGAIMAALFQRTRTGKGQKIDCNLLSTQVASLINIGSNYLNTGKEASRWGTAHESIVPYEAFPTKDGYYTIGTGSDLQFQDLCRKLKRPDLAENDKFKTNQLRVKHRTELIGLLRSIMATKTKKEWSEIFAGGSFPSGPVNSLKETFDDPHIKEIGLVQNLEHPVAGNIKVVGPPVKYSDGGNSVRSPPPTLGQHTQEVLETILNYSTEQINDLKKQSVIQ

SEQ ID NO: 6727 - DNA, 1155 bp, Mycobacterium sp. JLS
  CDS (1)..(1155): transl_table=11
atgacgggactcgcgcagcccctggagggcatcacggtggtcactctcgagcatgcggtggccgcgcctttcgcgacgcggcagcttgcggacctaggggcccgggtgatcaaggtggaacgccccatggtcggcgacttcgcccggacctatgaccggacggtgcacggcgaatcgagctacttcgtctggctcaaccgtggtaaggaaagcgtcgagatcgacatcaaggacgccgccgatcgccgattgctcgacaacctcatcgaccgtgccgacgtcttcgttcaaaatctcggccctggggtagtcgaccggatcggcctggacgcttcgacgctgcgcgcacgccgccccggcctcatccactgctcgatatccggttacggacccggcggcccatacacgtcgaagaaggcctacgacttgctcatccaatgtgaggccggactgctcgccaccacgggaacagcagacaccccgtcgaaggtcggtatctccatcgccgacatcgccaccggtatgtacgcctacaccggcatcctgacggcgctctacacgcgcgggcgcaccgacgaaggtgccacgatcgacgtcgcgatgctcgatgcattgggcgaatggatgatgcaacccgtgtacttcagcgtctacggaagtcaaccgacgcgacgcaccggggcgcggcatgcctcgatcgctccctacgggccgtatcgagtgggcgaaacttcaacggtgttcttgggagtgcagaacgaccgtgagtggaaagcgttgtgtgagcgcgtcatcaaccgcccggaactcgtcgaagacgagcggttcgccaccaatacggcgcgggtcaccaatgacgccgagatcacgggactcctcgaagaggcattccgcgcgagcaccgcagacgatgtgacagcgcgcctggacgcggccggtatcgcctgcgcggagttgcgcagcccggccggcttcgcccaacaccctcaactcgcggccaggaaccgctggcgcgcagtggccaccgcaggagggacggtgaacgcgttgcttccgccggtcacgatcgccgggcatgaggcaccgatgcggccggtgccgcgactcggtgagcacaaccccgccatacgtgccgagttcggcacgacccgctga

SEQ ID NO: 6728 - protein, 384 aa, Mycobacterium sp. JLS
MTGLAQPLEGITVVTLEHAVAAPFATRQLADLGARVIKVERPMVGDFARTYDRTVHGESSYFVWLNRGKESVEIDIKDAADRRLLDNLIDRADVFVQNLGPGVVDRIGLDASTLRARRPGLIHCSISGYGPGGPYTSKKAYDLLIQCEAGLLATTGTADTPSKVGISIADIATGMYAYTGILTALYTRGRTDEGATIDVAMLDALGEWMMQPVYFSVYGSQPTRRTGARHASIAPYGPYRVGETSTVFLGVQNDREWKALCERVINRPELVEDERFATNTARVTNDAEITGLLEEAFRASTADDVTARLDAAGIACAELRSPAGFAQHPQLAARNRWRAVATAGGTVNALLPPVTIAGHEAPMRPVPRLGEHNPAIRAEFGTTR

SEQ ID NO: 6729 - DNA, 1194 bp, Clostridium difficile 630
  CDS (1)..(1194): transl_table=11
atgaaaaaaggagcattaagcaatataaaggtacttgaccttacaagagttcttgcaggtccatattgtacaatgatgttggcggattttggagctgatgttataaaaatagagatgccaagaaaaggtgatgatacaagaggttttggaccttttgtaaatggagagagtttatactatgcaaatataaatagaaataaaaaaggtatcactctaaaccttaaatcagaagaaggaaaaaatatatttttagaaatggtaaaacatgctgatgttgtagtagaaaattacagaccaggtgtaatggaaaagttaggtctgggttatgatgagttggctaaagttaacaatcaaataatttatggagctgtatcaggatttggatgttatggaccatattcagaacgtccaggttatgatattattgcacaggcaatgggtggtcttatgagtataacagggcaagaaggaggagaaccaacgagagttggtaatgctatgggtgatgtactaggtggaatgaatttaaccattggtatactcacagcactcaacgctagaaaaataataggaaaaggacaaagagtagatgtttccctcgttgattctgttgtatcgtctctcgaaactggtatacagagatactttgattcaggacaacctgaacttatgggtaatagatatgcttcagcctatccttatgactcttttaaggcaagtgatggaagttttgtaataggctgtggtaatgacaaactttttgaaaagttatgtaaaaaagttctttttagagaagaccttttaatagatgagagatttaaaacaaatcttaatcgttgtgaacattacaaggctcttaaaccagaaatagaaaaatggtctgttaagcatacaataaaagaagcagttgacttaatatcagaggctggagttcctgctgctcctatctataatcttgattgtgttacaacagatgaacatatagcaaaagcaagagaaatgattgtagatattagtcatcctattataggaaatatgaaagtcaatggaaatccagttaagttgatgacaacaaaagctaaaattgatatgccagcaccatctctaggggaaagtaacgaggagatttataatggttggcttggttttgatagtgataaaataaaagatttaaaagaaaatggagttatttga

SEQ ID NO: 6730 - protein, 397 aa, Clostridium difficile 630
MKKGALSNIKVLDLTRVLAGPYCTMMLADFGADVIKIEMPRKGDDTRGFGPFVNGESLYYANINRNKKGITLNLKSEEGKNIFLEMVKHADVVVENYRPGVMEKLGLGYDELAKVNNQIIYGAVSGFGCYGPYSERPGYDIIAQAMGGLMSITGQEGGEPTRVGNAMGDVLGGMNLTIGILTALNARKIIGKGQRVDVSLVDSVVSSLETGIQRYFDSGQPELMGNRYASAYPYDSFKASDGSFVIGCGNDKLFEKLCKKVLFREDLLIDERFKTNLNRCEHYKALKPEIEKWSVKHTIKEAVDLISEAGVPAAPIYNLDCVTTDEHIAKAREMIVDISHPIIGNMKVNGNPVKLMTTKAKIDMPAPSLGESNEEIYNGWLGFDSDKIKDLKENGVI

SEQ ID NO: 6731 - DNA, 1203 bp, Herminiimonas arsenicoxydans
  CDS (1)..(1203)
atggctggaccattgaacggcatgcgcgtcatcgagctggcccacatcatgtcgggccccatctgcggcatgatgctggccgatatgggcgccgatgtcatcaaggtcgagaagacgcctgacggcgacgattccagacgtttttcacccatgctgccgtgcggtgaatccgcttccttcatgatcgtcaaccgcaacaagcgcggcatcggactgaatctgaaaacggaaggtggacgcgaagtcctgcgtcgcctgctggccgatgccgatgccgatgtcgtgatcgaaaattatcgtgccggcacgatggaaaaattcggcctcggttacgaggagcttaagttattgaatcctggcctgatttattgctccatttccggcttcggacgcaccggcccctatgcagacaagggcggcttcgatctgatcgcgcaagggatgagcggcatgatgagcatgaccggcgaagaaggccgggcgccaatcaaggccgggtcgccagtagccgatatcaacgccggcattcttgctgcattaggcattgcggcagcctatgcaaacaagctgcgcaccggcctcgggcaggtagtcgatacctccttgtttgaagcagggttgcagcagatgtactggccggcagcgaattattttgccgatggcaccatcctgcccaaaatgggttccgctaattcaaccagtgcgccatatcaggtatttgcatccagcgacggctggatcaatatcggcgcggcgaatcaaaacaattacgaacgcttgctggaagtgttgcagatgccggcgctggcagatgatccgcgctttcgcaccaatgccgaccgcatggccaatcgcgaggcgctggtgcagttattgaacgagcgcctggtgacgcgcacgacggcgcaatggctggaggaattcgatgcggtgggtttgccggccggcccggtattgaatgtggctgaagcgatggcgcacgaacaggcaattgcccgcgacatgatagtggagacggaacatccggttgccggtcccgtcaaggggctgggtttgcctatccgcttctccgatgatgcaggcacctcgcagcggcctgcgcccttgctgggtgaacatacgttcaaggtcttgctggaacttggctatggcgaagaagaaatcctggtgctgcagcagcaacaggctgtgttgatactgtag

SEQ ID NO: 6732 - protein, 400 aa, Herminiimonas arsenicoxydans
MAGPLNGMRVIELAHIMSGPICGMMLADMGADVIKVEKTPDGDDSRRFSPMLPCGESASFMIVNRNKRGIGLNLKTEGGREVLRRLLADADADVVIENYRAGTMEKFGLGYEELKLLNPGLIYCSISGFGRTGPYADKGGFDLIAQGMSGMMSMTGEEGRAPIKAGSPVADINAGILAALGIAAAYANKLRTGLGQVVDTSLFEAGLQQMYWPAANYFADGTILPKMGSANSTSAPYQVFASSDGWINIGAANQNNYERLLEVLQMPALADDPRFRTNADRMANREALVQLLNERLVTRTTAQWLEEFDAVGLPAGPVLNVAEAMAHEQAIARDMIVETEHPVAGPVKGLGLPIRFSDDAGTSQRPAPLLGEHTFKVLLELGYGEEEILVLQQQQAVLIL

SEQ ID NO: 6733 - DNA, 1167 bp, Novosphingobium aromaticivorans DSM 12444
  CDS (1)..(1167): transl_table=11
atggcgaaaccggcctggcgggccgcagtaaccggcgatccgtccaaaccgctcgatggggtacgggtgcttgagctcgcccgcattctggccggaccttggtgcgggcaattgctggcggacctgggcgccgaagtgatcaagatcgagcggcccggtgcgggcgacgacacgcggcattgggggccgccgttcgtgaccgcagaagacggtacgagtctgggcgcggcctatttccattcgaccaatcgcggcaagcgctccttcgcgatcgacatcgccagcgcggaaggccaggccatcatccgcgagctggcgaacggggccgacatcgtgatcgaaaactacaaggtcggcgggctggcgaaatacgggcttgaccatgccgcgctgtccgaactgaacccgcgcctgattacttgctcgatcaccgggttcgggcagaccgggccttatgcccaccgcgcgggctacgatttcatcgcccaggccatgggcggcatgatgtcgatgaccggcgaacccgatcgcgagccgcagaaggcgggcatcgcggtggccgacctgttcacgggcatgtacagcactgtggcgattctcgccgcgctcaaccgccgggaccgcaccggcagcggcgcccatatcgacatggcgctgctcgatacccaggtggcggtcatggccaatcaggcgatgaactggatgacttcgggcaaagtcccgcgccggttcggcaacggtcatgccaatctggcaccctatcaagccttccccacgcttgacggacccttggtgattgcggccggcaacgacggccagttcgccagcttgtgccgcgttttgcggtgttcactgcatgaagacccacgcttcgccacaaatcctgcccgtctctcgaaccgggcggaactggtcacaacggtcgaggggcgcacggcccagtggaaccgacaagcgctgttcgacgcgcttgaagaggttggcgtgccagccggaccgatcaacgaactcgacgaagtgttcgccgatccgcaggtcgtcgccagaggcctcgccgcaatggccggagggcgcaaaggcgtcgcgagcccgatcgtgatcgacggggtgcgaatggtttcgaatctggccgcgccgggaagtcccgagccggtcgaagatgaatag

SEQ ID NO: 6734 - protein, 388 aa, Novosphingobium aromaticivorans DSM 12444
MAKPAWRAAVTGDPSKPLDGVRVLELARILAGPWCGQLLADLGAEVIKIERPGAGDDTRHWGPPFVTAEDGTSLGAAYFHSTNRGKRSFAIDIASAEGQAIIRELANGADIVIENYKVGGLAKYGLDHAALSELNPRLITCSITGFGQTGPYAHRAGYDFIAQAMGGMMSMTGEPDREPQKAGIAVADLFTGMYSTVAILAALNRRDRTGSGAHIDMALLDTQVAVMANQAMNWMTSGKVPRRFGNGHANLAPYQAFPTLDGPLVIAAGNDGQFASLCRVLRCSLHEDPRFATNPARLSNRAELVTTVEGRTAQWNRQALFDALEEVGVPAGPINELDEVFADPQVVARGLAAMAGGRKGVASPIVIDGVRMVSNLAAPGSPEPVEDE

SEQ ID NO: 6735 - DNA, 1242 bp, Novosphingobium aromaticivorans DSM 12444
  CDS (1)..(1242): transl_table=11
atgactggcgaggcttctccggcaggccccctggcgggcctgcgcgtcctcgacctgtcgcgcgtgctggcggggccgtggtgtacccagatcctgggcgatctgggcgcggaagtcatcaaggtggaacagcctggccagggcgacgatacccgccgctggggcccgcccttccttgacgacggcagcaacgacgcggcctactacctctgcgccaatcgcaacaagcgctcggtcgccatcgatcttgccgatccgcagggcgccgcgctgatccgccgcttcgccgaaacggccgacatcgtggtcgagaacttccgcgtcggcggccttgcgaagtacgggctcgattatgcttcggtgaaagcgatccggccggacgtcatctactgttccatcaccggcttcggccagaccggaccgatgcgcaacaccggcggctacgatttcctgatccaggggatgagcggcctgatgagcgtgaccggcctgcccgatggcgagcccggaggcgggccgatgaaggtcggcctgccggtctgcgatctccagaccgggctctatgccacggtctcgatcctcgccgcgctcaaccaccgcaaccgcaccggcgaaggccagcacatcgacctcgccctgctcgacacgcaggtctcgctgcttgccaaccaggcgtcgaactggatgaacggcggcatggtgccgcgccgcttgggcaaccagcaccccaacaccgtgccctaccaggacttcgcctgcgcggacggcaatatcctcgtcgccatcggcaacgaccgccagttccgccagttcatggcgatgatcggccttggcgcccttgccgacgatccccgctttgcagcaagcggcgggcgcagcgtgaaccgcgatgccctgcttggcgtgatgcgcccggtcatcgcgcagtggaaggcggccgagcttatcgcggcgatgcaggcggcgggtctgcccggcggcaaggtcaacgagattcccgaagtgctcgagcatccccagatcgaggcgcgcggcctcgtccacgagatggagcggagcgacggcaccccggtcaaggtgctcggctttccggccaagctctcggccacccccgccacctaccgaaccgcaccgccccgctcgggcgaggatacacgcgcggttctgacgggcgtgctggggctggacgcagccgagatcgaacgcctgatggccgccggagtcatcgccgaaaggctttga

SEQ ID NO: 6736 - protein, 413 aa, Novosphingobium aromaticivorans DSM 12444
MTGEASPAGPLAGLRVLDLSRVLAGPWCTQILGDLGAEVIKVEQPGQGDDTRRWGPPFLDDGSNDAAYYLCANRNKRSVAIDLADPQGAALIRRFAETADIVVENFRVGGLAKYGLDYASVKAIRPDVIYCSITGFGQTGPMRNTGGYDFLIQGMSGLMSVTGLPDGEPGGGPMKVGLPVCDLQTGLYATVSILAALNHRNRTGEGQHIDLALLDTQVSLLANQASNWMNGGMVPRRLGNQHPNTVPYQDFACADGNILVAIGNDRQFRQFMAMIGLGALADDPRFAASGGRSVNRDALLGVMRPVIAQWKAAELIAAMQAAGLPGGKVNEIPEVLEHPQIEARGLVHEMERSDGTPVKVLGFPAKLSATPATYRTAPPRSGEDTRAVLTGVLGLDAAEIERLMAAGVIAERL

SEQ ID NO: 6737 - DNA, 1203 bp, Bradyrhizobium sp. ORS278
  CDS (1)..(1203): transl_table=11
atgacccctcaatttgctcccggcgccatggccggattgcgcgtgatcgatctcacgcgcgtgctcggcggcccctattgcacgcagatcctggccgatcacggcgccgacgtgatcaaggtcgagccgcccgccggcgacgaggtgcgcgactggggccctcccttccacgacgaggacgcggcctacttcgtcggcatcaaccgcaacaagcgctcgatcggcctcgacctcgcctccgagggcggccgggtcgtcttgttgaagatgctcgaaacggccgatgtgctgatcgagaacttcaagccgggcacgctggaaaaatgggggatcggcagcgacgtgctgcgcgagaaattcccaaagctcgtgcattgccgcatctgcggcttcggcgccgacggtccacgcggcggcaatcccggctatgatgcgatcatccaggcgatgaccggcatgatcgcggcgaccggttcgcccgagagcggcccgatgcggatcggcgtgccgctggtcgacatcaccacgggactctatgccgccattggcatcctgatggcgctgtcggagcggcaacgctcgggacaaggccagttcctcgaggtcaccctgtacgagaccggcctcgcgatcatgcatccgcataccgcgaactacttcatgcacggcaagccgccgtcactgaccggcaacgagcatccgaacctcgttccctacgcgatcttccccacgaagaccgacgacatcttcatcggcgtcggcaatgacggcaccttccgcaagctcgcgcgtgagatcggccgccccgagctcggcaccgatccgcgcttcgcccgcaacaaggaccgcgtcgccaatcgcgaggcgctgcgcgccgagctcgccgccgtgttcagccagttcgaggccgagccgctgtgcgatcggctgctcgccgccggcctgcccgcgggaccggtgcagaagatcgatcaggcgctgaccaacccgcacacgttccaccgcggcgatgtcatcgagaaggactggtacaagggcgtcgcttcgccgatccggctcgaacgcaccaagccgagcctgcgctcgacgccgccgaaattcagccagcacgcgcgcgatgtgctcggcgagttcggctactccgatagcgacatcgacgcgctggtcgcgcagggaaccgtctgcacggagcgcaagcgctga

SEQ ID NO: 6738 - protein, 400 aa, Bradyrhizobium sp. ORS278
MTPQFAPGAMAGLRVIDLTRVLGGPYCTQILADHGADVIKVEPPAGDEVRDWGPPFHDEDAAYFVGINRNKRSIGLDLASEGGRVVLLKMLETADVLIENFKPGTLEKWGIGSDVLREKFPKLVHCRICGFGADGPRGGNPGYDAIIQAMTGMIAATGSPESGPMRIGVPLVDITTGLYAAIGILMALSERQRSGQGQFLEVTLYETGLAIMHPHTANYFMHGKPPSLTGNEHPNLVPYAIFPTKTDDIFIGVGNDGTFRKLAREIGRPELGTDPRFARNKDRVANREALRAELAAVFSQFEAEPLCDRLLAAGLPAGPVQKIDQALTNPHTFHRGDVIEKDWYKGVASPIRLERTKPSLRSTPPKFSQHARDVLGEFGYSDSDIDALVAQGTVCTERKR

SEQ ID NO: 6739 - DNA, 1284 bp, Bradyrhizobium sp. ORS278
  CDS (1)..(1284): transl_table=11
atgcccattcaggtcgcgctacaggaccgcaacccgcgcccggctgatgcgccggcagctttggctggcctgctcgtgatcgatttcacgcgcgtggtggccgggccggcgtgtacgcaaaccttggcggacttcggtgccgaggtgatcaagatcgagcagccgatcaagggagatgacacgcgggcctacgagcatgccgagctcggtggcgaaagcgcagcttttctcagcctcaaccgcaacaagcaagggatggtgctggacctcacgactccggaagcgagaaatattgcgcgcgcgctcatcgccaaggccgatgtcgtcgtggagaatttttcgtcgcatgtcatggagaagcatggtctggactatccgacggtgtcgagcgccaatccgagcctgatctattgctcgatctcggcctatggacgcaccggtccgtttgcgtggcgatcgggtttcgatccgatcacccaggccgaaagcggtttcatgtcgctcaacggttttcccgatggtccaccagtgcggacaggtccccccatcgtcgacttcgctaccggcatgtcggcctgcaatgccatcctgctggcgcttgcggcacgacaacggctcggccgggggcagcacgtcgaggtggccttgttcgacacggctctggcgctgacaggcttttctggaatggcttatctgatgagcggcgtgaatcccacgcgcactggaaactcgccgaacgattcgccgacggtcggtgtgttcgaagcgtcggatggtccgctctatgtggcctgcgccaacgatcggctctaccatcggctggtcgccgaggtgctcgagcgcccggatctgctgagcgatccgcgcttcgcgacgaggaaagcacgctggagcaaccgcgcccaactgcgtggtatcctcgccgacatctttgcggccaagcagatggaggtgtggatctcgcggatgaacgatgccggggtccccgtcggccgcgtccgaacggtggcacaggccttcggcgcgccagaggtgcgagagcgcaaccggatctgtcgcatcccacacatgacggcaggtgccgtacccaatatcgagccagcgatcagcatgcagatgacgcccgccgtcacgccccgagcggcgccgcggctcggcgagcacacggctactgttctacgtgacaggctgggatactccgagcaggagatcgaagcgcttcgcgatcggggcgccttcggtccggacgccccggctatccaaggtcagccgactgacaaatag

SEQ ID NO: 6740 - protein, 427 aa, Bradyrhizobium sp. ORS278
MPIQVALQDRNPRPADAPAALAGLLVIDFTRVVAGPACTQTLADFGAEVIKIEQPIKGDDTRAYEHAELGGESAAFLSLNRNKQGMVLDLTTPEARNIARALIAKADVVVENFSSHVMEKHGLDYPTVSSANPSLIYCSISAYGRTGPFAWRSGFDPITQAESGFMSLNGFPDGPPVRTGPPIVDFATGMSACNAILLALAARQRLGRGQHVEVALFDTALALTGFSGMAYLMSGVNPTRTGNSPNDSPTVGVFEASDGPLYVACANDRLYHRLVAEVLERPDLLSDPRFATRKARWSNRAQLRGILADIFAAKQMEVWISRMNDAGVPVGRVRTVAQAFGAPEVRERNRICRIPHMTAGAVPNIEPAISMQMTPAVTPRAAPRLGEHTATVLRDRLGYSEQEIEALRDRGAFGPDAPAIQGQPTDK

SEQ ID NO: 6741 - DNA, 1176 bp, Xanthobacter autotrophicus Py2
  CDS (1)..(1176): transl_table=11
atgtcccctcccctcgccggccttcgcgtccttgaacttgcccgcatcctcgcaggtccctggtgcgggcagctgctcgccgatctcggcgccgaggtcatcaaggtggagcgccccggtggcggcgacgatacccgcacctggggcccgcccttcctgacgggggaggacggggccgatctcggcgccgcctatttccatgccaccaatcgcggcaagcgctcggtggcggtggatttcgagaccgcggagggacaggagaccatccgcgcgctggcccgccagagcgatgtggtcatcgagaatttcaaggtgggaggcctcaagaaatacggcctcgactacgcgagcctgaaggcggagaacccgcgcctcgtctattgctcggtcaccggcttcggccaggatggcccttatgcgccgcgcgccggctacgacttcctggtgcagggcatgggcggcatcatggacctcaccggcgcgccggagggcgagccgcagaaggtgggggtcgccttcgccgacatcttcaccggcctctatgccaccgtgggcatcctcgccgccctgcgccggcgggaggagaccggcaccggcggccatgtggacatggcgctgctcgacacccaggtgggcgtgctggccaaccaggccatgaactacctcacctccggcaaggcccccaggcgcatgggcaatgcccatcccaacatcgtgccctatcaggtcttcccctgcgcggacggctatttcatcgccgccgtgggcaatgacggccagttcgcccgtttctgtgccgtgctcggcgcgccggagctggcgcaggaggccgatttcggcaccaaccccgctcgcgtcgcccaccgcgccgcgctggtgccgcagctgtcagcgctgaccgccgccttcaggcgcgacgacctgctcgccgcgctggaggcgaagggggtgcctgccggccccatcaacacggtggcgcaggtgttcgacgatccgcaagtgaaggcccgcggcctgcgggtggacctgaaggaggccggcggcggcaccatcccggcggtggcgagccctatcgtgctcgacggcgagcggcaggtggccaaggccgccagcccgcgcctcggtgccgatacgcaggccgtgctggcggcgctcaaggcgctggcgaagggctga

SEQ ID NO: 6742 - protein, 391 aa, Xanthobacter autotrophicus Py2
MSPPLAGLRVLELARILAGPWCGQLLADLGAEVIKVERPGGGDDTRTWGPPFLTGEDGADLGAAYFHATNRGKRSVAVDFETAEGQETIRALARQSDVVIENFKVGGLKKYGLDYASLKAENPRLVYCSVTGFGQDGPYAPRAGYDFLVQGMGGIMDLTGAPEGEPQKVGVAFADIFTGLYATVGILAALRRREETGTGGHVDMALLDTQVGVLANQAMNYLTSGKAPRRMGNAHPNIVPYQVFPCADGYFIAAVGNDGQFARFCAVLGAPELAQEADFGTNPARVAHRAALVPQLSALTAAFRRDDLLAALEAKGVPAGPINTVAQVFDDPQVKARGLRVDLKEAGGGTIPAVASPIVLDGERQVAKAASPRLGADTQAVLAALKALAKG

SEQ ID NO: 6743 - DNA, 1218 bp, Acinetobacter sp. ADP1
  CDS (1)..(1218): transl_table=11
atgggtgctctagaaggatttcgtgtgcttgatttaagtcgagtgcttgcaggcccttggtgtggtcaggttttggccgatttaggcgcagaagtaattaaagtcgagcgccccaaacatggagatgatacccgtgcttggggcccaccatggatgaaggatgatgaaggtcgtgatactcatgaagctgcatactatcagtcgactaaccgtaataagctttcagttgcgattgatatttcaactccagaaggtcaggaaatcgtacgggcactcgcacttgaatcagatgttttaattgaaaattataaatcaggttcattaaaaaaatatggtctcgattatgaaacactgtcaaagctcaacccaaaacttgtttattgttcaattactggatttgggcaaactggaccacgtgcacaagagccaggctatgattttattattcagggtatggggggattaatgtctgtcactggtgaaaaagatgatttacctggcggtggcccacaaaaattaggaatcgcattttctgatatcgcaacagggttatattcgaccatcgcgattcaagcggccttacttaatcgtaatatcacgggtttgggtcaatatatcgatatggccttattagatgtacagattgcaacgctggcaaatcaaggaatgaattatctggcttcaggtaaagtacctggccgatatggtaatgctcatgccaatattgtgccttatcaggtgtttaaggcatcagaccgagatttcattattgcctgtggcaatgacacgcaatttattcagttgtgtcaggcaattggattgccagagcttcctaatgatcctaaatttaccagaaatgcagatcgtatcaagtatcgtgaagaaatcatccatctactttcaacgcattttttaactaaaacagccgatgaatgggttggaatcattcaagcagctaaagtcccagttggatgtattaataatcttgaacaagcctttgaagaaccacaagtcatagaaagaaaaatgttggtagatatgtcacatccacaacgtgagcatcttaaagtcattggttcgcctattaaaatgtcgcgtacacccgttgagtataaaaatgcacctccaatgcttggacagcataccgaagagatattatcaaatatactttctagagaaaggtttagtgagctgaaatcaaaaggaataataggataa

SEQ ID NO: 6744 - protein, 405 aa, Acinetobacter sp. ADP1
MGALEGFRVLDLSRVLAGPWCGQVLADLGAEVIKVERPKHGDDTRAWGPPWMKDDEGRDTHEAAYYQSTNRNKLSVAIDISTPEGQEIVRALALESDVLIENYKSGSLKKYGLDYETLSKLNPKLVYCSITGFGQTGPRAQEPGYDFIIQGMGGLMSVTGEKDDLPGGGPQKLGIAFSDIATGLYSTIAIQAALLNRNITGLGQYIDMALLDVQIATLANQGMNYLASGKVPGRYGNAHANIVPYQVFKASDRDFIIACGNDTQFIQLCQAIGLPELPNDPKFTRNADRIKYREEIIHLLSTHFLTKTADEWVGIIQAAKVPVGCINNLEQAFEEPQVIERKMLVDMSHPQREHLKVIGSPIKMSRTPVEYKNAPPMLGQHTEEILSNILSRERFSELKSKGIIG

SEQ ID NO: 6745 - DNA, 1224 bp, Acinetobacter sp. ADP1
  CDS (1)..(1224): transl_table=11
atgggtgccttaacaggatttagggttctggatttaagcaggattttagctggaccttggtgtagtcaggtattggcagacttgggcgcagaagtaattaagatagaaaagccattttatggtgatgatacacgcatttgggggcctccatttcttaaaaatgatgatggtaaggagacgactgaatctgcttattatttatcagcaaatcgtggtaaacattcggttgcaattgatatggcaacagaagaaggtcaggcactaatcagaaaaatggtgttagaaagtgatgttgtgatcgaaaactataaagcgggctcactcaagaaatatggtctggactatgaaagtttaagtcagatcaaccccaaactggtgtattgctcgattactggttttggacagaaaggcccacgtgcggctgaacttggctatgattttattattcaggggatgggcggtatgatgagtgtaacaggtgagcgagatgatttacctggcggagggcctcaaaaagcaggtttggcttttgcagatttgacgacaggtttatatgcagccattgccattcaggctgcattgttgtcacgagtaaccactggcgaaggccagcatatagatatggccttgttggatacacaggttgcatcactctcagttctggctatgaattatttaacatcgaccaaagtaccaggtcggtttggaaatgcgcatgccaatatcgtgccttatcaagtcttcaaggcaaaagaaggggaatttattattgcttgtggtaacgatcagcagtttcaggccttatgtgaaagtataggattgcctgaactgtgcaaaaactccaaatttactaaaaataaagatcgggtcacgcatcgagaagagatcagtcatatcttacaacaacactttatgacagagattgcccagctatgggttgatcgtattcataaagttaaggtgcctgtgggtatgattaataatttacagcagaccttggaggaagagcaggtggttttccgtgagatggtaattcatatgcagcatccgttgcgttctgattatatttcgattggatcgccgatcaaactatccaaaacacctgtcgagtatctaaaagcacccccttatttgggtgaagatactgatcagattttaaatcgatttttatctgataaagaattacatgatttaaaagatagaaaagtgattcaacaaggttga

SEQ ID NO: 6746 - protein, 407 aa, Acinetobacter sp. ADP1
MGALTGFRVLDLSRILAGPWCSQVLADLGAEVIKIEKPFYGDDTRIWGPPFLKNDDGKETTESAYYLSANRGKHSVAIDMATEEGQALIRKMVLESDVVIENYKAGSLKKYGLDYESLSQINPKLVYCSITGFGQKGPRAAELGYDFIIQGMGGMMSVTGERDDLPGGGPQKAGLAFADLTTGLYAAIAIQAALLSRVTTGEGQHIDMALLDTQVASLSVLAMNYLTSTKVPGRFGNAHANIVPYQVFKAKEGEFIIACGNDQQFQALCESIGLPELCKNSKFTKNKDRVTHREEISHILQQHFMTEIAQLWVDRIHKVKVPVGMINNLQQTLEEEQVVFREMVIHMQHPLRSDYISIGSPIKLSKTPVEYLKAPPYLGEDTDQILNRFLSDKELHDLKDRKVIQQG

SEQ ID NO: 6747 - DNA, 1167 bp, Propionibacterium acnes KPA171202
  CDS (1)..(1167): transl_table=11
atgtccaaaggtgtgctcgagggagtcaaagttctcgatctctcgcgtgtcctggcaggcccgtactgcggtgctttccttgcagatctaggtgctgatgtggtcaaagtcgaggcaccgaatggtgatgacgcgcgtcatttgggacctttcaagggcgaggagagcgtatacttcgctgaattgaaccatggtaaacggagcgtcgtcctgaatttcaaagatcccaaggaccatgagcgtttcatgaagctcgttgagcatgcagacgtcgtgttagaaaactttcgacctggagtcacgaagcgtttgggagtggatgcggaaagtgtacataaaaccaatccgcgaataatatacgccagcatttcgggtttcggtcaagaggggccgttccgaaatcgtcccgcgtatgatctcattgtacaggcgatgagcggaatcatggctgccacgggtcctgaaggaggaaagccgacacgcgttggtgaatcactgggtgacgtcgtttcagggattttcgccggatgggcgatttgtgcagcactgtatgagcgtgagcgtactggggtcggtcgtactgtcgacgtttcaatgttcaattctttgcttgcgttgcaggtgactaatctgagtctccttcttgccgatggaaaattgccgggacgaatcggaaatcgtcatccggtttcggttccattcgacacctaccctgctaaggacggactggttgccttggcagtggcaaacgatcgaatttgggcacgcttggccgacctcatgggaaggccggaccttggtgccaacgatgcctatctcggtgatatgaaccgcgcgaataaacgacaagagctcacgcagttggtgtccggatggacgcagacgatgaccgttgccgaactgttgcggaagaccgaggaagcaggtgtccctgctgcacccatctgggatctcaaagaggcgcttgaaagtgagcatgtggttgcgcgccattcgctcggtcacttcacacacccggagctcggaaagatgccgtacctacgatttccggcggacttcgggtgcggcaatctggaggtgtcctcggagtcgtcgccgcgtttgggtgaacagacagcaggagccgtcgccgctgaatggggccgatcggcgaatgacgacaaatga

SEQ ID NO: 6748 - protein, 388 aa, Propionibacterium acnes KPA171202
MSKGVLEGVKVLDLSRVLAGPYCGAFLADLGADVVKVEAPNGDDARHLGPFKGEESVYFAELNHGKRSVVLNFKDPKDHERFMKLVEHADVVLENFRPGVTKRLGVDAESVHKTNPRIIYASISGFGQEGPFRNRPAYDLIVQAMSGIMAATGPEGGKPTRVGESLGDVVSGIFAGWAICAALYERERTGVGRTVDVSMFNSLLALQVTNLSLLLADGKLPGRIGNRHPVSVPFDTYPAKDGLVALAVANDRIWARLADLMGRPDLGANDAYLGDMNRANKRQELTQLVSGWTQTMTVAELLRKTEEAGVPAAPIWDLKEALESEHVVARHSLGHFTHPELGKMPYLRFPADFGCGNLEVSSESSPRLGEQTAGAVAAEWGRSANDDK

SEQ ID NO: 6749 - DNA, 1176 bp, Symbiobacterium thermophilum IAM 14863
  CDS (1)..(1176): transl_table=11
atgctggacctctcccgggtgttggcgggcccctactgcgcccagatgctgggcgacgccggggcggacgtgatcaaggtggagtcaccggccggggacgacacccgggcctggggaccgccctttctggctggctgcgaaccgcagcccggccgtccgggcgacagcgcctattatgtgtcgtgcaaccggaacaagcgggggatcgtgctggacctgaccaccccgcacgggcaggaggcgctctgccggctggtcgcccgggcggacgtgctcatcgagaacttcaagcccggcaccatggagcgctggggcctggggtacgaagacgtgctgcgcccgctgaatccccggctggtctacgcgagcatttcaggttacggccggacggggccggacgccgacctgccgggctacgacttcgtggcacaggccgtcggcgggatcatgtccatcaccggcgagccggagggcgacccgatgaaggtgggcgtggccgtcaccgacctgaccaccgggatgatggccgccttcgccatctgcgccgccctgatcgcccggcaggcgaccggccgggggcagcgggtggacctctcgctgctggagacccaggtggcctggctggccaacgtgggccagtcctacctggtgagcggccagccgccccggcgctggggcaacgcccacgcgtcgatcgtcccgtacgaactcttccacgccgccgaccggcccatcgtcgtcggcgtgggcaacgatgcgcagtttgcgcgcttttgcgctgtgttgggccggccggagtgggcggcggacgagcggttcgccaccaacccggcaaggctgcggcaccggcgggaactggtggggctcatcgcccgggagctgcgcacccgtccggcggccgaatggcttgcggccatgcgggcagccggcgtcccctccgggcccgtgcgcaccatccccgaggtcttcgccgacccgcaggtgctggcccgggggatgaaggtggaatgcaaccatccggtggccgggttgatctccctcatcggcatcccgttcaagttcagcgacacgccggcgactgtccgccgccctccgccccggtggggggagcacacggcggaggtgctggccgagatcgggtacagcgcggaggagatcaagcagttcctcatgtag

SEQ ID NO: 6750 - protein, 391 aa, Symbiobacterium thermophilum IAM 14863
MLDLSRVLAGPYCAQMLGDAGADVIKVESPAGDDTRAWGPPFLAGCEPQPGRPGDSAYYVSCNRNKRGIVLDLTTPHGQEALCRLVARADVLIENFKPGTMERWGLGYEDVLRPLNPRLVYASISGYGRTGPDADLPGYDFVAQAVGGIMSITGEPEGDPMKVGVAVTDLTTGMMAAFAICAALIARQATGRGQRVDLSLLETQVAWLANVGQSYLVSGQPPRRWGNAHASIVPYELFHAADRPIVVGVGNDAQFARFCAVLGRPEWAADERFATNPARLRHRRELVGLIARELRTRPAAEWLAAMRAAGVPSGPVRTIPEVFADPQVLARGMKVECNHPVAGLISLIGIPFKFSDTPATVRRPPPRWGEHTAEVLAEIGYSAEEIKQFLM

SEQ ID NO: 6751 - DNA, 1734 bp, Burkholderia mallei ATCC 23344
  CDS (1)..(1734): transl_table=11
atgccgcggggccgcggcgcgccggaggggccgacacattcgcttggagaagcgccgtgcgccgtgcgccgcgcgcgacacgtcggctcggcggtgcacgccgcatcgcgcaaacgcaggcgagccgtgagcgaggagcggcgcttgccgggcggcggatgcgttgggtgcgttgggtgcgttgggtgcgtcgggtgcgtcgggtgcgtcgggtgcgtcgggtgcgtcgggtgcgtcgggtgcgtcgggtgcgtcgggtgcggcgggcgcggcgggtgcggcgggtgcggcgggtgcggcgggtgcggcgggtgcggcgggtgcggaaagcgcgcccggcggccgcgcgcggctgcgtcggaccgtcgccgttccgaccgctcgcgcgacaaccgcgcacgaatcgctttaagatgcggcgggagacgattcaccgaacacgcgcccgcgcggacgcgccgcgaacggcgcgcccacccgaaaagcgcaaccaacagaggagacagatcgaagatgggagccctcagccacatccgcgtcctggacctgagccgcgtgctcgcgggcccgtggtgcgcgcagacgcttgccgatctcggcgccgacgtgatcaaggtcgagcgcccggagtgcggcgacgacacccggcactggggcccgccgtacctgaagacgccggacggcgccgacacccgcgaagccgcgtactacctcgccgcgaaccgcaacaagcgctcggtgacggtcgatatcgcgacgcccgagggccagcggatcatccgcgagctcgccgcgcaatgcgacgtcgtgctcgagaactacaaggtcggccagctcgcgaaatacgggctcgactacgcgtcgctcgcggccgtgaagcccggcctcgtctattgctcggtgacgggcttcggccagacgggcccgtacgcgcaccgcgccggctacgacttcatcatccaggggatgggcggcttcatgagcatcaccggcgagcgcgacggcctgccgggcggcggcccgcagaaggcgggcgtcgcgatcgccgatctcgcgacgggcctgtactcgacgatcgcgatcctcgccgcgctcgcgcaccgcgaccgcacgggcgaaggccagcacatcgacatggcgctcctcgacgtgcaggtggcgctcctcgcgaacatgaacacgaacttcctcgcgagcggcaagccgcccgtgcgctggggcaacgcacatccgaacatcgtgccgtaccagacgttcgagacgagcgacggctggatcatcgtcgcggtcggcaacgacggccagttccgcaagttcgtcgaggcgggcgggcgccccgagctcgccgacgacgagcgcttcgcgacgaaccccgcgcgcgtgcgccaccgcgacacgctcgtgccgatcgtcgccgcgatgacgaagacgcgcacgaagcgcgagtggctcgacgcgctcgaggcgctcggcgtgccgtgcggaccgatcaacgacctcgccgaagtgttcgacgacgaacaggtgcgcgcgcgcggcatgcaggtcgatttgccgcatccgagcggcgcgagcgcgaaactcgtgcgcaatccgatccgaatgagcgcgacgccgcccgacgcgcgcagcgcgccgccgctgctcggcgagcacacggacgcggtgctgcgcgacctgctgggttacggcgacgcggcgatcgccgcgctcagggacaagcgcgtcgtctga

SEQ ID NO: 6752 - protein, 577 aa, Burkholderia mallei ATCC 23344
MPRGRGAPEGPTHSLGEAPCAVRRARHVGSAVHAASRKRRRAVSEERRLPGGGCVGCVGCVGCVGCVGCVGCVGCVGCVGCVGCVGCGGRGGCGGCGGCGGCGGCGGCGKRARRPRAAASDRRRSDRSRDNRARIALRCGGRRFTEHAPARTRRERRAHPKSATNRGDRSKMGALSHIRVLDLSRVLAGPWCAQTLADLGADVIKVERPECGDDTRHWGPPYLKTPDGADTREAAYYLAANRNKRSVTVDIATPEGQRIIRELAAQCDVVLENYKVGQLAKYGLDYASLAAVKPGLVYCSVTGFGQTGPYAHRAGYDFIIQGMGGFMSITGERDGLPGGGPQKAGVAIADLATGLYSTIAILAALAHRDRTGEGQHIDMALLDVQVALLANMNTNFLASGKPPVRWGNAHPNIVPYQTFETSDGWIIVAVGNDGQFRKFVEAGGRPELADDERFATNPARVRHRDTLVPIVAAMTKTRTKREWLDALEALGVPCGPINDLAEVFDDEQVRARGMQVDLPHPSGASAKLVRNPIRMSATPPDARSAPPLLGEHTDAVLRDLLGYGDAAIAALRDKRVV

SEQ ID NO: 6753 - DNA, 1221 bp, Burkholderia pseudomallei K96243
  CDS (1)..(1221): transl_table=11
atgggagccctcagccacatccgcgtcctggacctgagccgcgtgctcgcgggcccgtggtgcgcgcagacgcttgccgatctcggcgccgacgtgatcaaggtcgagcgcccggagtgcggcgacgacacccggcactggggcccgccgtacctgaagacgccggacggcgccgacacccgcgaagccgcgtactacctcgccgcgaaccgcaacaagcgctcggtgacggtcgatatcgcgacgcccgagggccagcggatcatccgcgagctcgccgcgcaatgcgacgtcgtgctcgagaactacaaggtcggccagctcgcgaaatacgggctcgactacgcgtcgctcgcggccgtgaagcccggcctcgtctattgctcggtgacgggcttcggccagacgggcccgtacgcgcaccgcgccggctacgacttcatcatccaggggatgggcggcttcatgagcatcaccggcgagcgcgacggcctgccgggcggcggcccgcagaaggcgggcgtcgcgatcgccgatctcgcgacgggcctgtactcgacgatcgcgatcctcgccgcgctcgcgcaccgcgaccgcacgggcgaaggccagcacatcgacatggcgctcctcgacgtgcaggtggcgctcctcgcgaacatgaacacgaacttcctcgcgagcggcaagccgcccgtgcgctggggcaacgcacatccgaacatcgtgccgtaccagacgttcgagacgagcgacggctggatcatcgtcgcggtcggcaacgacggccagttccgcaagttcgtcgaggcgggcgggcgccccgagctcgccgacgacgagcgcttcgcgacgaaccccgcgcgcgtgcgccaccgcgacacgctcgtgccgatcgtcgccgcgatgacgaagacgcgcacgaagcgcgagtggctcgacgcgctcgacccgctcggcgtgccgtgcggaccgatcaacgacctcgccgaagtgttcgacgacgagcaggtgcgcgcgcgcggcatgcaggtcgatttgccgcatccgagcggcgcgagcgcgaagctcgtgcgcaatccgatccggatgagcgcgacgccgcccgacgcgcgcagcgcgccgccgctgctcggcgagcacacggacgcggtgctgcgcgacatgctgggttacggcgacgcggcgatcgccgcgctcagggacaagcgcgtcgtctga

SEQ ID NO: 6754 - protein, 406 aa, Burkholderia pseudomallei K96243
MGALSHIRVLDLSRVLAGPWCAQTLADLGADVIKVERPECGDDTRHWGPPYLKTPDGADTREAAYYLAANRNKRSVTVDIATPEGQRIIRELAAQCDVVLENYKVGQLAKYGLDYASLAAVKPGLVYCSVTGFGQTGPYAHRAGYDFIIQGMGGFMSITGERDGLPGGGPQKAGVAIADLATGLYSTIAILAALAHRDRTGEGQHIDMALLDVQVALLANMNTNFLASGKPPVRWGNAHPNIVPYQTFETSDGWIIVAVGNDGQFRKFVEAGGRPELADDERFATNPARVRHRDTLVPIVAAMTKTRTKREWLDALDPLGVPCGPINDLAEVFDDEQVRARGMQVDLPHPSGASAKLVRNPIRMSATPPDARSAPPLLGEHTDAVLRDMLGYGDAAIAALRDKRVV

SEQ ID NO: 6755 - DNA, 1383 bp, Burkholderia pseudomallei K96243
  CDS (1)..(1383): transl_table=11
atgccgccgggaacggcgatcgccgacgcgacggccacggcgtccgatgcgcgcacggcgttcgccgcaaataccaaagacgccaaagacgccaaagacgccaaagacgccaaagacgccaaagacgccaaagacaccacatcccgcccgtccctcgccgccgcgaatcatgcaaccgggcctgtccgccctggcgcgctcgccggcctgaaaatcatcgacctgagccgcgtcctcggcggcccgtactgcacgcaggcgctcgcggaccacggcgcgcgcgtgatcaagatcgagccgccggcgggcgacgaaacgcgcggctggggcccgccgttcctcgacgacgacgcgtggtatttcaccggcgtgaatcgcaacaaggaagggatcgtgctcgacttgtcgcgcgacgaaggccgcgcgatcctctggcgtctgctcgaagacgcggacgtgcttgtcgaaaacttcaagcccggcacgctcgcgcgctgggggatggactacgagcgggacttgcggccgcgctttgcgcgcctcgtccattgcgcgatcacgggtttcggcgccgacggcccgctcggcgggctgcccggctacgatgcggtgatccaggcgatggcgggcctcatgagcgtgaatggcgatgccggtggcgacgcgacgcgcatcggcctgccgatcgtcgacatggtgacgggcctgaacgcgctcgccggcatcctgctcgcgctcgccgagcgcgagagaagcggcgtgggccagtcgatcgacatcgcgctgtacgactgcggcgtgtcgctgctgcatccgcacctgccgaactggttcggctcggggcgcacccccgcgcgcagcggcaacgcgcatccgaacatcgcaccgtacgacagctaccgcaccgcgagcgcgccgatctttctcgcgattggcaacgaccggcagttcgcgcggctttgcgcacaccttggcgtgcccgcgctcgcgagcgatccgcgttttatcgacaaccgcagccgctgcgcgcatcgcgccgagctgaaggcgagcctcgagacgcggctcgccggccgcgatggcgagacgctcgcgcgcgagctgatggccgagggcgtgccgtgcgggccggtgcgcacgatcgatgcgctcgcgtgcgatccgcacacgctgcatcgcgggctcgtcgtcgagatggggcgataccgcggcgcggcgtcgccgatcaagctctcgcgcacgcccgcgacgtaccgcaccgcgccgcccacgctcggccgcgatacgcgcgcggtgctcgacgcgctcggcatcgatgcggcgacgcaggcgcggctcgccgacgcgggcgtgctcaaggaggcgaaaccaatggcgacgtga

SEQ ID NO: 6756 - protein, 460 aa, Burkholderia pseudomallei K96243
MPPGTAIADATATASDARTAFAANTKDAKDAKDAKDAKDAKDAKDTTSRPSLAAANHATGPVRPGALAGLKIIDLSRVLGGPYCTQALADHGARVIKIEPPAGDETRGWGPPFLDDDAWYFTGVNRNKEGIVLDLSRDEGRAILWRLLEDADVLVENFKPGTLARWGMDYERDLRPRFARLVHCAITGFGADGPLGGLPGYDAVIQAMAGLMSVNGDAGGDATRIGLPIVDMVTGLNALAGILLALAERERSGVGQSIDIALYDCGVSLLHPHLPNWFGSGRTPARSGNAHPNIAPYDSYRTASAPIFLAIGNDRQFARLCAHLGVPALASDPRFIDNRSRCAHRAELKASLETRLAGRDGETLARELMAEGVPCGPVRTIDALACDPHTLHRGLVVEMGRYRGAASPIKLSRTPATYRTAPPTLGRDTRAVLDALGIDAATQARLADAGVLKEAKPMAT

SEQ ID NO: 6757 - DNA, 1224 bp, Azoarcus sp. EbN1
  CDS (1)..(1224): transl_table=11
atgtcgggcgccctgtcgcatatccgggtgctcgacctgtcgaggattctggccggcccgtgggccggccagatcctcgccgacctcggcgccgacgtcatcaaggtcgagcgtccgggcgaaggcgacgacacccgccactggggtccgccgttcctcaaggacacccacggccacgacaccgacgttgccgcgtatttcctctgcgcgaatcgcaacaagcgctcgatcacggtagacatgacgaagccggacggacggcaactgctgcgcgacctcgccggcaaatgcgacgtcgtgctggagaatttcaagcagggcgggctcgcgcgccacggcctcgactacgcgtcgctgaaaaccgtcaatccgcgcctcgtgtattgctcgatcaccggtttcggccaggatggaccgtacgcggcacgcgccggctacgacttcctgatccagggcctcggcggcctgatgagcctgaccggacggcccggcgacgagccgggcggcggcccgatgaaagtcggcgtcgcgctgaccgacatcctgacgggcctgtacgcggccaacgcggtgcaggcggcactcgccgcgcgcgacaggaccggcgaaggccagcacatcgatctcgcgctgctcgacgtgcagatcgcgtgcctcgcgaaccaggcgatgaattacctcaccaccggcgtgtcaccgggccggctcggcaacgcccatcccaacatcgtgccgtaccaggacttcccgaccgacgacggctacatgatcctcgcgatcggcaacgacgcgcagttcgcacgcttttgtgaagcggccggtgacccctcgctcgcgaccgacgcccgattcgccaccaacaaggctcgcgtcggccaccgcgcagtgctgatcccgctgctcaacaagctgacgatccggcgcacgacgaccgactggatcgcgcggctcgaagcgctcggcgtgccgtgcggaccgatcaacacgctcgccgacgtgttcgccgacccgcaagtacgcgcgcgcggactgcgcatcgacctgccgcacccgctcgccggccgcgtgccgcaggtcgccagtccgatgcgcctgtcggcgaccccggtcgaataccgtctcccgccgccccttctcggcgaacataccgacgaaattctcgcctcgctgctgggcttgccggccgaacgcatcgcccgcctgaggcatgacgaagtaatctga

SEQ ID NO: 6758 - protein, 407 aa, Azoarcus sp. EbN1
MSGALSHIRVLDLSRILAGPWAGQILADLGADVIKVERPGEGDDTRHWGPPFLKDTHGHDTDVAAYFLCANRNKRSITVDMTKPDGRQLLRDLAGKCDVVLENFKQGGLARHGLDYASLKTVNPRLVYCSITGFGQDGPYAARAGYDFLIQGLGGLMSLTGRPGDEPGGGPMKVGVALTDILTGLYAANAVQAALAARDRTGEGQHIDLALLDVQIACLANQAMNYLTTGVSPGRLGNAHPNIVPYQDFPTDDGYMILAIGNDAQFARFCEAAGDPSLATDARFATNKARVGHRAVLIPLLNKLTIRRTTTDWIARLEALGVPCGPINTLADVFADPQVRARGLRIDLPHPLAGRVPQVASPMRLSATPVEYRLPPPLLGEHTDEILASLLGLPAERIARLRHDEVI

SEQ ID NO: 6759 - DNA, 1227 bp, Azoarcus sp. EbN1
  CDS (1)..(1227): transl_table=11
atgaccaaattttccacgactggcgggctgaagggcttgcgggttctcgacctggggcacgcgctggccgcgccgttctgcacgcagatgctcgccgaccacggcgcggacgtgatcaagatcgagccgcccggaggggacgtgtcgcgccgcatcggcccgttcaccgaggacgacacgacgcgcgaatacggcgggctgtaccagtgctgcaatcgcaacaagcgcggcatggtgctggacctgaaaagcacggaaggacgcgaggcgttcctcaagatggtcgagcaggccgactgcgtggtcgagaacttccgcgccggtgtcatggaccggctcggtctgagctacgagaccctggccgatcacaacccgcgcatcgtctatacgtcgatccgcggtttcggcgatccgcgcggtggcaagactgcctataccgattggccggcggtggacatcatcgcccaggcgatggggggcctgatgagcattaccggccccgatgcggattgcccgaccaaggtgggtggcggccctggcgacacaataccggggctgttcggcgcgttctccaccatggtcgcgctgtgggaggcgcgcgcctcgggcaagggacagtacgtcgatgtgtcgatggtcgacagcctgatcgcgctcaacgagacggtcaccgtcacctatacgtatacgggtgaggtgccgcgccccacgggcagccgcctgccgcagatcgcccccttcggccgcatctcgaccaaggacggctgggccgtgattgccgtgccgccgggtcgcaactggccggtgttctgcgaggtgatcggacgtcccgaactgatcgacgatccgcatttctgcaacgaacaggcgcggctcgccaacttcgatgcggtctatgaggtcgtcgagtccttcacccgcgaacacacccgcgccgaactgctgcagatcttcggtggcaaagtgccgtttgcccccgtctatgactcggcggacattttccaggatccgtacttccagatccgcgagatgctgccgcaggtcgagcagccgggctccaaacacaaggtgaccgtacccggcgtgccggcgaagctcacgcgcacgccgggcggcgtgttccagcgcgcaccgctcctcggcgaacacaccgacgacatccttgacggtttcggcttcagcgcggaagcgattgccacgctgcgcaaatcaggcgcggttgcctga

SEQ ID NO: 6760 - protein, 408 aa, Azoarcus sp. EbN1
MTKFSTTGGLKGLRVLDLGHALAAPFCTQMLADHGADVIKIEPPGGDVSRRIGPFTEDDTTREYGGLYQCCNRNKRGMVLDLKSTEGREAFLKMVEQADCVVENFRAGVMDRLGLSYETLADHNPRIVYTSIRGFGDPRGGKTAYTDWPAVDIIAQAMGGLMSITGPDADCPTKVGGGPGDTIPGLFGAFSTMVALWEARASGKGQYVDVSMVDSLIALNETVTVTYTYTGEVPRPTGSRLPQIAPFGRISTKDGWAVIAVPPGRNWPVFCEVIGRPELIDDPHFCNEQARLANFDAVYEVVESFTREHTRAELLQIFGGKVPFAPVYDSADIFQDPYFQIREMLPQVEQPGSKHKVTVPGVPAKLTRTPGGVFQRAPLLGEHTDDILDGFGFSAEAIATLRKSGAVA

SEQ ID NO: 6761 - DNA, 1113 bp, Silicibacter pomeroyi DSS-3
  CDS (1)..(1113): transl_table=11
atgagcgcaccgttgcaagggctgaaagtggtcgaactggcccgcattctggcagggccctggatcggccagaccctggccgatctgggcgccgaggtgctcaaggtcgaaagccccgagggcgacgacacccgcaaatggggcccgccctttatcgagcgcgagggcgaccgctcggctgcctatttccacggcgccaaccggggcaagacctcgatcgcgctggatttcggcgatgcgggcgaccgggccaaactgctggacctgatccgcgaggcggatgtgctgatcgagaatttcaaggtcggcgggctgaagaaattcggcctcgattatgacagcgtcaaagaggtcaacccgcgccttgtctattgctcggtcaccggctttggacaggacggcccctatgcccatcgcgccggatacgatttcctgatccaggggatgagcggcatcatggacctgaccggcgatccggcgggcgagccgcaaaagatcggcgtggcctttgccgatatctttaccgggctttacggcgtcatcggcattcaggcggcgctggcggaacgcgcgcggtcgggtatgggccagcatgtggatctcagcctgctcgattgcatgaccggggtgctggccaaccaggcgatgaacttccttgcctcggggcaatgcccgacacgtctgggcaatgcccatcccaatatcgtgccctatcaggtgtttccggtggccgatggccatatcatcatcgcctgcggcaatgaccggcaatatggcacgctctgcaccattcttggtgtggccgagctgatcaatgacccacgctttgccaccaatcccgaccgggtcgcgcaccgggccgagatgaccgagttactgacgacggcctgcctgaaatggaccaaggcggatctgctggccgcgctggagcagggcggcgtgccgggcgggccgatcaactcggtggccgaggcgctggccgacccgcagatcgcccatcgcggcatgcggatcgagcccgagggcgtgccgggcctgcgcacgccgatccggttttctcgctcggagctggtgctggacaaggcctcgccgaaacggccggtcagatcatga

SEQ ID NO: 6762 - protein, 370 aa, Silicibacter pomeroyi DSS-3
MSAPLQGLKVVELARILAGPWIGQTLADLGAEVLKVESPEGDDTRKWGPPFIEREGDRSAAYFHGANRGKTSIALDFGDAGDRAKLLDLIREADVLIENFKVGGLKKFGLDYDSVKEVNPRLVYCSVTGFGQDGPYAHRAGYDFLIQGMSGIMDLTGDPAGEPQKIGVAFADIFTGLYGVIGIQAALAERARSGMGQHVDLSLLDCMTGVLANQAMNFLASGQCPTRLGNAHPNIVPYQVFPVADGHIIIACGNDRQYGTLCTILGVAELINDPRFATNPDRVAHRAEMTELLTTACLKWTKADLLAALEQGGVPGGPINSVAEALADPQIAHRGMRIEPEGVPGLRTPIRFSRSELVLDKASPKRPVRS

SEQ ID NO: 6763 - DNA, 1158 bp, Silicibacter pomeroyi DSS-3
  CDS (1)..(1158): transl_table=11
atgcccggccctcttagcggaacccttgtcctggacctgacccatgtcctggcgggaccatttgccagcatgactctggccgatctgggcgcccgtgtgatcaaggtcgagcgccccggacagggcgatgacacccgcgccttccccccgttcaagggcggcaaaagtgcctatttcgccaccatcaaccatggcaaggaaagcatcgcgctggacctcaaggcgcccgaggaccgggccattttcgagaggctgctggcgcgggccgatatcctgctggaaaactaccgccccggcgtgatggagcgtctgggctatggctgggaggcgctgcatgcccgctttcccaagctgatctatggcgccgtctcgggctttggccataccggccccgaggcgcagcgccccgcttatgacatggtggtacaggcgcgcggcggggtgatgtcgatcaccggcgagcgcgaccgcgagccggtgcgcgtcggcgcctcgatcggcgatatcgtggcgggcatgtatctggtgcagggggtgatggccgccctgttgcaggtggaacgcggcggcaccgggcaaaaggtcgatgtggcgatgctcgacagtcagctggcgctgttggaacatgccatcgccatcaccagcgtcaccggcgagccgccgcgcccctcgggcgcgcggcacccctcgatcaccccgttcgaaacctttcacgccgaggacgggctgttcgtcatcgccgccggcaatgacggcctgttcgcccggctctgcgacgcattggagctgccgctggcggaggatccgcgctttgccaccaacccggcccgctgccagaacgcgcggcttttgaaacggctgatcgaggcggtgaccctcgaccggcccaaggcgcattggatcgagacactgacccgcgcgggcgtgcctaccggcccgatccagaacgtggccgaggtgttgcaggacccgcagatccgcgcccgcaacatggtggtcgacgtgctgggccccgatggcgcaccggcctataccgccgccggcaacccgatcaagatgtccgatctgcccgatcccacgacgcgtgccccggccccggatctggatgcggaccgcgcggcgattctggactggctcgacgagggcgcggccgactga

SEQ ID NO: 6764 - protein, 385 aa, Silicibacter pomeroyi DSS-3
MPGPLSGTLVLDLTHVLAGPFASMTLADLGARVIKVERPGQGDDTRAFPPFKGGKSAYFATINHGKESIALDLKAPEDRAIFERLLARADILLENYRPGVMERLGYGWEALHARFPKLIYGAVSGFGHTGPEAQRPAYDMVVQARGGVMSITGERDREPVRVGASIGDIVAGMYLVQGVMAALLQVERGGTGQKVDVAMLDSQLALLEHAIAITSVTGEPPRPSGARHPSITPFETFHAEDGLFVIAAGNDGLFARLCDALELPLAEDPRFATNPARCQNARLLKRLIEAVTLDRPKAHWIETLTRAGVPTGPIQNVAEVLQDPQIRARNMVVDVLGPDGAPAYTAAGNPIKMSDLPDPTTRAPAPDLDADRAAILDWLDEGAAD

SEQ ID NO: 6765 - DNA, 2112 bp, Silicibacter pomeroyi DSS-3
  CDS (1)..(2112): transl_table=11
atgagcagcaccctcctcaaggggatacgcgtgctggatctcagccgcatgttgtccggcccctattgcagcatgttcctggccgatcacggcgccgaggtcatcaagatcgaaggcggcagcggcgacaccagccgcaacaacggcccctatcgcgccgatgatcccggccatgactgggcgggctatttcgtcagcctgaaccggggcaagaaaagcatccggctggacctgaaatcgctcgagggcaaggccgcctttcgcaggctggcgacgacggcggatgtggtgctggagaacttccggcccggcgtgatggaccgtctcgacctctcttatgaatctctcgccgaggccaatccccggctggtctatgccgccattcgcggctttggcgatccgcgcaccggggccagcccctatgccgactggccgtcctatgacgtggtggcgcaggcaatgggcgggctgatggcgatgaccggccccgatgccgatacgcccaccaaggtcggccccggcatcggcgatatctttgccggcatgatgatgtcctttggcattctcgccgccctgcgcgaggccgaggcgaccggcaagggccgtttcgtcgacgtcgccatgtatgacgcgatgatctcgatgtgcgagcgcatggtctatctgcacgacatgaccgggcaggtgccgggccccgagggcaacggccacccgctgctggccccctttggtgtgttccccgccgccgatggtcaggtggcgctgggtattgtcgatgacagtttctggcagaagctgaccgcgatcatgaacctgcccgacctgggcagcgatgcgcggttctcctcccgcgccgggcggtccgccaatgcgggcgagatcaaccgggtcgtctcgggctggaccgccacccgcagcaaggcagaactgaccgcgctgctgggcggtcaggtgccctttggcccgctcaacacggtggccgatatcgccgccgatccccatgttgcggcgcggcagatgctggcgcgcatcccccatcccgaacccggacatgccccctggaccgtggccgccaacccgctgcgctttgccggacaggtggcgcccccgctgcccgccccgccccggctgggcgagcatgacgcgctgctcgacacgctggcagacagcgcgccgctggacgaggatgcaaggcgcgacctgcgccgtgccttcgggcagttcgccaccggggtgaccgtgctgaccacccggcaagaggatggaacaccccgcggctttaccgccaattcgttcacctcggtctctctcgacccgccgctgctgctggtctgcctcgccaagacggcgcacagctgcgatgtctttgcccaggcgccacatttcgcggtcaacatcctgtcggacgcacagaaagagatttcgggcctcttcgcctcacgctcgaccgagaagttcgccggcacccattggcatccgggcccgcatgaactgccgctgatcaaccgggcgctggcgacatttgcctgtgcgcggcacaagctggtcgatgcaggcgatcacctgatcctgatcgggcgcgtgctgaaccacgcggtgaccgagggcaaaccgcttgggttccacaacggcgcctatttcgacctcgggctggagaaccggctggccgacgcggcaaccaaggacgcaaacgggatcatcgccgccgtcctggccgatggcgcgcggatcctgctggaagtgacacccgacggcacgctgacggtgcccaaggcgcccccgcgcgacaacacggttgccgggttcctgcggcacatggacagccgtggcctgacggcccgcctcgaccacctttatgccgtgttccagaacagccagaccggcgcgcattcgatcgtctatcacggcacggtcagcggcaccgcgccacccggcatgcgctatcacgatctggccgcgctgccgctggatcaggtcgccaacgacaccgaacgctcgctgctggcacgctatcagcgcgaataccgccatggcagtttcgggatttaccacggcaccgaacgcagcggcatcgtccattcgatcgccgatcacaccgaatacaccgtttga

SEQ ID NO: 6766 - protein, 703 aa, Silicibacter pomeroyi DSS-3
MSSTLLKGIRVLDLSRMLSGPYCSMFLADHGAEVIKIEGGSGDTSRNNGPYRADDPGHDWAGYFVSLNRGKKSIRLDLKSLEGKAAFRRLATTADVVLENFRPGVMDRLDLSYESLAEANPRLVYAAIRGFGDPRTGASPYADWPSYDVVAQAMGGLMAMTGPDADTPTKVGPGIGDIFAGMMMSFGILAALREAEATGKGRFVDVAMYDAMISMCERMVYLHDMTGQVPGPEGNGHPLLAPFGVFPAADGQVALGIVDDSFWQKLTAIMNLPDLGSDARFSSRAGRSANAGEINRVVSGWTATRSKAELTALLGGQVPFGPLNTVADIAADPHVAARQMLARIPHPEPGHAPWTVAANPLRFAGQVAPPLPAPPRLGEHDALLDTLADSAPLDEDARRDLRRAFGQFATGVTVLTTRQEDGTPRGFTANSFTSVSLDPPLLLVCLAKTAHSCDVFAQAPHFAVNILSDAQKEISGLFASRSTEKFAGTHWHPGPHELPLINRALATFACARHKLVDAGDHLILIGRVLNHAVTEGKPLGFHNGAYFDLGLENRLADAATKDANGIIAAVLADGARILLEVTPDGTLTVPKAPPRDNTVAGFLRHMDSRGLTARLDHLYAVFQNSQTGAHSIVYHGTVSGTAPPGMRYHDLAALPLDQVANDTERSLLARYQREYRHGSFGIYHGTERSGIVHSIADHTEYTV

SEQ ID NO: 6767 - DNA, 1194 bp, Silicibacter pomeroyi DSS-3
  CDS (1)..(1194): transl_table=11
atggccggatctgaacaacccaaagggccgctcgacggggtgcgcgtgctggacctcagccgcattctggcggggccgacctgcacccagctcttgggcgatctgggcgccaatgtgatcaagatcgagaaccccggttcgggcggcgacgacacccgccaatgggggccgccctatgtcactgacgccgaaggcaaccccagcgatctgagcgcctatttcatggccgccaaccgcaacaagaaatcggtgacgctggatatctcgacgcccgaggggcaggcacagatccggcgtctggcggcacatgccgatatcctgatcgagaatttcaaacccggcgggctggccaaatacgggctggactatgccagcatcggccccgagttccccagccttgtctattgctcgatctcaggctttggccagaccggccccaatgcctcgaaaccgggctatgaccttatggcccaagggtttggcggtgtaatgtccctgaccggagagcccgagggcgcgcccatgaaggtgggcgtgggcatcgccgacgtgatgtgtggcatgtatgcgaccgtgggcatccttgccgcgctgcatcaccgcgagcgcaccggcgagggtcagcatatcgatctggcgctggtcgatgcgcaggtggcctggatgatcaacgaaggcgtgaactatctgaccagcggcgccctgccccaacggcgcggcaatgctcaccccaacatcgtgccctatgacctttatgccacctcggacgggcatgtggtgctggcggtgggcaatgacagccagttccgccgggtctgcgagtttctcgaccttgccgcgctggccgacaatccgcgctttgccaccaaccaggcgcggctgcagaaccgcgccacgctggatgcgctgctgcgcccagcgctggcggcgcgcagcaaggccgaggtgatcgcggggcttgaggcgcgcaaggtgacggtggggccggtgcagaccatcgatcaggtctttgccagcgaccaggtcgcggcccgccagatgcagatcgacatggaatcacaggccggtccggtgcatctgatcggcaacccgctgaaactgtcgcgcaccccggtaacctaccgcagggcgccgccgcgctgtggtcaggacaccgaaaccgtactttcctcggacgatcccttcgcggactga

SEQ ID NO: 6768 - protein, 397 aa, Silicibacter pomeroyi DSS-3
MAGSEQPKGPLDGVRVLDLSRILAGPTCTQLLGDLGANVIKIENPGSGGDDTRQWGPPYVTDAEGNPSDLSAYFMAANRNKKSVTLDISTPEGQAQIRRLAAHADILIENFKPGGLAKYGLDYASIGPEFPSLVYCSISGFGQTGPNASKPGYDLMAQGFGGVMSLTGEPEGAPMKVGVGIADVMCGMYATVGILAALHHRERTGEGQHIDLALVDAQVAWMINEGVNYLTSGALPQRRGNAHPNIVPYDLYATSDGHVVLAVGNDSQFRRVCEFLDLAALADNPRFATNQARLQNRATLDALLRPALAARSKAEVIAGLEARKVTVGPVQTIDQVFASDQVAARQMQIDMESQAGPVHLIGNPLKLSRTPVTYRRAPPRCGQDTETVLSSDDPFAD

SEQ ID NO: 6769 - DNA, 1221 bp, Pseudomonas fluorescens Pf-5
  CDS (1)..(1221): transl_table=11
atgggcgcgttatcgcatctgcgggtactggatttatcgcgggtactggccgggccttggtccgggcagatccttgcggacctgggggccgaggtcatcaaggtcgagcgtccgggtaatggtgacgatacacgcgcctgggggccgcccttccttaaagatgcctatggcgagaacaccacggaggctgcctattacctgtcggccaaccgtaacaagcagtcagtgaccatcgacttcacgcgccctgaggggcagcagttggtgcgtgagctggctgccaagtcggatatcgtcatcgagaacttcaaggtaggtgggctggcggcttacggtctggactatgagtcgctcaaggccgttaatccgcggctgatctattgctctatcaccggttttggtcagaccgggccctatgccaagcgcgcgggttatgacttcatgatccagggcttgggtggtctgatgagcctgactgggcgacctgagggtgatgagggggctgggccggtaaaagtgggggtggccttgaccgacatccttaccgggctctactccactgtggcgattctggcggctttggctcatcgagatcagggtggcggtggtcagcacatcgatatggcattgctggatgtccaggtcgcttgcctggccaaccaggccatgaactatctgaccacaggggtcgctcccaagcgtttgggtaatgcgcaccctaatatagtgccctatcaggattttccgacggcggatggcgacttcatccttaccgtgggtaatgacgggcagtttcgcaagtttgccgaggtagcgggtcagccgcagtgggcggacgatcctcggtttgccactaacaagctgcgggtggccaatcgggcggtgctgattccgctgattcgccaggccacggtgttcaagactacggcggagtgggtgagccagctggagctggctggggtgccttgtgggccgatcaatgatctggcgcaggtgtttgctgatccacaggtcgtggctcgaggcctggctgtggagctaccacacgcgttggctgggatggtgcctcaggtggctagcccgattcgtctttcgcaaacccccgttgagtaccgtaacgcccctcctctattgggcgaacatactgcagaggttctgcagcgtgtcttggggatgcgggtcgaggctgtggacgccttgaggcattcgcgagtggtgtag

SEQ ID NO: 6770 - protein, 406 aa, Pseudomonas fluorescens Pf-5
MGALSHLRVLDLSRVLAGPWSGQILADLGAEVIKVERPGNGDDTRAWGPPFLKDAYGENTTEAAYYLSANRNKQSVTIDFTRPEGQQLVRELAAKSDIVIENFKVGGLAAYGLDYESLKAVNPRLIYCSITGFGQTGPYAKRAGYDFMIQGLGGLMSLTGRPEGDEGAGPVKVGVALTDILTGLYSTVAILAALAHRDQGGGGQHIDMALLDVQVACLANQAMNYLTTGVAPKRLGNAHPNIVPYQDFPTADGDFILTVGNDGQFRKFAEVAGQPQWADDPRFATNKLRVANRAVLIPLIRQATVFKTTAEWVSQLELAGVPCGPINDLAQVFADPQVVARGLAVELPHALAGMVPQVASPIRLSQTPVEYRNAPPLLGEHTAEVLQRVLGMRVEAVDALRHSRVV

SEQ ID NO: 6771 - DNA, 1188 bp, Pseudomonas fluorescens Pf-5
  CDS (1)..(1188): transl_table=11
atgacgtttgcccaaggcgccctggcgggcgtgaaaatcatcgatctcagccgtgtgctgggcggcccctactgttcccaggccctggccgaccacggcgccgaggtgatcaagctggaacctttgagcggcgatgagacccggggctgggggccgcctttcgaaggtgatgacgcggcgtattttcgcggcatcaaccgtaacaagcaggggatcgccgtcgacctgtcgcgccccgaaggcctggccctgctgatgcagttgctggaaggcgccgacgtgctgatcgagaacttcaagccgggcaccctgcagcgttggggcatcggttaccaggaggtgctgagccagcgttttccggcgttgatccactgcgggatttccggctttggcgccgatggcccgctgggcgggctaccgggttacgacgcggtgatccaggccatggccgggctgatgagcgtcaacggcgaaggcgacggcgggccgttgcgcatcggcctgccgattgtcgatatggtcaccggcctgaatgccctggcggggattctcctggccctcaacgagcgccagcgcagcggcctcgggcagtcactggacatctccctgtacgactgcggcgtgtccctgctgcacccgcacctgccgaactacttcgccgccggccagacgcccaaacgcacgggcaacgcccatcccaacattgctccctacgacagctaccgcaccgctggcgagccgattttcctggcggtgggcaacgaccgccagttcacccggctgtgccaggaactgggggccggcgcgttgttggaggacccgcgctttaccgacaacggccagcgctcggtcaaccgcgaggctttgaagcagcaactggagcattacctgtcggcacacgacggcgcgttgctggccccgcggctgatcggcctgggggtgccttgtggttcgatcgccaccgtcgaccaggtggtggctcatccccacacccggcatcgcgggctgctggtggaactcgatggctaccggggcataggttcgccggtgaagttgtcgcgcacgccggccagctaccgtacggcgccgccgagcctggggcaggacacccgggcggtattgcaggggctgggcctggatgaatcgaccatcgccgcactgctggccagcggcgtggtgcacggttga

SEQ ID NO: 6772 - protein, 395 aa, Pseudomonas fluorescens Pf-5
MTFAQGALAGVKIIDLSRVLGGPYCSQALADHGAEVIKLEPLSGDETRGWGPPFEGDDAAYFRGINRNKQGIAVDLSRPEGLALLMQLLEGADVLIENFKPGTLQRWGIGYQEVLSQRFPALIHCGISGFGADGPLGGLPGYDAVIQAMAGLMSVNGEGDGGPLRIGLPIVDMVTGLNALAGILLALNERQRSGLGQSLDISLYDCGVSLLHPHLPNYFAAGQTPKRTGNAHPNIAPYDSYRTAGEPIFLAVGNDRQFTRLCQELGAGALLEDPRFTDNGQRSVNREALKQQLEHYLSAHDGALLAPRLIGLGVPCGSIATVDQVVAHPHTRHRGLLVELDGYRGIGSPVKLSRTPASYRTAPPSLGQDTRAVLQGLGLDESTIAALLASGVVHG

SEQ ID NO: 6773 - DNA, 1272 bp, Psychrobacter arcticus 273-4
  CDS (1)..(1272): transl_table=11
atgactgtcaccacaacgacacaaaggcctgagcaagcaaatgttattgacaatgctactgcaaatatcgtgactgatgctgtcgcaaaaggcgcattacacgggattaaggtgctggatttgtctcgggtattggccggtccttcttgcactcaggtactcgccgaccttggtgccgacgttatcaaagttgagcgtccacatatcggtgatgagacgcgtcattgggcgccgccaaaattcagcgatgacacatccgcttattacgccaccattaatcgcaataaaaaatccctcaccgtagatatcacgacgcctgctggacaaaccatcattaagcagctcgctgaaacaagcgatattgtggtagaaaactttaaagttggcggtctgaaaaaatacggtttggactatgagagtttaaagcaaagcaatccacgtctgatttatgcctcgttaactggctttgggcaaacaggtcccgatgctgcgcttccgggctatgactatatcattcaaggcttatctgggctgatgagcatcaccggacctactgatggcgaaccacataaagttggcgtggcagtggtagatttatttgcaggcttgcagctgaccataggtattcaagcggcgttaatagcgcgtcagcataccggacttggtcaacatgtcgatgtcgcgctactagacagtgcgctggcaatgctcgccaatgtcggtatgaatcacttggcatctggcgaggtgccaccaagactgggcaatggtcaccctaatattgttccctatcaagtgtttgccggtgcaggggaggagcatttcattttagcctgcggtaatgacgggcaatttgctaggttatgccagatgctatcagtagcgtggtataccgacagtcgttttgcgaccaatccagcacgggtagcccatcgtgagctaatttgtgagtggctcataaaagcatttgccgagcatccacgtgcatattggcttacgcgcttgcatgaggcgggtattccttgtggtcctattcataatattgcagaagccttggctatgccgcaagtgctggcgcgcgagatgattgttagttttgccgaacaaggcagtccggttaaagcacttggcagccccattaaactctcaggctcgcctgttacgtatcgcacaccaccgccacgcttgagcgagcatactgatagcacgcttactgatttaggctatgacagtgagatgatcgccaagctgaaagctgatggaattgtttga

SEQ ID NO: 6774 - protein, 423 aa, Psychrobacter arcticus 273-4
MTVTTTTQRPEQANVIDNATANIVTDAVAKGALHGIKVLDLSRVLAGPSCTQVLADLGADVIKVERPHIGDETRHWAPPKFSDDTSAYYATINRNKKSLTVDITTPAGQTIIKQLAETSDIVVENFKVGGLKKYGLDYESLKQSNPRLIYASLTGFGQTGPDAALPGYDYIIQGLSGLMSITGPTDGEPHKVGVAVVDLFAGLQLTIGIQAALIARQHTGLGQHVDVALLDSALAMLANVGMNHLASGEVPPRLGNGHPNIVPYQVFAGAGEEHFILACGNDGQFARLCQMLSVAWYTDSRFATNPARVAHRELICEWLIKAFAEHPRAYWLTRLHEAGIPCGPIHNIAEALAMPQVLAREMIVSFAEQGSPVKALGSPIKLSGSPVTYRTPPPRLSEHTDSTLTDLGYDSEMIAKLKADGIV

SEQ ID NO: 6775 - DNA, 1269 bp, Colwellia psychrerythraea 34H
  CDS (1)..(1269): transl_table=11
atgaatcaagtaagtgaagcagatgaaaaaccaggccctttgtctggcgttaccgtattggatttctctcgagtgttggcagggccttattgcacaatggtcttggcagatcttggcgcacgggtaattaaaattgaacgatttggcactggtgatgatacgcgtgcgtttgggcctttcgtgggcgttgattcagcttatttcatgtgtttcaatcgcggtaaagaaagtatttctcttgatattaaatcaccacgcgaccgtgaactactagagcgcttgttggatagttgtgatgtggtggtagagaactttcgacctggagtgatggaacgccttggttacgggcctgaacgtcttgaaaaaacgcatccccatattatttatacgtctatttcaggttttggtcacagcggtccatttagtgaattgccaggctacgatatggtggtacaggccatgggcggggtgatgagtttgaccggctggccagatgaagagcccgctcgcgttggcaccagctttggtgacttaggtgcggcactctttggtgtgattggtatcttgtctgcactctatagtcgaacacgtgatgcgcaaggaacgcgagtggatatagggatgctagattgccaagcggcgttaatggaaactgcactagcaagatatgacgtggaggggattgtgccaacacgtacaggtgacaatcatccatcgcttgcaccctttgaaacctttgccgcacaggatggaaagttcgtgatctgtgccggtaatgatacgttatttttgctaatgatggacgctttgggctcgcctcagttggccttagaagcgcaatttctaaccaacgatttacgtgtgcaaaaccgtaaacaactggttaaagatgtcgaggcaataacactcaacgagccaatgcagcattggattgatgccctcaatgaagctggagtaccttgctccccgataaataccattgataaattatttactcatccacaacttctagcccgcaacatgatcgttaaagtgaaaggggaaaacgagagagcaatccgaacagccggtaacccaataaagatgagctcagtagcagaaattgatcccgaggtaccgctcaagtccccagcgcttaacgagcatcgcgaggcaatattagcagaattgatggccaaaaacggtgcgtatgcgccgacaccccaaccccaagaaaattcggatgatagtaagctagagacatattccgaagctatttctcaaatttaa

SEQ ID NO: 6776 - protein, 422 aa, Colwellia psychrerythraea 34H
MNQVSEADEKPGPLSGVTVLDFSRVLAGPYCTMVLADLGARVIKIERFGTGDDTRAFGPFVGVDSAYFMCFNRGKESISLDIKSPRDRELLERLLDSCDVVVENFRPGVMERLGYGPERLEKTHPHIIYTSISGFGHSGPFSELPGYDMVVQAMGGVMSLTGWPDEEPARVGTSFGDLGAALFGVIGILSALYSRTRDAQGTRVDIGMLDCQAALMETALARYDVEGIVPTRTGDNHPSLAPFETFAAQDGKFVICAGNDTLFLLMMDALGSPQLALEAQFLTNDLRVQNRKQLVKDVEAITLNEPMQHWIDALNEAGVPCSPINTIDKLFTHPQLLARNMIVKVKGENERAIRTAGNPIKMSSVAEIDPEVPLKSPALNEHREAILAELMAKNGAYAPTPQPQENSDDSKLETYSEAISQI

SEQ ID NO: 6777 - DNA, 1173 bp, Colwellia psychrerythraea 34H
  CDS (1)..(1173): transl_table=11
atggcaggcccactcaccggaatcaaagtactcgatcttagccgaattttagcaggcccttgggctacacaagtattggctgattatggtgccgaagtgtggaagatagaacgacctgaaaagggagatgatactcgccactggggtcctccatatgtgaaagatgagcagggtgaggatactgctgaatcagcatattaccttgccgctaatcgagggaaaaagtcgattgaagtagatatgacaagtgctgatggacaagcagcaatatataaattagtagcacaagcagatattgtcgttgaaaattataaggttggcggacttaaaaaatacggcttagattatgagagcattaaaaaaattcgtaaagatgttatctattgctcaatcactggctttggccaagatggcccgtatgcgaatagagcgggttacgatgccatgattcaagcgatgggtggattgatgagcatcactggagaaaaagattcgttacccggtggtggaccacaaaaagtaggggtagcaacaacggacttaatgacaggtatgtatgcggtgtcgggtattttagctgccttatatcatcgaactcaaacgaacgaaggtcaacagatagatattgcactattagatacgcaagttgcctgcttagcgaatcaaggcagtagttatttagtgagtggtgatgtaccacaaagattagggtcggctcacccaaatattgttccatatcaagccatgaaagtacaagatggttatatcctgttagccgttggcaatgatgatcaatttcaaaaatgctgtaatgtactgggttgcatagaggttggtgagaatatgcagtttacaaccaatgcattacgcgtaaagcatcgtgaaacacttatccccttactggagtcttactttatcaaacaaaagttagattattggttagcagcactttcagaagtacatgtaccttgtggtcccattaattcaattgaccgtgtgtttgaaaatccacaaattaaacatcgtaaaatggcctttgagctagatcatcctaccgcaggtaaagtgcctcaggtcggcaatccggtaagattttcacaaacgccaattacttatcacgctgctccacccacactgggacagcacactgatgaaatattaaaatcaaagtaa

SEQ ID NO: 6778 - protein, 390 aa, Colwellia psychrerythraea 34H
MAGPLTGIKVLDLSRILAGPWATQVLADYGAEVWKIERPEKGDDTRHWGPPYVKDEQGEDTAESAYYLAANRGKKSIEVDMTSADGQAAIYKLVAQADIVVENYKVGGLKKYGLDYESIKKIRKDVIYCSITGFGQDGPYANRAGYDAMIQAMGGLMSITGEKDSLPGGGPQKVGVATTDLMTGMYAVSGILAALYHRTQTNEGQQIDIALLDTQVACLANQGSSYLVSGDVPQRLGSAHPNIVPYQAMKVQDGYILLAVGNDDQFQKCCNVLGCIEVGENMQFTTNALRVKHRETLIPLLESYFIKQKLDYWLAALSEVHVPCGPINSIDRVFENPQIKHRKMAFELDHPTAGKVPQVGNPVRFSQTPITYHAAPPTLGQHTDEILKSK

SEQ ID NO: 6779 - DNA, 1236 bp, Thermobifida fusca YX
  CDS (1)..(1236): transl_table=11
atgaccgcaccgcctgccccgtcctccgccccgctttccgggatgctcgtcgccgacctgtcccgggtactcgccgggccctacgccacgatgctgctggccgacctgggcgcggacgtggtcaaagtggagcatcccgagcgcggggacgacacccgcgcatggggcccgccgtgggcgggcgaccagtccgcctactatctcgcgctcaaccggggcaagcggagcctggccgtcgacctcaaagacccggacgggctggccgcggtgcggaccctgtgtgcgcgggccgacgtggtcgtgcagaacttccggcctggcacggccgaacggctgggcctggggtatgccgacgtggccgccgacaaccccggggtggtctactgctcgatcagcgggttcggtcccgggcacctccgccccgaccgtcccgggttcgacgtggtcatccaaggtgagagcggtctgatgagcaccacgggcacgccggagggcgggcccaccaagatcgggatcccgctcgcggatgtgctcaccggcctcaacgccaccaccgcggtctgcgcggccctggtgcggcgcgccactacggggcgcggggagcacatccacgtctcgctgctcaactcggcgctctccgcgctcgtccaagtaggccagtctgcgctggtcaccggggcagaaccggagcgggtcgggcacgcgcacccgtctatcgtcccctaccagacgtttcccactgctgacggcgacatcatcatcgccgccggcaacgacgcgctctaccgcgccctgtgcacggtcgtggagcgccccgacctcgccgaggatccgcggttccgccgcaacgcggaccgggtcgcgcaccgggacatcctcgtggcggagctcaccgccgctttggcgaagcgcagcgccgaggagtggaccgcgctgttgagcgacgccggggtgcccgtggggaaggtgcgcggggtggctgaagcgctccgcaccgccgacgcctccggggatgaggcgaccatgaccgtcgaccaccccgtgctgggcgcagtggagctgatccgccccgggttccgcttcaccggcgcagccccgcagcacggtcctgccgtgctgcctcccccgctgctggggcagcactcggtggaagtcctccgcgagctcggcttgtcggaggagcgcatcaccgccctggtggagcgcggcactgtcgtccagcaccccgtccactga

SEQ ID NO: 6780 - protein, 411 aa, Thermobifida fusca YX
MTAPPAPSSAPLSGMLVADLSRVLAGPYATMLLADLGADVVKVEHPERGDDTRAWGPPWAGDQSAYYLALNRGKRSLAVDLKDPDGLAAVRTLCARADVVVQNFRPGTAERLGLGYADVAADNPGVVYCSISGFGPGHLRPDRPGFDVVIQGESGLMSTTGTPEGGPTKIGIPLADVLTGLNATTAVCAALVRRATTGRGEHIHVSLLNSALSALVQVGQSALVTGAEPERVGHAHPSIVPYQTFPTADGDIIIAAGNDALYRALCTVVERPDLAEDPRFRRNADRVAHRDILVAELTAALAKRSAEEWTALLSDAGVPVGKVRGVAEALRTADASGDEATMTVDHPVLGAVELIRPGFRFTGAAPQHGPAVLPPPLLGQHSVEVLRELGLSEERITALVERGTVVQHPVH

SEQ ID NO: 6781 - DNA, 1161 bp, Ralstonia eutropha JMP134
  CDS (1)..(1161): transl_table=11
atgacaaaggaatgtggccaattgccactggcgggaatcaccgtggttgacctgacgcgggtgcttgcgggcccgtactgtacgatgatgcttgccgacctcggggctcgggttatcaagattgagaacccggacggcggcgatgactcgcgccaggtgggcccgtttgtcgatggtgaatcagcctacttcgcatcgatcaaccgcaacaaggaatcgatcgcgctggacctcaagaaccctgccgaccgcaaggtactcgaccgcatgctcgccaccgccgacgtgctggtggagaacttccgtgctggcgtcatggaaaagctgggcttcacgtgggaggacctgcacgcccgctatccgcgcctcgtgtatgcatctatctccggcttcggccagactggaccgtatcgcaaccgcccggcctatgacatggtggtccaggccatgggggggctaatgagcgtgacgggggaggtgggcggcaacccggcacgcgtcggggtttcgattggcgatatcggggcgggtctgtacgcaaccatcggcatccagtccgcactgctcaagcgcctgcatactggcctgggcgagcgcgtcgacatttccatgctggattgtcaggttgcgctgctggagaatccgatcgcgcgctactcggcgaccgggagcgtaccaaagccgctcggtacccgccatccttcgatcacaccgttcgacatgttcgccaccaaagacggctttattgtcatcgcagttggcaatgatgccttgttcaccaagctctgcaacgccctcggtcgcagcgaatgggcacaggagacaagattcgctacggtgccgtcgcgcaatgaacaccatgtcgcgctcaaggcttgcctggagtcgcggctggctgatgccaccacgtcagagtgggaaacggtcctcgaagccgccggtgtcccgcatggcccgatgaacagcgttccgcaactggtcagtaacccgcacgtccaggcgcgcgggatgattctcgacatcggcattggcgacggcaaggcgctgcaaatcgcgggcaaccccgtcaagatcggtgctgcatcggtgctgtcaggggtccgcaatcccccggcgctggatcaggatcgggaacggttgctagcggagttcgccggctga

SEQ ID NO: 6782 - protein, 386 aa, Ralstonia eutropha JMP134
MTKECGQLPLAGITVVDLTRVLAGPYCTMMLADLGARVIKIENPDGGDDSRQVGPFVDGESAYFASINRNKESIALDLKNPADRKVLDRMLATADVLVENFRAGVMEKLGFTWEDLHARYPRLVYASISGFGQTGPYRNRPAYDMVVQAMGGLMSVTGEVGGNPARVGVSIGDIGAGLYATIGIQSALLKRLHTGLGERVDISMLDCQVALLENPIARYSATGSVPKPLGTRHPSITPFDMFATKDGFIVIAVGNDALFTKLCNALGRSEWAQETRFATVPSRNEHHVALKACLESRLADATTSEWETVLEAAGVPHGPMNSVPQLVSNPHVQARGMILDIGIGDGKALQIAGNPVKIGAASVLSGVRNPPALDQDRERLLAEFAG

SEQ ID NO: 6783 - DNA, 1221 bp, Ralstonia eutropha JMP134
  CDS (1)..(1221): transl_table=11
atgaccccatcgaaaagtttgcgtgggccgctggccggtttgcgcgtcgttgaactcgctcacgtcatggccgggccggtcggagggctgctgctcgccgacatgggtgccgacgtcgtaaaggtcgaaaagctgcccggaggcgacgatacgcgacgcacgacgccgccagagattgaaggtgaatcggcctcgtacatgatcctcaatcgcaacaaacgcgggatcgccgtcgatttgaaaagcgagcgcggtcgggaacttgtgagccgcctcgttgctcaggcggatatcgttgtggagaactaccggcccggcaccatggagaagctggggttgggctatgacgtgctgggccggcttaatcctggcttggtctactgcaagatcactggcttcggactgactggtccttatgcgcagcgcgctggttatgacctgatctcgcaaggcatgtctggcctgatgggactaaccggagagggaccgggccgtcccccggtcaaggtcggcgttcctgtgggcgacgtcactgccggcattctggctgccaccggcgtgctggctgcctacatcgagcggttgcgtaccggacaggggcaatacgttgatacatcactgctcgaagcctcgctggtgcatacatactggcccgtggcattggcgttcgctaccggaaaggcggcagggccaatgggatccgcgcatccggtcgcggcgccgtatcaggcttttcccaccgcagatggatggctgaacattggtgcaatgagccaggctacctgggcgggcgtttgcgaagtcctcggtatgagttggatgcttacagatgaacgctttgccacaaatggcgcgcgcatggccaaccgtggcgcgttggtgacccaaatgagcgaagtcctggtcacgcgctcgacggatgcgtgggtgacggcgttcgagcgtgcgggggtacctgcgggtccggtcaagaacatggtgcaggtgctggaggatccgcagacgcgtgcgcgagacatggtgatcaaggtggagcatccggtggcgggccagatagaggcgctgggttgccccatcaagttctcgcatggcaatggcgtgacgcgtcgcggtgcgccactttatggccagcacacagccgaggtcatggccgaacttggatactcggatagcgagattgcggagctagcgcatggcgccgtcgttcacgtcgctagataa

SEQ ID NO: 6784 - protein, 406 aa, Ralstonia eutropha JMP134
MTPSKSLRGPLAGLRVVELAHVMAGPVGGLLLADMGADVVKVEKLPGGDDTRRTTPPEIEGESASYMILNRNKRGIAVDLKSERGRELVSRLVAQADIVVENYRPGTMEKLGLGYDVLGRLNPGLVYCKITGFGLTGPYAQRAGYDLISQGMSGLMGLTGEGPGRPPVKVGVPVGDVTAGILAATGVLAAYIERLRTGQGQYVDTSLLEASLVHTYWPVALAFATGKAAGPMGSAHPVAAPYQAFPTADGWLNIGAMSQATWAGVCEVLGMSWMLTDERFATNGARMANRGALVTQMSEVLVTRSTDAWVTAFERAGVPAGPVKNMVQVLEDPQTRARDMVIKVEHPVAGQIEALGCPIKFSHGNGVTRRGAPLYGQHTAEVMAELGYSDSEIAELAHGAVVHVAR

SEQ ID NO: 6785 - DNA, 1200 bp, Ralstonia eutropha JMP134
  CDS (1)..(1200): transl_table=11
atggaaccgaaagacaaaggcccgttggccggcatccgcgtgatcgacatcggcacgatggttgccggtcccgtcgctgcaaccctgctggcagacctcggtgctgacgtgatcaagatcgagcagccgggtcgtggggactctctgcgccatattgggccggcggtgcaaggcgagagcctttggtggaacgtcgaagggcgcaacaagaaatccgtgacgctcgatctgcaccatcccgaaggccagcggattctgaaggagatgttgaagcacaccgatgtgctcgtggagaacttccgccccggcatcctgggcaagtggaacctctcgtgggagcatctgaagcaagtcaacccaaggctcgtgatgcttagcgtgtccggctatggccagaccggcccgtacgcgaatcgggcgggttacgaccgcatcgccctggcgatgggcggcacgctgaacgccacgggctatccggaccgcgctccggtcaagctgggcacggccatggccgactactcgacggcgttgtttggcgcgttcggaatcatggtggcgctctaccaccgggatacgcgcggcggcgaaggtcagcagatcgatctgtcgttgtacgagacggtgttccgctttacagacgtgatggtcacagcttacgacaagatgggactgccacgcgagcgcacgggcaacctgcacttcgcggcagccccgggcgaccatttcgaaacctgcgatggacgctacatcgtcctgaccgtgtccaacgaccgcatgttcggccggctgtgcgaagccattccagccctcggcggtgaagagcgctattcgacccacgcgaaacgcacggcgtgcgtcgaagagctcaacgtcatcgttgctgcatggatcaagtcgctgccggtgctggaggtctgccgcatcctggaagagaagggcctcgcatactcgttgatctactcgatcaaggatatcgtcgcagacccgcactacgaggcccggggcaccatcgccagcgtcgagcatccgcagatcggcgagctgaaaatgccggccgtgcaaccgcggttcagcgggacaccttccccgcagatcaagccagcgcccgccctgggcgcggacaccgacgagatcctgcgccaactggtagggctctcggcggggaggattgccgagctgcgccaggcgggcacggtctga

SEQ ID NO: 6786 - protein, 399 aa, Ralstonia eutropha JMP134
MEPKDKGPLAGIRVIDIGTMVAGPVAATLLADLGADVIKIEQPGRGDSLRHIGPAVQGESLWWNVEGRNKKSVTLDLHHPEGQRILKEMLKHTDVLVENFRPGILGKWNLSWEHLKQVNPRLVMLSVSGYGQTGPYANRAGYDRIALAMGGTLNATGYPDRAPVKLGTAMADYSTALFGAFGIMVALYHRDTRGGEGQQIDLSLYETVFRFTDVMVTAYDKMGLPRERTGNLHFAAAPGDHFETCDGRYIVLTVSNDRMFGRLCEAIPALGGEERYSTHAKRTACVEELNVIVAAWIKSLPVLEVCRILEEKGLAYSLIYSIKDIVADPHYEARGTIASVEHPQIGELKMPAVQPRFSGTPSPQIKPAPALGADTDEILRQLVGLSAGRIAELRQAGTV

SEQ ID NO: 6787 - DNA, 1179 bp, Ralstonia eutropha JMP134
  CDS (1)..(1179): transl_table=11
atggaaaatgcgacgctcggccccctggccggtgtaaggattgttgaactgacggcgatgatcaccgggccgcttgcaggaacgctgctggcggatctcggcgcggaagtcatcaaggtggagccacaggagggggaccccttccggacgttccgagggggcagctacagtccgtacttctgcacttacaaccgcaataagaagagcttggtgctcaacctcaagggagagcacgggaaggaagccttcttggggttgatcaagaacgcggatgtacttatcgtcaatttccggtcgggcgtgatggatcggttgggacttggcgcagaccagttgcgcgacgtcaatccgaagttgatcgtctgctcgatcacaggttttggcgagtccggcccgtatgccgatcgcccagcctacgacgccgtcgggcaagcactgagtggcatctcgagcttgttcttgggccaggatgcgcagatcacgggcccgtcgatcgcggataacctgacgggtatgtacgcaagctacgccatcctcggcgcgttgtacgagcggcagcgtaccggagcggggaaggatatccagctgaatatgctggagtccacgatcgccttcattagcgatccctttgcgaactatttgatggcaggcgtaaagccggatccgttgatgcgagtgcgcgcctctcagtcctacgcactccgttgcagcgacgaatcactgatcgccgtccatatgtcttcgccacagaagttctggcttggtcttctcgccgcgctcgatcgcaatgatctcgcgtcggacccacgcttcagcgaacgggcagggcggctggaaaactatgaagcgctggcagtggagcttaacaagacgtcgcgtacgcaatcgcgcgatttctggcttgcccggttggtggagcatgacgtacctcacgcccccgtactgacactgccagaggtgcttgtggacccgcaagtcactcacctcgacacgtttgtagacatcgaacaccccaagcacggcccgcaaaaggtcgtgcgtcgcccagtgcgttacaacggaaagcgcgatgaccagccgctaaacgcggccccggatctgggcgagcattccacggagattctccgctcgatcggcctcagcgacgcggaagttgctgccgtgctgaatggcgaatga

SEQ ID NO: 6788 - protein, 392 aa, Ralstonia eutropha JMP134
MENATLGPLAGVRIVELTAMITGPLAGTLLADLGAEVIKVEPQEGDPFRTFRGGSYSPYFCTYNRNKKSLVLNLKGEHGKEAFLGLIKNADVLIVNFRSGVMDRLGLGADQLRDVNPKLIVCSITGFGESGPYADRPAYDAVGQALSGISSLFLGQDAQITGPSIADNLTGMYASYAILGALYERQRTGAGKDIQLNMLESTIAFISDPFANYLMAGVKPDPLMRVRASQSYALRCSDESLIAVHMSSPQKFWLGLLAALDRNDLASDPRFSERAGRLENYEALAVELNKTSRTQSRDFWLARLVEHDVPHAPVLTLPEVLVDPQVTHLDTFVDIEHPKHGPQKVVRRPVRYNGKRDDQPLNAAPDLGEHSTEILRSIGLSDAEVAAVLNGE

SEQ ID NO: 6789 - DNA, 1302 bp, Ralstonia eutropha JMP134
  CDS (1)..(1302): transl_table=11
atgcagcgtgtccgcgccagcccatccgcaggcttcggcatccccctttacaccctctgcaaacggagccccctcgctgccatgggagccttaagccatctccgcgttctcgacctgacccgcgtccttgccgggccttggtgtgcccagaaccttgccgatttcggcgccgatgtcatcaagatcgaacgccccggcgccggggatgacacccgtacctggggaccgccgtggctcaaggccaccgacggcagcgataccgcagaagccgcctactacctggcagcgaaccgcaacaagcgttcggtgacctgcgatatttcatcgcccgaaggccagcaactcgtgcgcgaactcgccgcgcagagtgatgtggtgctggaaaactacaaggtcggccagttgaagaagtacgggctcgactatgcatcgctgaaggcggtgaagccggacatcatttattgctcggtgaccggcttcggccagagcggcccatatgcggcccgccccggctatgacttcatcatccagggcatgggcggcttcatgagcctgaccggcgagcgcgacgacctgccgggcggcggcccgcagaaggccggcgtggcgatctccgacctgatgaccggccagtacgcgactatcgccgtgctggccgcgctggcgcaccgcgaccgcacgggcgaaggccagtacatcgacatggcgctgctcgacgtgcaggtcgccatgctggccaatatgaataccaactacttggcgagcggccaggctccgcgccgctggggcaatgcgcacccgaacatcgtcccgtaccagaccttccaggccgccgacggctggctgatcgtcgcggtcggcaacgacgggcagttccgcaagttcgtcaacgacggcggccagccggaactggcggatgatccgcgcttttcgaccaacccgctgcgcgtggccaaccgcgacgtgctggtgccgatcctggccgacatggtgcgcacgcgtacgcgcgcacagtggatccgcgacctggaagcggccggcgtgccgtgcggcccgatcaactcgctcgacgaagtcttcgaggacgagcaggtcaaggcccgcggcctgcgcgtggacttgccgcacccgagcgccggcgaggtcaagctggtcggcagcccgatcaagatgagcgccacgccgcccgaggcgctgcgccatccgccgctgcttggcgagcacaccgacaccatcctggccgagtcactgggctacagccccgagaagatcgcggcgctacgcgccaagggcgtggtataa

SEQ ID NO: 6790 - protein, 433 aa, Ralstonia eutropha JMP134
MQRVRASPSAGFGIPLYTLCKRSPLAAMGALSHLRVLDLTRVLAGPWCAQNLADFGADVIKIERPGAGDDTRTWGPPWLKATDGSDTAEAAYYLAANRNKRSVTCDISSPEGQQLVRELAAQSDVVLENYKVGQLKKYGLDYASLKAVKPDIIYCSVTGFGQSGPYAARPGYDFIIQGMGGFMSLTGERDDLPGGGPQKAGVAISDLMTGQYATIAVLAALAHRDRTGEGQYIDMALLDVQVAMLANMNTNYLASGQAPRRWGNAHPNIVPYQTFQAADGWLIVAVGNDGQFRKFVNDGGQPELADDPRFSTNPLRVANRDVLVPILADMVRTRTRAQWIRDLEAAGVPCGPINSLDEVFEDEQVKARGLRVDLPHPSAGEVKLVGSPIKMSATPPEALRHPPLLGEHTDTILAESLGYSPEKIAALRAKGVV

SEQ ID NO: 6791 - DNA, 1221 bp, Ralstonia eutropha JMP134
  CDS (1)..(1221): transl_table=11
atgaagaaagccctcggacacctcagggtgctggacctcacacgcgtgctggccggcccctgggcgacgcagaaccttgccgatatgggcgcggacgtgatcaagatcgaacggcctggcgcgggcgacgacacgcgcgcctggggcccgcccttcctgcgcgatgcacaaggcgaggagacgcgcgattcgtcctacttcctgagtgccaaccgcggcaagcgctcggtgacggtggatatcgccacgcccgcgggccaggtcatcatccgcgacctcgcgcgtgaggccgacgtggtggtcgaaaactacaaggtcggcacgctggcgcgctacgggctgggctacgaagacctgcgcgccatcaacccgcggctcgtgtattgctcgatcaccggcttcggccagagcggcccgtacgcatcgctgcccggctatgacttcgtgttccagggcatgggcgggctgatgagcatcaccggcatgcccgacggcgagcccggaggcgggccggtcaagtccggcatcgccattaccgacctgctgaccggcatgtacgcgaccacggccattctcgccgcgctggaacaccggcacgtgagcggcgttggccagtacatcgacatggcgctgctcgactgcgtggtgacgatcaactcgtaccaggcgatcaactacttcctgtcgggaaagattccgcagcgcatgggcaatgcgcattcgaacatggtcccgtaccaggtgttccgctgcaaggagggcgacgtcatcgtcgcggtcggcaacgacggccagtatcgcgcactgtgcaaggtgatcgggcggcacgacctgggcgaagacgaacgcttcgcgactgccgggaaccgcaaccgcaaccgagaggtgctgatcccgcaagtcgccgaagccatgctggcgcgcaccatgacggaatgggtcgagctgctcgaagcggctaacgtgccttgcggcccgatctacaacatgcagcaggtattcgaagatccgcaggtacgccatcgcgagatgcagctgtcgctgccgcacagcgctggcgtgagtgcaccaggcctggccaacccgatccggttgtccgacacgccggtcacatacgagcgctccgcgccgacgctgggcgagcataccgacgctgtactcggcgaactcggctacgacgccgcgcgtattgccgcgttgcgcaaggagggtgtgctatag

SEQ ID NO: 6792 - protein, 406 aa, Ralstonia eutropha JMP134
MKKALGHLRVLDLTRVLAGPWATQNLADMGADVIKIERPGAGDDTRAWGPPFLRDAQGEETRDSSYFLSANRGKRSVTVDIATPAGQVIIRDLAREADVVVENYKVGTLARYGLGYEDLRAINPRLVYCSITGFGQSGPYASLPGYDFVFQGMGGLMSITGMPDGEPGGGPVKSGIAITDLLTGMYATTAILAALEHRHVSGVGQYIDMALLDCVVTINSYQAINYFLSGKIPQRMGNAHSNMVPYQVFRCKEGDVIVAVGNDGQYRALCKVIGRHDLGEDERFATAGNRNRNREVLIPQVAEAMLARTMTEWVELLEAANVPCGPIYNMQQVFEDPQVRHREMQLSLPHSAGVSAPGLANPIRLSDTPVTYERSAPTLGEHTDAVLGELGYDAARIAALRKEGVL

SEQ ID NO: 6793 - DNA, 1338 bp, Ralstonia eutropha JMP134
  CDS (1)..(1338): transl_table=11
atggcaagttggccgcgcggccggggcgctctacccttgcatcaaactcgtccggaagatgcaaaggagacagccttgaacaccgaaaccggccgcgccacggcggccacgcaggaccaacaccccacccccgaccgcccgctccagggcgtgcgcgtgctggccgtggagaacttcgtcgccggcccgttcgcgtccatgtggctcgccgacgcgggcgccgaggtcatcaaggtcgaagccccggccggcggcgacttcgcgcgcagcaccagccccgtcaggagggcggaggacggcagcccgcacgcgctgtcgttcctgcgcaccaaccgcaacaagaagagcctgacgctggacctcaagcagcccgagggcaagcggctgttcctcgaactgatcgccagcgccgacatcgtgatcgaaaacttgcgcccgggcgtcatggaccgcctcggcgtcggctacgacactttgcgcgcgcgcaacccgcgcctgatctacgttgccatttccggctttggccacaccgatgtgaagccaagcccttacaccgaccacccggccctcgacatcgtcggccaggcgctcagcggcctgatgtaccggcccgaacggcaggacgaccggccgacctatctcggcttttcgatgaccgacctgcagggcggcatcctcgctgcgcaaggcgcgctgctggccctgtaccagcgcgagcgtaccgggcggggcaagaaggtcgacatttcgctgtacgacgcctcgctggtccagaacgagatctcggtcaccatgtactcggccctgcaccagccgctgccgccgggcgtacccgcggtgacagcgccgttcgggccgttccgcgccagcgacggccatatcgtcatcgcggtgctcggcgagcacatctggcgccgcttctgcgaggtgatcggcaagccggacctggtggacgatccgcgcttcgccgatggcatcgagcgccgcaagcacagtgccgcgctcgatccgcatatcgacgcgtggcttgccacgcgcacgcgcgcgcaagccgtggacctgctgcgcgagggcggcgtgccagcgtcggtggtcaacgacgtggccgacctgttcgactgcccgcatgtcgccgcgcgcgagatgctgatgacggtccaggacccggcgtggggcccggtgcaggtggtcggcaacccgatcaagatgtcggacgtgcccgagcccgaggcgagggtgccgccgcggctcggggagcataccgacgcggtgctgcgcgactggctacacctcgatgcgcggcaggtcgccgcgctgcgcgccgacggcatcgtctga

SEQ ID NO: 6794 - protein, 445 aa, Ralstonia eutropha JMP134
MASWPRGRGALPLHQTRPEDAKETALNTETGRATAATQDQHPTPDRPLQGVRVLAVENFVAGPFASMWLADAGAEVIKVEAPAGGDFARSTSPVRRAEDGSPHALSFLRTNRNKKSLTLDLKQPEGKRLFLELIASADIVIENLRPGVMDRLGVGYDTLRARNPRLIYVAISGFGHTDVKPSPYTDHPALDIVGQALSGLMYRPERQDDRPTYLGFSMTDLQGGILAAQGALLALYQRERTGRGKKVDISLYDASLVQNEISVTMYSALHQPLPPGVPAVTAPFGPFRASDGHIVIAVLGEHIWRRFCEVIGKPDLVDDPRFADGIERRKHSAALDPHIDAWLATRTRAQAVDLLREGGVPASVVNDVADLFDCPHVAAREMLMTVQDPAWGPVQVVGNPIKMSDVPEPEARVPPRLGEHTDAVLRDWLHLDARQVAALRADGIV

SEQ ID NO: 6795 - DNA, 1236 bp, Ralstonia eutropha JMP134
  CDS (1)..(1236): transl_table=11
atgacagatttcagcgatacccgcgttcaggactccgctcgccccttgccgctggccggcgtgcgcgtgctcgacgtcagccaggtcatggccggcccctacgcgtgcatgctgctggccgaccttggcgccgacgtgatcaagatcgaaccgccagagggcggcgaccagacgcgcggctcgatgggcttcaagatgaagggcccggacagcatgggcttcctcaacatgaaccgcaacaagcgcagcgtcacgctggacctgaagacggaatcggggcgcgaggtgctgtaccggctggcggaaaccgccgacatcctcgtcgagaattaccggccgggcgtgatgaaacgcctcggcatcgattacgagacgcttagcaagatcaatccgaagctcgtctactgcagcatctccggcttcgggcagagcggcccgtgggccacgcggcccggcttcgacctgatggcgcaggccatgtcgggcgtcatgagcgtgaccggctacccgggcggcgcgcccgtgaaggccggtgtgccggtggccgacattggctgcgcgctgtttgccacttacggcatgctgtccgcgtacatcggggccaaggcgacaggaaaagggcagtacgtcgatgcttcgctgttcgattccgcactggccttttcggtgtgggacacgtgcgaatactggggcacgggccgcgaacccgagccgctgggcacggccaaccgcatgagcgcgccgtaccaggccatgaaagccgccgatggctacttcgtgatgggcgccaccaaccagaagctgtggcagttgctgtgcaagaccatcgaccggcccgacctcctcgcggacgagcgctttgcgaccgtggcgctgcggctgaataaccgcaaagcgctgatttgcgcgctggaggaaagcttcgcgcagcagggctgcgactactggattgagcacctgctcgaagtcggtatcccggccgggccgatcctgacgtatccgcaggcgttcgacagcgagcacggcaagcaccgccagatgcgtatcgagatcgatcacccgatcgaaggcaaggtgcccaatatcggcttcgccgtgaagatgggcggcacgccgcagcaggtccggcgtccgccgccgttgctgggtcagcatacggaggaagtcctggcggagcttggcctttcgaaggatcaacagcagtcgctggcggcagccggcgcgtttggcgcatga

SEQ ID NO: 6796 - protein, 411 aa, Ralstonia eutropha JMP134
MTDFSDTRVQDSARPLPLAGVRVLDVSQVMAGPYACMLLADLGADVIKIEPPEGGDQTRGSMGFKMKGPDSMGFLNMNRNKRSVTLDLKTESGREVLYRLAETADILVENYRPGVMKRLGIDYETLSKINPKLVYCSISGFGQSGPWATRPGFDLMAQAMSGVMSVTGYPGGAPVKAGVPVADIGCALFATYGMLSAYIGAKATGKGQYVDASLFDSALAFSVWDTCEYWGTGREPEPLGTANRMSAPYQAMKAADGYFVMGATNQKLWQLLCKTIDRPDLLADERFATVALRLNNRKALICALEESFAQQGCDYWIEHLLEVGIPAGPILTYPQAFDSEHGKHRQMRIEIDHPIEGKVPNIGFAVKMGGTPQQVRRPPPLLGQHTEEVLAELGLSKDQQQSLAAAGAFGA

SEQ ID NO: 6797 - DNA, 1236 bp, Ralstonia eutropha JMP134
  CDS (1)..(1236): transl_table=11
atgattgcattgcagggaattcgggtgctcgacctgagcaaggtacttgcgggcccgctgtgcggccagtatctgggggagcttggcgccgaagtcatcaaggtcgagccggtcggtagtggcgacgacacgcgcgcgtggctgccgcaggaacagggccagtcggcgaccttcctggccgtcaaccacaacaagcgcagcatcgcggtcgacctcaagacggcagagggccggaagatcgtccacgcgctggcggccaagtccgatgtcgtcctgcaaggatttggcagcggggcggccgctcggctcggcgttgactacgacaccctttcggccctgaaccccgcgctgatctactgcgagatctccggctacggccgtaccggcccgctcggacaggaacccggttacgacgtcatgctgcaagcgttcagcggcatggtcagcaccatgggcgaacccggcggcaggctcgctcgcgcaagcttttcccccgtcgatctcggcaccggcatgcatgcgttcagcggcgtcctggccgcgttgatcgaacgccagaagaccggccgcggcatgcaactcgaggtctcgctgctcgacaccgcgatgggattcatgggctacctcgcacagaactactggtgcagcggcaaggtgccgcgccccatgggtaccgcgcatcccgccatggcgccttaccaggtgttcgaggcttcggatgggccggtcatgatcggcatcggcaacgacgcacagtggcggcgcttctgccccgtcgccgccctgcaggcctatgtcgacgatccacgcttcgccaccaatgccgaccgtgtcgcgcacttcgacgaggtcgtcgccctggtacaggcgcgcattgccacccagcccgtcgcattctggctggacgcgctgcgcaacgccggtgtcgcctgcgcgccgatccacacactcgaccaggcgctcgcgcatccgcaactggccgcgcgcgggctaatcgtcgagtccaagcacccggtgctgggcaaggtgaggaacatgggcctgcccatccgcttccagggggaagaccggatcgcgcaccgggcgccgccattgctgggcgagcataccggggagttactgcgccaggccggctatgacaacgatgctatcgccgcgttgcatgcgagcggcgtggtggcaaccacgggccacacggaatccaacacgccgacgcaacagcgcgccgcggcatga

SEQ ID NO: 6798 - protein, 411 aa, Ralstonia eutropha JMP134
MIALQGIRVLDLSKVLAGPLCGQYLGELGAEVIKVEPVGSGDDTRAWLPQEQGQSATFLAVNHNKRSIAVDLKTAEGRKIVHALAAKSDVVLQGFGSGAAARLGVDYDTLSALNPALIYCEISGYGRTGPLGQEPGYDVMLQAFSGMVSTMGEPGGRLARASFSPVDLGTGMHAFSGVLAALIERQKTGRGMQLEVSLLDTAMGFMGYLAQNYWCSGKVPRPMGTAHPAMAPYQVFEASDGPVMIGIGNDAQWRRFCPVAALQAYVDDPRFATNADRVAHFDEVVALVQARIATQPVAFWLDALRNAGVACAPIHTLDQALAHPQLAARGLIVESKHPVLGKVRNMGLPIRFQGEDRIAHRAPPLLGEHTGELLRQAGYDNDAIAALHASGVVATTGHTESNTPTQQRAAA

SEQ ID NO: 6799 - DNA, 1272 bp, Ralstonia eutropha JMP134
  CDS (1)..(1272): transl_table=11
atgcgatgctgggcaagatcgcggcctgaacgggagcccgaagtgcagagtcaagccaaacccgccggggcgcttgccggcctgcgcgtgatcgacctcacgcagatgctggccggccccttttgcacgcagatcctcgctgaccacggggcggatgtcatcaaggtcgaagcgatgacgggcgacggcacgcgtgtgaccggcccgttctgccccgacgacgcgctgcgcgacttcggcggctatttccagagcgtcaaccgcaacaagcgctccatcgccgtcgacctgaagacggaggcgggtcgtgcagtcctgcgcgcgctgatcgacaaggccgacatcgtcgtcgaaaacttccgagcaggcgtgatggagcgcctgggctttgcctacgaaacgctgcgccagaccaacccgcggctgatctacggcacggtgcgcggctttggcgatccgcggagcggcgaaagcccgtatgcgcaatggccggcgtacgacgtggtttcgcaggctatgggcggcatgatgggcatcaccggcccggatcgttgcacaccgaccaagatcggtcccggcgtgggggacaccattccggcgctgatgctgtgcatcggcatcctcgcggccgtcaatcgcgtgcgcgaaaccggtcagggccagttcgtcgacgtggccatgaccgacgcggtgctggccatgtgcgagcgcatcgtctaccagaactcgtacaccggcgaagtggccgcaccggaaggcaaccgccacccgctgctgtgcccgttcggcttgttccgtgcgcgcgatggccatgtctcgattgcctgcgcgaccgatgcgttctgggaaaagctcgccgtggcgatcggccgccccgacatggcgcaggacccggacttcgcgaccaatgccgcgcgcgtgcagcatcagcagcaggtgatcgaggcgatcgaagcctttacctcggtgcgaaccaaggaagagattgccatcgcgctgggcggcaaggttcccttcggccccgtctatacctcggccgagatattcgcggacaggcactacgcggtgcgcgacatgatcgtcgaagtggagcaaccgggatcggccactccggtcaagatcgccggcgtaccgatcaagctcagcgaaaccccgggcgcggtgcgcacgcgcgcgccaatgctgggcgagcacaccgaagagattttgttcggtgccggctatgtggaggacgatattcgccgtctgcggcaggagggcgcggtgcggtaa

SEQ ID NO: 6800 - protein, 423 aa, Ralstonia eutropha JMP134
MRCWARSRPEREPEVQSQAKPAGALAGLRVIDLTQMLAGPFCTQILADHGADVIKVEAMTGDGTRVTGPFCPDDALRDFGGYFQSVNRNKRSIAVDLKTEAGRAVLRALIDKADIVVENFRAGVMERLGFAYETLRQTNPRLIYGTVRGFGDPRSGESPYAQWPAYDVVSQAMGGMMGITGPDRCTPTKIGPGVGDTIPALMLCIGILAAVNRVRETGQGQFVDVAMTDAVLAMCERIVYQNSYTGEVAAPEGNRHPLLCPFGLFRARDGHVSIACATDAFWEKLAVAIGRPDMAQDPDFATNAARVQHQQQVIEAIEAFTSVRTKEEIAIALGGKVPFGPVYTSAEIFADRHYAVRDMIVEVEQPGSATPVKIAGVPIKLSETPGAVRTRAPMLGEHTEEILFGAGYVEDDIRRLRQEGAVR

SEQ ID NO: 6801 - DNA, 1272 bp, Ralstonia eutropha JMP134
  CDS (1)..(1272): transl_table=11
atgcgatgctgggcaaggtcgccgcctgaacgggagcccgaagtgcagactcaagccaaacccgccggggcgcttgccggcctgcgcgtaatcgacctcacgcagatgctggccggccccttttgcacgcagatccttgctgaccacggggcggatgtcatcaaggtcgaagcgatgacgggcgacggcacgcgcgtgaccggcccgttctgccccgacgacgcgctgcgcgacttcggcggctatttccagagcgtcaaccgcaacaagcgatcgatcgcactggacctgaagaccagcgccggccgcgagatactgcgccggctgatcgacggggccgatgtggtcgtggaaaacttccgcgccggcgtgatggagcgccttggcttgtcctatgaaaccctgcgggaaaccaattcgcgcctggtctatggcgcggtgcgggggttcggcgatccgcgcagcggcgaaagcccgtatgcgcagtggccggcctacgacgtggtctcgcaagccatgggcggcatgatgggcatcaccggccccgaccgcgacacgcccaccaagatcgggcccggcgtaggcgacacggtgccggcgctgatgctatgtatcggcatccttgcggccgtcaaccgcgtgcgcgaaaccggtcagggccagttcgtcgatgtcgccatgaccgacgcggtgctggccatgtgcgagcgcatcgtctaccagacctcctacaccggcgccgtgccagcaccagaaggcaaccgccacccgctgctgtgcccgttcggactgttccgcgcgcgtgacggccatgtctcgattgcctgtgcgaccgacgcattctgggaaaagctggcgattgccattggccgcccggacatggcgcaggacccggccttcgcgaccaatgccgcacgcgtgcagcaccagcagcaggtcatcgacgccatcgaggcctttaccgccgtacgcaccaaggaggaaatcgcggtggcgctgggcggaaaagtgccgttcggcccggtctacacctcggcggaaatcttcgcggacaggcactacgccgtacgcgagatgctggtggatgtggagcagcctggatcgacgaagcccgtaaagatcgcgggcgtgccgatcaagctcagcgatacgccgggcgccgtgcggcgccgcgcgccgatgttcggcgagcacaccgacgagatccttggcgggatcggctatgcggacgacctgatccgggcgctgaaggcgcagcgtgtggtggcttag

SEQ ID NO: 6802 - protein, 423 aa, Ralstonia eutropha JMP134
MRCWARSPPEREPEVQTQAKPAGALAGLRVIDLTQMLAGPFCTQILADHGADVIKVEAMTGDGTRVTGPFCPDDALRDFGGYFQSVNRNKRSIALDLKTSAGREILRRLIDGADVVVENFRAGVMERLGLSYETLRETNSRLVYGAVRGFGDPRSGESPYAQWPAYDVVSQAMGGMMGITGPDRDTPTKIGPGVGDTVPALMLCIGILAAVNRVRETGQGQFVDVAMTDAVLAMCERIVYQTSYTGAVPAPEGNRHPLLCPFGLFRARDGHVSIACATDAFWEKLAIAIGRPDMAQDPAFATNAARVQHQQQVIDAIEAFTAVRTKEEIAVALGGKVPFGPVYTSAEIFADRHYAVREMLVDVEQPGSTKPVKIAGVPIKLSDTPGAVRRRAPMFGEHTDEILGGIGYADDLIRALKAQRVVA

SEQ ID NO: 6803 - DNA, 1200 bp, Ralstonia eutropha JMP134
  CDS (1)..(1200): transl_table=11
atgcaaaaaccgttgcgccatgtgcgcgtcctcgacctgaccaatgtgctggccggcccgttctgctgccaccagctcgcgcacatgggcgcggaagtcatcaaggtggaaacgcctggcaccggcgatctcgcgcgccagctcggcgcggatgcagacctgaaccagcgcctgatgggcgtgtcgttcctggcgcagaacccgggcaagcagtcgatcacgctgaacctcaagcacgcgcgcggcaaggaagtgttccgcaagctcgtccagagcgccgacgtggtggtcgagaacttccgccccggcgtgatggcgcggctgggcctgggctacgacgtcctgaagcaggacaacccgcgcctgatctactgtgcgatctcgggctttggccaggacgggccgctgtcggacctgcccgcgtatgaccagatcatccagggcatgtcgggcgtgatgagcatcactggcgatgcagagaccgcgccgtaccgtgtcggctatccggtgtcggacaccatcggcggcattactgccgcatttgcgattgccgcttcgctggcggaccaccagcgcaccgagggctacttcatcgacgtgtcgatgctcgaagccacgctcgcgaccatgggctgggtcgtgtcgaaccacctgatcgccggcaaggcaccggcgccgatgggcaacgagaacttcacggccagtccgtctggcaccttccgcaccggcgacggcctgttgaacatcgccgcgaacaagcaggagcagttcgaggccgtgtgccgcgtggtcggccgtctggagctgatcgccgatgaacgcttcgccgcgcgccaggcgcgcctggcgaaccgcgccgcgctaacgcaggcactagaggccgaacttgagaagaagcccgccaacgagtggtgggcgctgctcaacgaggccggcgtgccggccggccccgtactgggcgtgccacaaacgctggagcagccgcaggtgcgcgaccgcggcatgatcgggacgtttgccgacgtgcccggcgtgggccgcgatatccgcgtggtgcgcaccggcttcaagctgaaccaggaagcgccgtcggtggacacaccgcccccgcagcttggcgaacacacacagcagatcctcgccggccttggctacagcgaggccgacatcgataccctcagacaggagcgcgcggtatga

SEQ ID NO: 6804 - protein, 399 aa, Ralstonia eutropha JMP134
MQKPLRHVRVLDLTNVLAGPFCCHQLAHMGAEVIKVETPGTGDLARQLGADADLNQRLMGVSFLAQNPGKQSITLNLKHARGKEVFRKLVQSADVVVENFRPGVMARLGLGYDVLKQDNPRLIYCAISGFGQDGPLSDLPAYDQIIQGMSGVMSITGDAETAPYRVGYPVSDTIGGITAAFAIAASLADHQRTEGYFIDVSMLEATLATMGWVVSNHLIAGKAPAPMGNENFTASPSGTFRTGDGLLNIAANKQEQFEAVCRVVGRLELIADERFAARQARLANRAALTQALEAELEKKPANEWWALLNEAGVPAGPVLGVPQTLEQPQVRDRGMIGTFADVPGVGRDIRVVRTGFKLNQEAPSVDTPPPQLGEHTQQILAGLGYSEADIDTLRQERAV

SEQ ID NO: 6805 - DNA, 1158 bp, Ralstonia eutropha JMP134
  CDS (1)..(1158): transl_table=11
atgcttcatcgtgccctggaaggcgtgcgtgtattggacctgtcgcgcatcctggccggcccctggtgcacccagaacctggcggatctcggcgccgaggtgacgaaggtcgaacaccccgagcggggcgacgatacgcgcggctggggcccgccttacatgtcggcggccgatggcagcgacgcgcgcctgtccggctatttcatcagctgcaatcgcggcaagcgttcggtggcgatcgactacggcacgcccgaaggcgccgcacaggtgcgcgaactggcgcgcgaggcagacgtgctggtcgagaactacaaggtcggcacgctgcggcgctacgggctggactacgaccgcctcaaggcgatcaacccgcgactggtctacctgtcgatcaccggcttcggccaggacgggccgatggccgacaaaccgggctatgactacgtgttccagggaatgggcgggctcatgagctataccggccagcccgacggcagtcctggcgccggcccgctgcgcaccggcgtggcggtggtggacctcagcaccggcatgtacgcgacttcggccgtgcttgctgcgctgtaccagcgccacgcgaccggcgtcggccagcacctcgatatcgcgctgctcgatgtagccgtggcgctcaacgcgaatcagggtgcgaattacctggtatcgggcgagaacccccagcgcagcgggaatgcgcacccgaactgcgcgccgtacgaagtgttccgctgcgcggacggctacctgatcctcgccatcggcaatgacggccagttcgcccgcttctgtgcagtcgccggtatggccgacctggcacaggacgcgcgctacgcgaccaactcggcgcgtatcgaaaacttgccgcaactgcgcgcactgctgacggagatcttcccgacacgcactcgcaccgcatggacggacgccttcgatgccgccggcgtgccgtggggcccgatccacactatggaagaagtctttgcgcatccgcaggtgcgccaccgcgggctgcagcaattcgccgagcacccggtgatgggcaccgtgccgatggtgcgcaaccctatgctcgccggccacaccggaccgtcgcagccgccgccgctgctgggcgaacacaccgcgccggcctga

SEQ ID NO: 6806 - protein, 385 aa, Ralstonia eutropha JMP134
MLHRALEGVRVLDLSRILAGPWCTQNLADLGAEVTKVEHPERGDDTRGWGPPYMSAADGSDARLSGYFISCNRGKRSVAIDYGTPEGAAQVRELAREADVLVENYKVGTLRRYGLDYDRLKAINPRLVYLSITGFGQDGPMADKPGYDYVFQGMGGLMSYTGQPDGSPGAGPLRTGVAVVDLSTGMYATSAVLAALYQRHATGVGQHLDIALLDVAVALNANQGANYLVSGENPQRSGNAHPNCAPYEVFRCADGYLILAIGNDGQFARFCAVAGMADLAQDARYATNSARIENLPQLRALLTEIFPTRTRTAWTDAFDAAGVPWGPIHTMEEVFAHPQVRHRGLQQFAEHPVMGTVPMVRNPMLAGHTGPSQPPPLLGEHTAPA

SEQ ID NO: 6807 - DNA, 1131 bp, Ralstonia eutropha JMP134
  CDS (1)..(1131): transl_table=11
atgacgcaatccaagacgggcgcgctggccggcatccgcgtggtcgacctgtcgcgcatcctgggcggcccgtactgcgggcagattctcggcgaccacggcgccgacgtgctgaagatcgaaccgccgcagggcgatgacacgcgtacctggggccctccgttcaaggatggcgtcgcgtcctattacttcgggctgaaccgcaacaagcgcgtgatgaagctcgatctcacggccgagtcggaccgcagcgtgctgctcgcgctgctggaagatgctgatgtgctggtcgagaacttcaagaccggcaccatggagaagtgggggcttggcttcgacacgctgtcggctcgctttccgcgtctgattcactgccgggtttccggtttcggtgcggatggcccgctcggcggcctgcccggctatgacgccgctgtacaggccatggctggcctcatgagcatcaacggcgagcccgatggcaatgccctgcgtgtcggcctgccggtcgtcgatatggtcacgggcatgaacgccgcgctcggcgtgctgctggcgctgcaggaacgcgagcgcagcgggcgcggacagttcgtcgaagccgcgctgtatgactcgggcctgtcgctgctgcatccgcacgcggcgaactggttcatgaatggcaagacgccggtgcggacgggcaatgcgcatccgaacatctatccgtatgacacggtagccaccggcacggatccgattttcctcgccgtgggcaatgaccggcagttccgcatcctctgcgagcatctgcggattcctgcattggccgacgacgaacgctatgccacggcaggcggacgctcggtcaaccgcgtggcgctgaaggccgaactggaagcgcgcatgcgcgagctggacggcaaggtgctggccgatacgctggtcgcggccggcgtgccatgcgcgccggtgctatcggtgccggatgccctgcagcatccgcataccgtgcatcgtgaaatggtggtcgagatggaagggggctacaaggggctgggcgcccccgtgaagctgagccgcacgcccgcgacgtaccggttcgcgccgttgacggaaggcgaccagttcctgccgaaggaagactga

SEQ ID NO: 6808 - protein, 376 aa, Ralstonia eutropha JMP134
MTQSKTGALAGIRVVDLSRILGGPYCGQILGDHGADVLKIEPPQGDDTRTWGPPFKDGVASYYFGLNRNKRVMKLDLTAESDRSVLLALLEDADVLVENFKTGTMEKWGLGFDTLSARFPRLIHCRVSGFGADGPLGGLPGYDAAVQAMAGLMSINGEPDGNALRVGLPVVDMVTGMNAALGVLLALQERERSGRGQFVEAALYDSGLSLLHPHAANWFMNGKTPVRTGNAHPNIYPYDTVATGTDPIFLAVGNDRQFRILCEHLRIPALADDERYATAGGRSVNRVALKAELEARMRELDGKVLADTLVAAGVPCAPVLSVPDALQHPHTVHREMVVEMEGGYKGLGAPVKLSRTPATYRFAPLTEGDQFLPKED

SEQ ID NO: 6809 - DNA, 1221 bp, Pseudomonas fluorescens PfO-1
  CDS (1)..(1221): transl_table=11
atgggcgcgctgtcgcatctacgggtactggatttatcgcgagtgctggccggcccatgggctggtcagattctggctgatcttggggcggaagtgatcaaggtcgagcgcccgggtaatggtgacgacactcgcgcctgggggccgcccttccttaaagacgcctatggcgagaacaccagcgaggcggcttactacttgtcggccaaccgcaacaagcaatcggtgacgatcgacttcacgcgtcccgaaggtcagaagctggttcgggagctggcagccaagtccgacatcctgatcgagaacttcaaggtgggtggcctggcggcttacggcctggattacgagtcgctgaaggcaatcaatccagatctgatctattgctcgatcaccggtttcggtcaaaccggaccgtatgccaagcgtgcgggttatgacttcatgattcagggtctcggcgggctcatgagtctgaccgggcgacccgagggtgatgagggggccgggccggtgaaagtgggtgtggcgctgaccgatatcctgacgggcctgtattcgaccgtggcgatcctggcggcgctggctcatcgtgatcacgatggcggtgggcaacatatcgacatggcgctgctggatgtacaggtggcatgtctggccaaccaggcgatgaattacctgacgacgggcactgcgccgaagcggctggggaatgcgcatccgaacatcgtgccgtatcaggattttcctacggctgacggcgacttcattctcacggtgggcaacgacgggcagttccgtaaatttgccgaagtggcggggcagccgcagtgggcggacgatccgcgttttgcgactaataagctgcgagtggcgaaccgggctgttctaattccgttgatccgtcaggcaacagtcttcaagacgaccgctgagtgggtggctcagctggagcaggcgggtgtaccgtgtggaccgatcaatgatctgtcacaggtgttcgaggatccacaggtgaagtctcgcgggttggcgattgagctgcctcacgcgctggcggggatggtgccgcaggtggccagtccgattaggttgtcgcggacgcctgttgagtatcgccatgcgcctcctttgttgggcgagcatacgttggaggttttgcagcgggtgctgggtcttggagctggagcagtggctgcgatgaaagaggatggagtgctctga

SEQ ID NO: 6810 - protein, 406 aa, Pseudomonas fluorescens PfO-1
MGALSHLRVLDLSRVLAGPWAGQILADLGAEVIKVERPGNGDDTRAWGPPFLKDAYGENTSEAAYYLSANRNKQSVTIDFTRPEGQKLVRELAAKSDILIENFKVGGLAAYGLDYESLKAINPDLIYCSITGFGQTGPYAKRAGYDFMIQGLGGLMSLTGRPEGDEGAGPVKVGVALTDILTGLYSTVAILAALAHRDHDGGGQHIDMALLDVQVACLANQAMNYLTTGTAPKRLGNAHPNIVPYQDFPTADGDFILTVGNDGQFRKFAEVAGQPQWADDPRFATNKLRVANRAVLIPLIRQATVFKTTAEWVAQLEQAGVPCGPINDLSQVFEDPQVKSRGLAIELPHALAGMVPQVASPIRLSRTPVEYRHAPPLLGEHTLEVLQRVLGLGAGAVAAMKEDGVL

SEQ ID NO: 6811 - DNA, 1146 bp, Rhodobacter sphaeroides 2.4.1
  CDS (1)..(1146): transl_table=11
atgagcgcgccgcttgccgggatccgggtcgtcgaactggcccggattttggccggcccatgggccgggcaggtgctggcggacctcggcgcggatgtcgtcaaggtcgaggccccggaaggcgacgatacccgccgctggggcccgccctttatcgagcgcgagggcgaccgctcggccgcctatttccacgcggccaaccgcggcaagaggtcggtgacggccgatttccgcacgcccgaggggcaggagaccgtccggcggctcgtggccgatgccgatgtggtgatcgagaatttcaaggtgggcgggctcgcgaaatacgggctcgactggccgtctctgcagaaggtgaacccgcggctcgtctattgctcgatcacgggcttcgggcaggacggcccctacgcgcaccgggcgggctacgatttcatcatccagggcatggcggggctgatgagcgtcaccggcgcggccgagggccagccgcagaaggtgggcgtggcggtgaccgacatcttcaccgggatctatgccgccaccgccattctcgccgccctgcaccagcgcgcgggcacggggcgcgggcagcaggtggacatggcgctgatggatgtggccgcgggcatcatggccaatcaggcgatgaactacctcgcgaccggcgtcgcgccgcggaagatgggcaacgaacatccgaacctcgcgccctatgcggtcttcgattgcgccgacggctggatcatcatcgcgaccggcaacgacgcgcaatatcgcaggctctgcacgcttctgggcctgccggggctggccacggcgcccgcgttcctcaccaatgccgaccgggtggcgaaccgggccgagctgacgcgcgcgttgacagctgtcacctcgggctggcggaaggcggagcttctggccgcctgcgaggccgagggcgtgcctgcgggcccgatcaacgacatggccgaagtcttcgccgatccgcagatccgccatcgcggcatgcagatcgcccccggcggcgtgccgggcgtgcgctctccctttcgcttctccgaggcggagctggccctcgcccgccccgccccgcggctcggcgagcatcgggccgaggtgctgggcgaaccggcggatcaggactag

SEQ ID NO: 6812 - protein, 381 aa, Rhodobacter sphaeroides 2.4.1
MSAPLAGIRVVELARILAGPWAGQVLADLGADVVKVEAPEGDDTRRWGPPFIEREGDRSAAYFHAANRGKRSVTADFRTPEGQETVRRLVADADVVIENFKVGGLAKYGLDWPSLQKVNPRLVYCSITGFGQDGPYAHRAGYDFIIQGMAGLMSVTGAAEGQPQKVGVAVTDIFTGIYAATAILAALHQRAGTGRGQQVDMALMDVAAGIMANQAMNYLATGVAPRKMGNEHPNLAPYAVFDCADGWIIIATGNDAQYRRLCTLLGLPGLATAPAFLTNADRVANRAELTRALTAVTSGWRKAELLAACEAEGVPAGPINDMAEVFADPQIRHRGMQIAPGGVPGVRSPFRFSEAELALARPAPRLGEHRAEVLGEPADQD

SEQ ID NO: 6813 - DNA, 1305 bp, Burkholderia sp. 383
  CDS (1)..(1305): transl_table=11
atgcaagacaccgccattcgcactccgtccaccggcgacacgccggccggccatcgcccgaagccgctcgccggcatcaacgtgctcgacctgtcgcgcatcctcgccggcccgtggtgcacgcagaaccttgcggacctcggcgccgacgtgaccaagatcgaacgcccgggcaccggcgacgacacgcgaacgtgggggccgcccttcctgcacgatggcgaaggccgcgcgacgagcgaaagcgcctactacctctgtacgaaccgcgggaagcgatcggtcgcgatcgacatcgcgtcgcccgagggcgcggcgttgatccgttcgctcgcggagcaggcggacgtcctcgtcgagaatttcaaggttggcgggctcgccaagtacgggctcgactatccgggcctcgccgccgtcaacccgcgcctcgtctactgttcgatcacgggcttcggccagaccgggccgctcgcgcatcgcgcgggctacgacttcctgattcaggggatgggcggcctgatgagcttcaccggcgagccggacgaagcgccgggcggcggcccggagaaggtcggcgtcgccgtcaccgacctgatgtcgggcatgtatgcgaccacggcgatcctcgcggcgctgatggagcgcgaacgcagcggcctcggccagcacatcgatatctcgctgctcgacagccagttcgcgatgctcgccaaccaggcgtcgaactacctgaccaccggcgtcgcgccacggcggctcggcaatgcgcatcccaacgtcgtcccgtatcagacgttcgctgcccgcgacggccacctgatcatcgcgtgcggcaacgacggccagttcaaggcattgtgcggcgccatcgggcttccggggctcgccgaggacagccggttcgcgaccaattcggcccgcagcgtcaatcgcgcgttgttgctgccgaccctcgtcgatgcgttcctcgcccgcccgcgggacgagtggatcgcgatcttcgaatcgtgcggggtaccgtgcgggccgatcaatgacgtcgcgcaagcgctggcgtcggagcaggcgcgcgcgcgcgaagccgtccgtcacatcgctcacccgctggccggcagtgcgccggtggtcgcgagcccgctgcgcctgtccgccacgccggtcgagtatgatcgcgcgccgccgctgctcggcgagcattcggccgacgtgctgcgggaacgactcgagttgagcgacgcacgcatcaccgcgctggccgaagccggcgtgatcgcgctgcattcggcgtcgcaatccgcctga

SEQ ID NO: 6814 - protein, 434 aa, Burkholderia sp. 383
MQDTAIRTPSTGDTPAGHRPKPLAGINVLDLSRILAGPWCTQNLADLGADVTKIERPGTGDDTRTWGPPFLHDGEGRATSESAYYLCTNRGKRSVAIDIASPEGAALIRSLAEQADVLVENFKVGGLAKYGLDYPGLAAVNPRLVYCSITGFGQTGPLAHRAGYDFLIQGMGGLMSFTGEPDEAPGGGPEKVGVAVTDLMSGMYATTAILAALMERERSGLGQHIDISLLDSQFAMLANQASNYLTTGVAPRRLGNAHPNVVPYQTFAARDGHLIIACGNDGQFKALCGAIGLPGLAEDSRFATNSARSVNRALLLPTLVDAFLARPRDEWIAIFESCGVPCGPINDVAQALASEQARAREAVRHIAHPLAGSAPVVASPLRLSATPVEYDRAPPLLGEHSADVLRERLELSDARITALAEAGVIALHSASQSA

SEQ ID NO: 6815 - DNA, 1242 bp, Burkholderia sp. 383
  CDS (1)..(1242): transl_table=11
atgaacgcaaccgacaacacgcaggcgaacaccgtcgaccggccgctggacggcgtgcgggtactcgccatcgagaatttcattgcgggcccctatgcgtcgatgtggctcgccgatgccggcgcggaagtggtcaaggtcgaatcgcgcgaaggcggagatttttcccgcagcacgagccccgtcaagaccgacgcgcacggcgtcgcgcacggcctgtcgtttctgcgctcgaaccgcaacaagaagagcgtcacgctcgacctgaagcatcccgacggcaagcggatcttcatcgagctggcgcgcgaagccgatatcgtcgtggaaaacctgcgccccggcgtcatggatcggctcggcatcggttacgacgtgttgcgcgaacacaatccgcgcctgatctacgtcgcgatctccgggttcggccacaccgacgtgaagcccagtccgtacacggattacccggcgttcgacatcgtcgggcaggcgatgagcgggctgatgtaccggcccgagcgcaccggcgatcgtccgacctatctcggcttttcgctggccgacctgcaaggcggcatcctggcgatgcagggcgcactgctggcgctctatcagcgccagcgcaccggccgcggcaagaaggtcgacatttcgctctacgatgcgtcgctgatccagaacgagatctcggttgcgatgtattccgcgctgcgccagcccacgccgccgggcgtgcatgcggtcaccgcgccgttcggcacctatcgcgcgaacgacggctatatcgtcatcgccgtgctcggcgagcatatctggcgacggttctgcgacgtgatcggtcggccggaactgcccgacgatccgcgctttgtcgacggcatctcccgccgtgccaatggcgacgtgctcaacagccacatcgatgcatggctggccgcacggacccgcgcggacgccgtccggatgttgcgtgacggcggggtgccggcctcggtggtgaacgatgtcgccgacctgttcgactgcccgcacgttgccgcccgcgacatgctgatgacactcgacgacccggtctgggggccgatccaggtcgccggcaacccgatcaagatgtcggacgtgccggaacccgaagccggtctgccgccgcaactgggccagcacacgcaggccgtgctcgaggcgtggctgcagatggacggcgacgaagtcgccgcgctgcgctcgcggcaggtcatctga

SEQ ID NO: 6816 - protein, 413 aa, Burkholderia sp. 383
MNATDNTQANTVDRPLDGVRVLAIENFIAGPYASMWLADAGAEVVKVESREGGDFSRSTSPVKTDAHGVAHGLSFLRSNRNKKSVTLDLKHPDGKRIFIELAREADIVVENLRPGVMDRLGIGYDVLREHNPRLIYVAISGFGHTDVKPSPYTDYPAFDIVGQAMSGLMYRPERTGDRPTYLGFSLADLQGGILAMQGALLALYQRQRTGRGKKVDISLYDASLIQNEISVAMYSALRQPTPPGVHAVTAPFGTYRANDGYIVIAVLGEHIWRRFCDVIGRPELPDDPRFVDGISRRANGDVLNSHIDAWLAARTRADAVRMLRDGGVPASVVNDVADLFDCPHVAARDMLMTLDDPVWGPIQVAGNPIKMSDVPEPEAGLPPQLGQHTQAVLEAWLQMDGDEVAALRSRQVI

SEQ ID NO: 6817 - DNA, 1296 bp, Burkholderia sp. 383
  CDS (1)..(1296): transl_table=11
atgcgaaccgcggtatcaggagacgatgaaaaaggagaggagatggaggaggtgattcatgagtcgcgcgccggaacgacgatcggcgcgggacgaccgctggccggtattcgcgtgctgacggtcgagaacttcatcgcggcgccgtttgcttcgatgtggctggcggacgccggcgcggaagtcgtcaagatcgaagcgcgcgacggcggcgattatgcgcggagcacggacccggtcgggccgggcgccgacggccggcccagcgggctcgcctttctgcggaccaatcggaacaagaagagcgtcacgctcgatctcaagcacccggagggacggcgcatcttcaccgagctcgccgcgcgggccgacgtggtgctcgagaacctgcggccgaacgtgatggaccggctggggctcggctacgcggcgttgagccggatcaatccacgcctgatctacggcgccatttccggcttcgggcacgacgacatcctgccgagcccgtacggcgatttccccgcgttcgatatcgtcgggcaggcgatgagcgggctgatgtaccgccccgagcgcggcgacgatcgtccgacctatctcggcttttcgctggccgatatcgagtgcgggatcctggcgctctacggcatcgtgctggcgctcctgcatcggcataccacgggcaagggcaagaagatcgacatctcgatggtcgatgcatcgttgatcctcaacgaaatctcggtcgcgatgtactcggcgacgaagcgcacgtcgccgcccggcgtgcatgccgttaccgcgccgttcggcacctatcgcgcgaaagacggctatatcgtgatcgcggtgctgggcgaacacatctggaagcggtttgcggacgtgatcggccggcccggcctgaaggacgatccgcgattcgccgacggcatgttgcgcaagcagcatgtcgacgtgctgaacgtcgagatcgatgcgtggctcggcgaccggtcgcgcgaagcggcgctggcggcgctgcgtgcgggtggcgtaccgtgctcgaacgtgaacgacgtgccggacctgttcgaatgccctcacgttgccgcccggaagatgctcatgacgctcgacgacccggcatggggttccattcaggtcgcgggcaatccggtcaagatgtcggatgtgcccgaaccggacgcgaagacgccgccggttctcggcgagcacaacgcggacgtgctgcacgactggctgggcctggatgaacgcgcgatcacgacattgcgggacatgaacgtgatctga

SEQ ID NO: 6818 - protein, 431 aa, Burkholderia sp. 383
MRTAVSGDDEKGEEMEEVIHESRAGTTIGAGRPLAGIRVLTVENFIAAPFASMWLADAGAEVVKIEARDGGDYARSTDPVGPGADGRPSGLAFLRTNRNKKSVTLDLKHPEGRRIFTELAARADVVLENLRPNVMDRLGLGYAALSRINPRLIYGAISGFGHDDILPSPYGDFPAFDIVGQAMSGLMYRPERGDDRPTYLGFSLADIECGILALYGIVLALLHRHTTGKGKKIDISMVDASLILNEISVAMYSATKRTSPPGVHAVTAPFGTYRAKDGYIVIAVLGEHIWKRFADVIGRPGLKDDPRFADGMLRKQHVDVLNVEIDAWLGDRSREAALAALRAGGVPCSNVNDVPDLFECPHVAARKMLMTLDDPAWGSIQVAGNPVKMSDVPEPDAKTPPVLGEHNADVLHDWLGLDERAITTLRDMNVI

SEQ ID NO: 6819 - DNA, 1191 bp, Burkholderia sp. 383
  CDS (1)..(1191): transl_table=11
atggcggaacacgagcagcagggcgcgctggagggattgcgcatcatcgatctgtcgcgggtgctgggcggcccgtacgccacgcagatcctggccgaccacggcgccgaggtgatcaaggtcgaaccgccatccggcgacgaaacgcgcacgtggggcccgccgttcgacggcgataccgcgtcgtacttcctcggcgtgaaccgcaacaagctcggcatcgcgctcgacctgacgcaaccggccgaccgcgagcggctgctcggcctgctcgaacatgcggacgccatcgtcgagaacttcaagatcggcacgatggagcgctgggggctcggcttcgacgcactgcacgcgcggtttccgcgcctcgtccattgccgcgtgtcgggctttggctcggacggcccgctcggcgggctgccgggctacgacgcggccgtgcaggcgctcgcggggctgatgagcgtcaatggcgaggcgggtggcgcgccgctgcgggtcggcgtgccgatcgtcgatctcgtgaccgggctgaacgcggcgctcggcgtgctgatggcgctgcgcgagcgcgacgcgagcggccgtggccagttcgtcgaatcgacgctgttcgactgcgcgctgtcgatcctgcatccgcatacgccgaacttcttccattcgaggaatgcgcccgtgcgcaccggcaacgcgcatccgaacatcacgccgtacgacagctttccgacggcgagcgtcgacatctttctggcggtcggcaacaacgggcagttcgcggggctgtgcgacgtgctcggcacgcgcgactggctcgacgatccgcgtttcgcggacaaccgcgcgcgcagcgcgaatcgcgccgcactacgcacgctgctcgaaacggcgctggccggacacgacggcgcggcgctcgccgagcagctgatgcgccgcggcgtgccgtgcgcgccggtgctcgggctcgatgcggcgctcgaccatccgcatgtcgcgcatcggcagatgaaggtcgagctgggccggcatcgcggcatcgcgtcgccgatcaagctcggccgcacgccggccacgtaccggcggccgccgcccgcgctgaacgaacacgccgcccgggtgttcgccgacgcggacgccaacgaccgcgaccacgaccacgaccacgaccacgacacgcgccgggactga

SEQ ID NO: 6820 - protein, 396 aa, Burkholderia sp. 383
MAEHEQQGALEGLRIIDLSRVLGGPYATQILADHGAEVIKVEPPSGDETRTWGPPFDGDTASYFLGVNRNKLGIALDLTQPADRERLLGLLEHADAIVENFKIGTMERWGLGFDALHARFPRLVHCRVSGFGSDGPLGGLPGYDAAVQALAGLMSVNGEAGGAPLRVGVPIVDLVTGLNAALGVLMALRERDASGRGQFVESTLFDCALSILHPHTPNFFHSRNAPVRTGNAHPNITPYDSFPTASVDIFLAVGNNGQFAGLCDVLGTRDWLDDPRFADNRARSANRAALRTLLETALAGHDGAALAEQLMRRGVPCAPVLGLDAALDHPHVAHRQMKVELGRHRGIASPIKLGRTPATYRRPPPALNEHAARVFADADANDRDHDHDHDHDTRRD

SEQ ID NO: 6821 - DNA, 1197 bp, Burkholderia sp. 383
  CDS (1)..(1197): transl_table=11
atgagcctgacgcgtggtgctctggacggcctgaaggtcgtcgacctgagccgtgtgctcggcggcccgtactgcacgcaggcgctcgccgaccacggtgcgacggtggtcaagatcgagccgccggacggcgacgagacgcgcggctgggggccgccattcctcggcgatacggcctggtatttcatgggcgtgaaccgcaacaaggaagggctcgcgctcgacctgtctcgcgccgaagggcgcgcaatcctgtggcgtctgctcgaagaggccgacgtgctcgtcgagaacttcaagcccggcacgctcgcgcgctgggggatggattacgcgcgcgacctgcagccgcgtttcccgcgcctgatccactgcgcggtgacgggcttcggcgaagacggcccgctcggcgggctgcccggctacgacgcggtgatccaggcgatggcggggctgatgagcgtcaacggcgagcgcgacggcgatgcgacgcgtatcggtctgccgatcgtcgacatggtcacgggactcaatgcgctcgcgggcatcctgctggcgctcgcggagcgcgagaagagcgggcagggccagtcgatcgacatcgcactgtacgactgcggcgtgtcgctgctgcatccgcacctgccgaacttcttcggttcggggcgcgtgccggagcgcagcggcaacgcgcatccgaacatcgcgccgtacgacagctatcgcacggcgaccgtgccgatcttcctcgcgatcggcaacgaccggcagttcgcgcggctcgtcgcgcatctcggcgtgccggcgctcgcaagcgatccgcgtttcgtcgacaaccgtagccgctgcgcgcatcggcccgagctgaaggccgaactggaagcacggctcgccgcgcatgcatgcgagccgctcgcgcgcgacctgatggcggccggcgtgccgtgcgggccggtgcgaacggtcgccgacgtcgcgcacgatccgcatgcgctgcaccgcaacctgttcgtcgaaatcggtgcgtatcgcggcacggcgtcgccggtgaagctgtcgcgcacgccggccacctatcgttcgccgccgcctgcactgggcggcgacacgcgcgcggtgctcgatcgcctcggcgtcgatcccgcgctccagcagcaactgctcgacgccggcgtgctgagggaagcccccggctag

SEQ ID NO: 6822 - protein, 398 aa, Burkholderia sp. 383
MSLTRGALDGLKVVDLSRVLGGPYCTQALADHGATVVKIEPPDGDETRGWGPPFLGDTAWYFMGVNRNKEGLALDLSRAEGRAILWRLLEEADVLVENFKPGTLARWGMDYARDLQPRFPRLIHCAVTGFGEDGPLGGLPGYDAVIQAMAGLMSVNGERDGDATRIGLPIVDMVTGLNALAGILLALAEREKSGQGQSIDIALYDCGVSLLHPHLPNFFGSGRVPERSGNAHPNIAPYDSYRTATVPIFLAIGNDRQFARLVAHLGVPALASDPRFVDNRSRCAHRPELKAELEARLAAHACEPLARDLMAAGVPCGPVRTVADVAHDPHALHRNLFVEIGAYRGTASPVKLSRTPATYRSPPPALGGDTRAVLDRLGVDPALQQQLLDAGVLREAPG

SEQ ID NO: 6823 - DNA, 1224 bp, Rhodospirillum rubrum ATCC 11170
  CDS (1)..(1224): transl_table=11
atggccgcagcccttgatggcattcgcgttcttgatttgtcccgcgtgctggccggcccctgggccagtcaggccctggccgacctgggggccgaggtcatcaagatcgagcgccccggcgccggcgacgacacccggtcgtgggggccgcccttcctcaaggacgaggacgggcgcgagaccaccgacgccgcctatttcctggcggccaatcgcggcaagaaatccctgaccgtcgatatcaccaaagccgagggccaggatttggtccgcgccctggcggcgcgcagccatgtggtgatcgagaacttcaagctgggcggtctggcgaaatacggcctggactggcccagcctgcgggcggtcaatccggccctggtctattgctcgatcaccggctttggccagaccggcccctatgcgccacgggcgggctatgacgcgatgatccaggcgatgtcggggctgatgagcgtgaccggcgaacccgatggcgtggccggcggcggaccgatgaaggtgggggtggcggtgaccgatatcctcaccggcctctatgcggcctttggcatcctcgccgccctgcgccatgccgaagccaccggcgagggccagcacatcgacctcgccctgatggatacggcggtcgcctgcatggccaatcaggcggccaacgccctggttggcgagcgcgtgcccggccgcctgggcacggcgcaccccaatatcgtgccctatcaggccttcgccacccaggacggccatctgatgctggcggtgggcaacgacggccagttcgcccgcctgtgcgcgatcggccagcgcccggacctgcccctagatccgcgctttgcccgcaaccgcgaccgcgtggcccatcgcgccgccctgctggccgagatcatcccgatgatggcgagccgctcgaccgatgcctggatcgccgccctggaaagcgccggggtgccttgcggcccgatcaataccctggatcgggtcttcgccgatccccaggtcatcgcccggggcctgcgcgtcgatggcacccacgccgaggccggcacggtgccgatggtgcgcaatcccttgctgctatcagccaccccgcccacccacaccgccggcccgccgacgctgggccagcatactgatggggtgctcagcgacgttctggggctgaccgccgaggacatcaccaccctacgccaaaaggcgatcgtttag

SEQ ID NO: 6824 - protein, 407 aa, Rhodospirillum rubrum ATCC 11170
MAAALDGIRVLDLSRVLAGPWASQALADLGAEVIKIERPGAGDDTRSWGPPFLKDEDGRETTDAAYFLAANRGKKSLTVDITKAEGQDLVRALAARSHVVIENFKLGGLAKYGLDWPSLRAVNPALVYCSITGFGQTGPYAPRAGYDAMIQAMSGLMSVTGEPDGVAGGGPMKVGVAVTDILTGLYAAFGILAALRHAEATGEGQHIDLALMDTAVACMANQAANALVGERVPGRLGTAHPNIVPYQAFATQDGHLMLAVGNDGQFARLCAIGQRPDLPLDPRFARNRDRVAHRAALLAEIIPMMASRSTDAWIAALESAGVPCGPINTLDRVFADPQVIARGLRVDGTHAEAGTVPMVRNPLLLSATPPTHTAGPPTLGQHTDGVLSDVLGLTAEDITTLRQKAIV

SEQ ID NO: 6825 - DNA, 1440 bp, Burkholderia thailandensis E264
  CDS (1)..(1440): transl_table=11
atgagcgacgatgcctcgaagcaattcccgtcttcgggcggcttggagatcgagcgcgacgcagcgcgggcgatcgattcggcaggtgcggccggcgtcgctggcgcggcagggcgcgccgcgaatccgtcgcagccggcgagcgcgctttgcgctccgcctgcgcagcgcgaaccgctggagacggcggccgcaaacgccgcacgccgaccgggttcggcctccccgcgcgacgcggcggcgaccgagcacgcccgccgcggcgcactcgcgggcctgaagatcgtcgacctgagccgcgtcctcggcggcccgtactgcacgcaggcgctcgcggaccacggcgcgcgcgtgatcaagatcgagccgccggcgggcgacgagacgcgcggctggggcccgccgttcttcgacgacgacgcgtggtacttcatcggcgtgaaccgcaacaaggaaggcatcgcgctcgacctgtcgcgcgacgaaggccgcgcgatcctctggcgtctgctcgaagacgcggacgtgctcgtcgagaatttcaagcccggcacgctcgcgcgttgggggatggactacgagcgggacttgcggccgcgctttccccgtctcgtccattgcgcgatcacgggcttcggcgccgacggcccgctcggcgggctgcccggctacgacgcggtgatccaggcgatggcgggcctcatgagcgtgaacggcgacgcctgcggcggcgcgacccgcatcggcctgccgatcgtcgacatggtgacgggcctgaacgcgctcgccggcatcctgctcgcgctcgccgagcgcgagaaaagcggcgtcggccagtcggtcgacatcgcgctgtacgactgcggcgtgtcgctgctgcatccgcatttgccgaactggttcggctcggggcgcacgcccgcgcgcagcggcaacgcgcatccgaacatcgcgccgtacgacagctaccgcaccgcgaccgggccgatctttctcgcggtcggcaacgaccggcagttcgcccggctctgcgcgcatctgggcgtgcccgagctcgcgggcgacccgcgtttcgtcgacaaccgcagccgttgcgcgcaccgcgccgagctgaaggcgagcctcgaggcgcggctcgccgatcgcgactgcgagacgctcgcgcgcgagctgatggccgagggcgtgccgtgcgggccggtgcgcacggtcgacgcggtcgcgcgcgatccgcacacgctgcatcgcgggctcgtcgtcgagatggggcgataccggggcgccgcatcgccgatcaagctgtcgcgcacgagcgcgacgtaccgcaccgcgccgcccatgctcgggcgcgatacgcgcgcggtgctcgacgcgctcggcatcgacgcggcgacgcaggcgcgcctcgccgaagcgggcgtgctgaaggaggcgaagtag

SEQ ID NO: 6826 - protein, 479 aa, Burkholderia thailandensis E264
MSDDASKQFPSSGGLEIERDAARAIDSAGAAGVAGAAGRAANPSQPASALCAPPAQREPLETAAANAARRPGSASPRDAAATEHARRGALAGLKIVDLSRVLGGPYCTQALADHGARVIKIEPPAGDETRGWGPPFFDDDAWYFIGVNRNKEGIALDLSRDEGRAILWRLLEDADVLVENFKPGTLARWGMDYERDLRPRFPRLVHCAITGFGADGPLGGLPGYDAVIQAMAGLMSVNGDACGGATRIGLPIVDMVTGLNALAGILLALAEREKSGVGQSVDIALYDCGVSLLHPHLPNWFGSGRTPARSGNAHPNIAPYDSYRTATGPIFLAVGNDRQFARLCAHLGVPELAGDPRFVDNRSRCAHRAELKASLEARLADRDCETLARELMAEGVPCGPVRTVDAVARDPHTLHRGLVVEMGRYRGAASPIKLSRTSATYRTAPPMLGRDTRAVLDALGIDAATQARLAEAGVLKEAK

SEQ ID NO: 6827 - DNA, 1221 bp, Burkholderia thailandensis E264
  CDS (1)..(1221): transl_table=11
atgggaaccctcagccatatccgcgtcctggacctgagccgcgtgctcgccggcccgtggtgcgcgcagacgcttgccgatctcggcgccgacgtgatcaaggtcgagcgcccggaactcggcgacgacacccggcactggggcccgccgtacctgaaaacgccggacggcgccgacacgcgcgaggccgcgtactacctcgccgcgaaccgcaacaagcgctcggtgacggtcgacatcgcgacgcccgagggccagcggatcgtccgcgagctcgccgcgcaatgcgatgtcgtgctcgagaactacaaggtcggccagctcgcgaaatacgggctcgactatgcgtcgctcgcggccgtaaagcccgatctcgtctactgctcggtgacgggcttcggccagacgggcccgtacgcgcaccgcgccgggtacgacttcatcatccaggggatgggcggcttcatgagcatcacgggcgagcgcgacggcctgccgggcggcggtccgcagaaggcgggcgtcgcgatcgccgatctcgcgacgggcctctattcgacgatcgcgatcctcgccgcgctcgcgcaccgcgaccgcacgggttgcggccagcacatcgacatggcgctcctcgacgtgcaggtcgcgctcctcgcgaacatgaacacgaacttcctcgcgagcggcaagccgccggtgcgctggggcaacgcgcatccgaacatcgtgccgtaccagacgttcgagacgagcgacggctggatcatcgtcgcggtcggcaacgacggccagttccgcaagttcgtcgacgcgggcgggcgggcggagctcgccgacgacgcgcgcttcgcgacgaatccggcgcgcgtgcgccatcgcgacacgctcgtgccgatcatcgcggagatgacgaagacgcgcacgaagcgcgagtggctcgacgcgctcgaggcgctcggcgtgccgtgcgggccgatcaacgatctcgccgaagtattcgacgacgagcaggtgcgcgcgcggggcatgcaggtcgagctgccgcacccgagcggcgcgaccgtgaagctcgtgcgcaacccgatccggatgagcgagacgccgcccgacgcgcgcagcgcgccgccgctcctcggcgagcatacggacgcggtgctgcgcgacatgctcggctacggcgacgcggcgatcgcggcgcttcgcgacaagcgcgtcgtctga

SEQ ID NO: 6828 - protein, 406 aa, Burkholderia thailandensis E264
MGTLSHIRVLDLSRVLAGPWCAQTLADLGADVIKVERPELGDDTRHWGPPYLKTPDGADTREAAYYLAANRNKRSVTVDIATPEGQRIVRELAAQCDVVLENYKVGQLAKYGLDYASLAAVKPDLVYCSVTGFGQTGPYAHRAGYDFIIQGMGGFMSITGERDGLPGGGPQKAGVAIADLATGLYSTIAILAALAHRDRTGCGQHIDMALLDVQVALLANMNTNFLASGKPPVRWGNAHPNIVPYQTFETSDGWIIVAVGNDGQFRKFVDAGGRAELADDARFATNPARVRHRDTLVPIIAEMTKTRTKREWLDALEALGVPCGPINDLAEVFDDEQVRARGMQVELPHPSGATVKLVRNPIRMSETPPDARSAPPLLGEHTDAVLRDMLGYGDAAIAALRDKRVV

SEQ ID NO: 6829 - DNA, 1206 bp, Burkholderia xenovorans LB400
  CDS (1)..(1206): transl_table=11
atgaacagtcccgctttgcccgccggcagcctcgacggcgttcgtgttctcgatctttcgcgcatccttgccgggccgagttgcacgcaactgctcggcgatctgggtgcggacgtcatcaaggtcgagaaacccggcgcgggcgacgacacccgcaagtggggaccgccgttcgcccgcgcggccgacggcacaccgttcgacgaaagcgcgtattacctgtgcgcgaaccgcaataagcgctcggtcgcgctggatatcgccacgcccgaaggacaggcgtcgatccatgcgctgctcgcgcacagcgatgtgctgatcgaaaatttcaaggtcggcgatctgagccgctatggcctcgactggccgcaattgcatgcgcgttatccgcgcctcgtgtattgctcgatcacgggcttcgggcaggacggtccgtacgccgcgcgtccgggctacgatttcatggcacaggcgatgggcggcatcatgagcctgacgggcgagccggacggcgcgccgcagaaagtggcggtcggcatcactgacctgatgacgggcatgtatgcgacggtcggcattctggccgcattgcgccatcgcgatcgtcatggcgtcggccagcatgtcgacgtggcgctgctcgattgccaggtggcgtcgctcgcgaacgccgcgacgcactatctgacgagcggtacgccgcccgcgcgactcggcaatgcgcatccgaacatcgttccctacgaagcctttccggcaagcgacggctacttcgtgatcgccgtgggtaacgacgcgcaattccgccgcctgtgcaccctgcccggcatgcagccgttggccgacgacgcccgctttatcaccaatgcatcgcgcgtgtcgcatcgcgccgcgctgattccgctgatgcgggcgatcacgcgcgaacgtgacgcggcgtggtggctcgcctcgctcgaagcgttgcagattccgtgcgcgccgatcaacacgctgccgcaggttttcgccgatccgcaagtcgtccatcgcgagatggcggtgcgcatggaagacgcgcgctatgaagcgggcggcccggtgctgctcggcaatccgctcaagctgagcgcgacgccggtgcgctatgcacgcactccaccacgcctgggcgaacatacgagcgaaatattggaccagctcgccacatacggcagagctcactga

SEQ ID NO: 6830 - protein, 401 aa, Burkholderia xenovorans LB400
MNSPALPAGSLDGVRVLDLSRILAGPSCTQLLGDLGADVIKVEKPGAGDDTRKWGPPFARAADGTPFDESAYYLCANRNKRSVALDIATPEGQASIHALLAHSDVLIENFKVGDLSRYGLDWPQLHARYPRLVYCSITGFGQDGPYAARPGYDFMAQAMGGIMSLTGEPDGAPQKVAVGITDLMTGMYATVGILAALRHRDRHGVGQHVDVALLDCQVASLANAATHYLTSGTPPARLGNAHPNIVPYEAFPASDGYFVIAVGNDAQFRRLCTLPGMQPLADDARFITNASRVSHRAALIPLMRAITRERDAAWWLASLEALQIPCAPINTLPQVFADPQVVHREMAVRMEDARYEAGGPVLLGNPLKLSATPVRYARTPPRLGEHTSEILDQLATYGRAH

SEQ ID NO: 6831 - DNA, 1308 bp, Burkholderia xenovorans LB400
  CDS (1)..(1308): transl_table=11
atgcaggaatcgtcgaaacagtcccggcaaaatgatgttgcgggttcacgactacggccgctcgaaggtatccgtgtgctggatctctcccgtgtgctggccgggccgtggtgtacccagaatctcgccgatctgggcgcacgggtcatcaagatcgagcggcctggcgccggcgacgaaacccgctcctgggggccgccattcctgcgcgacgccggcgggcgcgacaccagtgagagcgcgtactatctgtgcgcgaatcgcaacaagcagtcggtggccatcgatatcggttcgcctgaaggcgcggcactggtgcgcgaatttgcgaaaacctgcgacgtgctggtcgagaacttcaaggtgggcggtctcaaaaaatatggactcgactatgagagtctcgccgaactgaacccgcgtctcgtgtattgctccgtgacgggcttcggccagaccgggccgctttcgaagcgcgccggttacgattttctcgtgcagggcatgggcggcctcatgagtatcaccggcgaacccgacgacatcccgggcggcggtccggaaaaagtcggcgtagcggtgacggacctgatggccggcatgtatgcgaccacaggcgtactggccgcgctgatggaacgcgccaggagcggccgcggccagcacgtcgatattgcgttgctcgactgccagctcgcgatgctggccaaccagtcgatgaactatctgacgaccggcatcgcgccgcgcaggcttggcaatgcgcatccaaacgtggtgccctaccagaccttcgcgacgaacaacggtcacctcatcctcgcgtgtggcaacgacggtcaattccgcgcgctctgcggcgcgatgaaccggccggagctcgccacggatgtccggttcgcgaccaacagcgcgcgtagcgtgaaccgtgccgatctgattcccctgctcgcgtcgctgttcgccacccgcagcaatgacgaatggatcaccacgctcgaagcgtgcggggtgccgtgcggcccgatcaacgatatcgcgcaggcattcgagtccgagcaggcgcgccaccggaatgcggtgcgccatatggcacatccgctggccggtagtgcaccgacggtcacgagtccgctgcggctgtcggcgacacccgtcgaatacgttcagccaccgcctctgcttggcgaacatacggccgccgtgctgcacgatctgctcgggatggaacccgcacagattgccggattgtcgcaggccggcgtgatcggcgtaccgttcgttgccgacgtgcacgaagaggcataa

SEQ ID NO: 6832 - protein, 435 aa, Burkholderia xenovorans LB400
MQESSKQSRQNDVAGSRLRPLEGIRVLDLSRVLAGPWCTQNLADLGARVIKIERPGAGDETRSWGPPFLRDAGGRDTSESAYYLCANRNKQSVAIDIGSPEGAALVREFAKTCDVLVENFKVGGLKKYGLDYESLAELNPRLVYCSVTGFGQTGPLSKRAGYDFLVQGMGGLMSITGEPDDIPGGGPEKVGVAVTDLMAGMYATTGVLAALMERARSGRGQHVDIALLDCQLAMLANQSMNYLTTGIAPRRLGNAHPNVVPYQTFATNNGHLILACGNDGQFRALCGAMNRPELATDVRFATNSARSVNRADLIPLLASLFATRSNDEWITTLEACGVPCGPINDIAQAFESEQARHRNAVRHMAHPLAGSAPTVTSPLRLSATPVEYVQPPPLLGEHTAAVLHDLLGMEPAQIAGLSQAGVIGVPFVADVHEEA

SEQ ID NO: 6833 - DNA, 1227 bp, Burkholderia xenovorans LB400
  CDS (1)..(1227): transl_table=11
atggcagaacccaaaacccgtccggcgccgctcgcgggcattacggtcctcgacttttccaaagtcctggcgggaccagtctgtacgcaaattcttgccgacatgggcgccgacgtgatcaaggtggaatcgatcgaaggcggcgatgacacacgccgctggccccccttccgcaaggaaggggacaaccaggacggcacggtcttcctgagcgccaatagaggcaaacggagcatcgctgttgacctgaaatcaacaggcgggcgtgccgtaatcagacgacttgccgaaagcgcggatatcgtcatcgaaagcttcgggccgggtgtcgcgcagcgcctcggcgtcgatgcaggtacgctccacgaaatcaatccgcgactcgtgcattgcagtatctccggttttgggacagagggccccatgcgtttcgcaaaaggttacgatgtcatcctgcaggcattcagcggcatgctggggatcattggaaacccaggcgatccaccgatacgggttcccttctcgccgatcgatcaggccacgggctatcacgccgtcaccggcatactcgccgcccttttcgagcggaaccggacggatcgcgggactgccgtcgaggcatcactgtttgactcttccgtcagcttcatgggatatctgctgcagtcgttctgggaaagaggcaccgaacccgagcggcatgggtccggacacgagtccctttgtccttacgaagcgttcgcgaccgcggacaagccgatcatgctgggaatcgccaacgacgcgttgtggcgctcgttttgtgaactcgcagggatcgccgaactgggccgggatccgcgctttgcaacgaacgcagaccgtgtgtcaaaccggaaagaaactgtcgcgcttgtcagggacattctttcccgccgtccccgcgatgagtgggtcgacagtctgaataacgctggaattccctgttcgccaatccatacactcgcagagctttccgaacacccgcaacttgtcgaaagcggaatgcgtctggactacggtcacccgacctatgggaagctctccggcgtagcacaggctgtcaagttcaatggccagcgcgcgacggctgagttacccccaccgcttttcggtgagcacacgcgcgaaatacttcgcaggttgaagttatcggatcatgaaatcgacgcgatgcggaatgcggggcacgttttcacactaacatga

SEQ ID NO: 6834 - protein, 408 aa, Burkholderia xenovorans LB400
MAEPKTRPAPLAGITVLDFSKVLAGPVCTQILADMGADVIKVESIEGGDDTRRWPPFRKEGDNQDGTVFLSANRGKRSIAVDLKSTGGRAVIRRLAESADIVIESFGPGVAQRLGVDAGTLHEINPRLVHCSISGFGTEGPMRFAKGYDVILQAFSGMLGIIGNPGDPPIRVPFSPIDQATGYHAVTGILAALFERNRTDRGTAVEASLFDSSVSFMGYLLQSFWERGTEPERHGSGHESLCPYEAFATADKPIMLGIANDALWRSFCELAGIAELGRDPRFATNADRVSNRKETVALVRDILSRRPRDEWVDSLNNAGIPCSPIHTLAELSEHPQLVESGMRLDYGHPTYGKLSGVAQAVKFNGQRATAELPPPLFGEHTREILRRLKLSDHEIDAMRNAGHVFTLT

SEQ ID NO: 6835 - DNA, 1188 bp, Burkholderia xenovorans LB400
  CDS (1)..(1188): transl_table=11
atgaccggcattctgcagggcattcgggtactcgacatgacacagatggtcgccggaccgctctgtaccatgctcctgggcgacctcggtgctgacgtaatcaaggtcgagccgcctggcggcgacagtagccgcggtattggactgaaccgtccatgtggtgaaagcgattattttctgagcgtgaaccgcaacaaacgcggtatcgtactcgacctgaaaaaggcggaagacgttgcgaccttcagggctctcgcggacacttccgacatcctggtcgaaaacttccggcccggcactctcgagaagctcggcatcggcttcgagacgcttcgacaaaccaatccgaggctaatctattgcggaatgtcgggattcggtacggacggtccataccgtgaccgccccgcccttgatccggtcattcaggccatgtccggcatcatgcagttgaccggcacggctgccagcgggccgttgaagaccgggatactcacatcggactttgttccgccgctgttcggcacaattggcattattggagcgctgtacgcgcgcgcgtccaccggccaggggcagcgcgtagacgtttcaatgcttgatgcgaccgtgttttcaatgttaccgcgtgaaggattttacttctccaccggcaggacacccgaacgcctcggcaatgcgcattaccagttggcgccgtggaacagttatgccacaagtgacggccggcacctgattatcgtcgcgcacaccgacaagtactggcgcgcgctgcttggtgcgatcggtcatgggccgctcgcggcggatccgcgcttccttaccaatgcgctgcgacttgcaaaccgcgaggcacttgatgcgttgatcagcgaagcgtttgccaccgaaagcctcgccacgtggtctgaacgcctgacagcggccggtgtgctcttcgcgccggtacgcgactttgatgaggttttttcggatccggcggtacgcgatacgatggtcgcccagataccgcatccgactgctggagagatttccgtgttgcgcaatcccattcggctgtcggacaacccgacttcgatacgagccgcgccgccgttgctcggacagcataccggggaagtgcgcgcagagctcgcacaggccgcaagcaccttggaacatcaacgtgtatcaggagcacagagatga

SEQ ID NO: 6836 - protein, 395 aa, Burkholderia xenovorans LB400
MTGILQGIRVLDMTQMVAGPLCTMLLGDLGADVIKVEPPGGDSSRGIGLNRPCGESDYFLSVNRNKRGIVLDLKKAEDVATFRALADTSDILVENFRPGTLEKLGIGFETLRQTNPRLIYCGMSGFGTDGPYRDRPALDPVIQAMSGIMQLTGTAASGPLKTGILTSDFVPPLFGTIGIIGALYARASTGQGQRVDVSMLDATVFSMLPREGFYFSTGRTPERLGNAHYQLAPWNSYATSDGRHLIIVAHTDKYWRALLGAIGHGPLAADPRFLTNALRLANREALDALISEAFATESLATWSERLTAAGVLFAPVRDFDEVFSDPAVRDTMVAQIPHPTAGEISVLRNPIRLSDNPTSIRAAPPLLGQHTGEVRAELAQAASTLEHQRVSGAQR

SEQ ID NO: 6837 - DNA, 1290 bp, Burkholderia xenovorans LB400
  CDS (1)..(1290): transl_table=11
atgacggatgacgcgttcggcagcctgcgcggactggtcgtgctcgacctgacgcagatgctggccggcccgttctgcacgcagatgctggccgaccacggtgccgaggtcatcaagatcgaaccgccggaaggtgacgcgacgcgtcacttcgggccgttccatcccgctgacacgctgcggtcgcatggcggctactaccagagcgtcaatcgcaacaagaagagtgtggtgatcgacctgaaatcggcggacggatgccgcgatttcatcgcgctcgcgcgccaggccgacgtggtggtcgagaacttccgcgaaggcgtgctggatcggctcggcgtcggctacgggatgctctcggccgagaatccgcgcctgatctatgcgtcggtacgcggattcggcgatcgccacggcggcagcggcatcagtccgtacaccgagtggccggcgttcgacgtggtcgcgcaggcgatgggggggctaatcggaatcaccggactcgacaagacctccgtcgtgaagaccggtcccggcgtcggcgacatcatgccgggtctgcttgccgcgttcggcgtgctggccgcgtgtcgtgaccgcgagcgcaccggcctcggccagtacgtcgacgtctcgatggtcgacacgatgttggcgctgtgcgagcgcatcgtccaccactactcgtacgcgcacgtggtgtgcgagccagaaggcggcaaccacccgatgttcgcgccgttcgggctgtttccggcgctcgacggcgtagtctcgatcggctgcgtcgcgcagcatcagtgggggctgctgtgcgacatcatgggccgcaccgacctgcgcgacgatccgacgttgagcgacggtccgaagcgcttcgcgcggcgcaccgacatcacgagattcgtcagcgaattcacggtgcgccacaccaaggccgagctgatcgcgctgctcggcggcaagatcccgttcggccccgtgtacaacgccgctgacatcttcgacgacccccacttcgcggtgcgcgagatgctcccgcgcgtcgcccatcccggcatcagcgaaccgctggcgatcgccggcgtgccgctgaagctgtcgcgcacgccggggcgtgtggcccggggcgccgcacaactcggcgagcacaccgccgaggtgctcgctcgcgtgcgcccgctgcaaccatctgacacacccccatccgaagaccaccaggagaaagctgatgaagcaagtgaaggaacgtccacgccgcgtgcagctagcagtaccgggcagcaatga

SEQ ID NO: 6838 - protein, 429 aa, Burkholderia xenovorans LB400
MTDDAFGSLRGLVVLDLTQMLAGPFCTQMLADHGAEVIKIEPPEGDATRHFGPFHPADTLRSHGGYYQSVNRNKKSVVIDLKSADGCRDFIALARQADVVVENFREGVLDRLGVGYGMLSAENPRLIYASVRGFGDRHGGSGISPYTEWPAFDVVAQAMGGLIGITGLDKTSVVKTGPGVGDIMPGLLAAFGVLAACRDRERTGLGQYVDVSMVDTMLALCERIVHHYSYAHVVCEPEGGNHPMFAPFGLFPALDGVVSIGCVAQHQWGLLCDIMGRTDLRDDPTLSDGPKRFARRTDITRFVSEFTVRHTKAELIALLGGKIPFGPVYNAADIFDDPHFAVREMLPRVAHPGISEPLAIAGVPLKLSRTPGRVARGAAQLGEHTAEVLARVRPLQPSDTPPSEDHQEKADEASEGTSTPRAASSTGQQ

SEQ ID NO: 6839 - DNA, 1218 bp, Burkholderia xenovorans LB400
  CDS (1)..(1218): transl_table=11
atgacggcacccgtgaatgccggcacacaaggcgcgctgcaaggcatcaaggtgatcgacctgagccgcgtgctcggcggcccgtactgcacccaggcgctcgccgatcacggcgcgcaggtgatcaagctcgaaccgccggacggcgacgaaacacgcggctgggggccgccgttctatggcgacaccgcatggtatttcgccggcgtgaaccgcaacaagcagggcatcgcggtcgatctttcacgcgacgaaggccgcgcgattctctggaagctgctcgaagacgccgacgtgctggtcgaaaacttcaaacccggcacgctggcgcgctggggcatggactacgagcgcgatttgcgcgagcgtttcccgaagctgattcattgcgccgtgtcggggttcggtcccgatggcccgctcggcggcctgcctggctacgatgccgcgattcaggcaatgaccggcctgatgagcgtgaacggcgagcgcgacggccccgccatgcgcgtcggcttgccggtggtcgacatggtcaccggcctgaatgcgttcgccggcgttctgctcgcgctcgccgagcgcgcgaagagcggccgtggccagtcgatcgatatcgcgctgtacgactgcggcgtttcactgctgcatccgcatctgccgaactatttcggctcgggccgcacgccgcagcgcagcggcaacgcgcatcccaacatcacgccatacgacagctatcgcaccgcgagcgcgccgatctttctcgcggtgggcaacgaccggcagttcgcgaagctctgcgcgcatctcggcgcgcccgaactcgccgacgatccgcgttatgtcgacaaccgcagccgctgcgcgcatcgcgagccgctcaaggccgcgctggaaagcctgctcgccgcgcacgactgcgaaccgctcgcgcacgcgctgatcaacgcgggcgtgccgtgcggaccggtgcaaaccgtggacgtggtggcgcggcatccgcacaccttgcatcgcggcatggtggtcgagatgggcgagtatcgcggcaccgcgtcgccgatcaagctgtcgcgcacgccggccacgtatcgcagcgcgccgccgtcgctcggtgccgacacgcgcgacgtgctcgacgcattgggtatcgacgccgccacccagcggcgtctgttcgaagcgggcgtgctgaaagcgggcgcacctgaagcataa

SEQ ID NO: 6840 - protein, 405 aa, Burkholderia xenovorans LB400
MTAPVNAGTQGALQGIKVIDLSRVLGGPYCTQALADHGAQVIKLEPPDGDETRGWGPPFYGDTAWYFAGVNRNKQGIAVDLSRDEGRAILWKLLEDADVLVENFKPGTLARWGMDYERDLRERFPKLIHCAVSGFGPDGPLGGLPGYDAAIQAMTGLMSVNGERDGPAMRVGLPVVDMVTGLNAFAGVLLALAERAKSGRGQSIDIALYDCGVSLLHPHLPNYFGSGRTPQRSGNAHPNITPYDSYRTASAPIFLAVGNDRQFAKLCAHLGAPELADDPRYVDNRSRCAHREPLKAALESLLAAHDCEPLAHALINAGVPCGPVQTVDVVARHPHTLHRGMVVEMGEYRGTASPIKLSRTPATYRSAPPSLGADTRDVLDALGIDAATQRRLFEAGVLKAGAPEA

SEQ ID NO: 6841 - DNA, 1218 bp, Ralstonia metallidurans CH34
  CDS (1)..(1218): transl_table=11
atgagcgcaatcctgcagggcatcaaggtactggacctgacccgtgttgtggccgggccgtgggctactcagaacctggcggacatgggtgccaccgtctacaagatcgagaaacccggtgatggcgatgacacgcgtcggatggggccattcctgaccgacggcgatggcaacgtgacgaacgactccgcgttcttcctctgctgcaaccgtggcaagcaatcggtcaccgtcgatatttcgcagccggaaggcgccgaactggtacgccaactggcatcgcattgcgatgtcgtcgtggagaactacaaggcgggcagcctgaagaagtacggactcgactacgagagcatccgtgcgctgcgtcccgacatcatctattgctccgtgaccggctttggtccggatggcccttacgcgccccgccccgcatacgacttcatcctgcaaggcatggcggggctgatgagcacctgcgggcagcccgatggcacgcccggcgcggcgccgatgcgaaccgcgattccactgacggatatcctcacggggctgtatgcatcggtggcactgatgggcgcgctctatcaccgtcaggctaccggtgaggggcaattcatcgatgccgcgatgatcgatgccgcagtggccgccaacggccatctcgcgctgggctatcacatgacgggaaaggtgccgcagcgcgccggcaactccaatccggtggcatcgccttcggaggtgttcgcctgccttgacggccacgtcatcatcgccgccggcaacaacggtcagttcgcggcgttgtgccgcgtgatcgggtgtgcgtcgttgatcgaagatccgcgattcctgcagaacatggaccgcgtacgaaatcgcccggttctgcgcgagacattgggtgagcgtctgctgaactggcgtcttgccgacctgattcaggccctggaaggcgcaggcgtgccatgtggcccgatcaacgacatcgacgacgttttcgacgatccgcaagtccggcaccgcgaactgctggtacgcctgccgcacggcagtggtgtcgaggcgccgacgctgcgcagcccactgcgcttctctgccacgccggtcacgatgaccgcgccaccgcaacttggccagcacaccgaagccgcgctccggagcgaattgggaatgtcggcagcggacgtggaggccttccgggagagaggcgtgatctga

SEQ ID NO: 6842 - protein, 405 aa, Ralstonia metallidurans CH34
MSAILQGIKVLDLTRVVAGPWATQNLADMGATVYKIEKPGDGDDTRRMGPFLTDGDGNVTNDSAFFLCCNRGKQSVTVDISQPEGAELVRQLASHCDVVVENYKAGSLKKYGLDYESIRALRPDIIYCSVTGFGPDGPYAPRPAYDFILQGMAGLMSTCGQPDGTPGAAPMRTAIPLTDILTGLYASVALMGALYHRQATGEGQFIDAAMIDAAVAANGHLALGYHMTGKVPQRAGNSNPVASPSEVFACLDGHVIIAAGNNGQFAALCRVIGCASLIEDPRFLQNMDRVRNRPVLRETLGERLLNWRLADLIQALEGAGVPCGPINDIDDVFDDPQVRHRELLVRLPHGSGVEAPTLRSPLRFSATPVTMTAPPQLGQHTEAALRSELGMSAADVEAFRERGVI

SEQ ID NO: 6843 - DNA, 1224 bp, Ralstonia metallidurans CH34
  CDS (1)..(1224): transl_table=11
atgatcaagccactttcccatattcgagtactggacttgacgcgtgtgctggccgggccctggtgtacgcagaatctcgccgacctgggtgcggaagttatcaaggtggaacgaccagaagtcggcgacgagacgcgcggatggggaccaccatggctgccggccgcggaagagtccgaacgccgcgactccagctactacgcctcagccaaccgcggcaagaagtcgattaccgtgaaccttgcaagtgctgacggccaagcgatcatccgtcgccttgcggcgagcgccgacgtgctggtcgagaactacaaggtcggtacgctcgcgcgctacgggctgggctatgacgacctacgagaggccaatccaggtctggtgtactgctccgttactggcttcggacagactgggccataccggcatcttccaggctacgacttcgtcttccagggcatgggtggcctgatgagcattaccggggagcgcgacgacctgcctggcggcggtccgcagaaggtcggtatcgcggtggccgacattacaactgggatgtatgccagcctggccatagccgccgccctcacatggcgtgagcgtagcggccagggccagcatatcgatatggcactgctcgattgcatgctcgccttcaacagcaatcaggccgtcagctacctcgtctcaggcaagcttccgaaacggcagggcaacgcacatgccaacgccgtcccctatcaggtcttcgatagtctggatggcaagctcattgtcgccgtgggcaacgatagtcagtttgccgcctattgccgcgcagtcggcaagccggagttggccatcgacacacgttttgccaaggtgaccggacgcattgtcaaccgcgaggtgctcctgcccatgctggtggatgtgatgcgtaccgattccaccgcatcatggcttgcccgactcaaggctgccggcgtgccatgcggccctgtcaacgacttcagccagacattcgaggacccgcaggtacggcaccgcggcatccgcgtggacctgcctctaccggatggcggcatttgcccgtcgattgcgagcccgatgcgcttctctgccacgccgcttgaacacagtgcggcgccgccagccctgggtgagcacactgacaccgttctgacggagtgtctgggcttgctacctgccgaactttcccgcctgcgcgaggccggggccatctga

SEQ ID NO: 6844 - protein, 407 aa, Ralstonia metallidurans CH34
MIKPLSHIRVLDLTRVLAGPWCTQNLADLGAEVIKVERPEVGDETRGWGPPWLPAAEESERRDSSYYASANRGKKSITVNLASADGQAIIRRLAASADVLVENYKVGTLARYGLGYDDLREANPGLVYCSVTGFGQTGPYRHLPGYDFVFQGMGGLMSITGERDDLPGGGPQKVGIAVADITTGMYASLAIAAALTWRERSGQGQHIDMALLDCMLAFNSNQAVSYLVSGKLPKRQGNAHANAVPYQVFDSLDGKLIVAVGNDSQFAAYCRAVGKPELAIDTRFAKVTGRIVNREVLLPMLVDVMRTDSTASWLARLKAAGVPCGPVNDFSQTFEDPQVRHRGIRVDLPLPDGGICPSIASPMRFSATPLEHSAAPPALGEHTDTVLTECLGLLPAELSRLREAGAI

SEQ ID NO: 6845 - DNA, 1236 bp, Ralstonia metallidurans CH34
  CDS (1)..(1236): transl_table=11
atgcaaaaaatggaagccaataagtttcgcccgctggctggcgtaaaagtgcttgagttgtcacagattctggccggccccacctgtgggctgatgcttggcgatctcggggccgacgtggtcaagatcgagcgatttcccgccggggacgacgcgcggaagtaccgccggcagggcgacagcggattgccgccttccttcctgattgtcaatcgcggcaagcggtcgctcggactcgacctgcgcaaggaagagggcaaggcggtgctcaagcggatggttgcccaggccgatgtgctgaccgagaactttcgtctgggagtgatggagaaactgggccttggctacgacgtgctgcgcgaggtgaatccggccctgatctactgctcgatcaccggatacggacggacggggccgctcgccagcaaaggtggtttcgacctgattctgcaggcgttctcggggctcatcagcgtgacaggagagcccggccgcgacccggtcaagccgggcatgtcgatcgccgacgtcaatgccggcatcctggccgcattcggtatcctggcggcgtacatcaaccggctacgcacgggcgagggctcgcgcgtcgagacctcgctgctgcaggcatcgatgcagcagctttactggtacgcggcggcctacttctcgaccggggcgattgcgaagccggtcggcacggcgcatccgctcatcgcgccttaccaggtgtatcaatgcgctgatggcggtatcgcgctcgggggcgccaatcagaccaactgggagcgcatcgccgatgtgctgggccatccggagtggaaggccgatccgcgtttcgacagcgcggcggaaagactcgcgcgccgtgccgagctcgaactgctgatcaccgatgtcctgaagggcgcgccggtggcgacgtgggtggagcgattcgatgccgtgggggtgcctgtcggcccggttcagaacgtggcgcaggcactggagcatccgcaggcgaaggcagtcgggatggtcgtggaagcccgcaagccaggcggcggcatgacgcgcgcgctggggctacccgtcctgttcgacgggggcaacgccagttcgaccggcccggcccccgcgctgggcgagcattccagttcagtgctgcgggagtttggatttgccgcgggagagatcgaggacctgctgcgcaacgccgtggtccacgactgcgctcatccggtcgcggcgtga

SEQ ID NO: 6846 - protein, 411 aa, Ralstonia metallidurans CH34
MQKMEANKFRPLAGVKVLELSQILAGPTCGLMLGDLGADVVKIERFPAGDDARKYRRQGDSGLPPSFLIVNRGKRSLGLDLRKEEGKAVLKRMVAQADVLTENFRLGVMEKLGLGYDVLREVNPALIYCSITGYGRTGPLASKGGFDLILQAFSGLISVTGEPGRDPVKPGMSIADVNAGILAAFGILAAYINRLRTGEGSRVETSLLQASMQQLYWYAAAYFSTGAIAKPVGTAHPLIAPYQVYQCADGGIALGGANQTNWERIADVLGHPEWKADPRFDSAAERLARRAELELLITDVLKGAPVATWVERFDAVGVPVGPVQNVAQALEHPQAKAVGMVVEARKPGGGMTRALGLPVLFDGGNASSTGPAPALGEHSSSVLREFGFAAGEIEDLLRNAVVHDCAHPVAA

SEQ ID NO: 6847 - DNA, 1245 bp, Ralstonia metallidurans CH34
  CDS (1)..(1245): transl_table=11
ttgaataagaccaacaacatgcctggccggacccacatacccctcatgcaaaagccgcttcgcaatatccgcgtgctcgacctcaccaacgtgctggccgggcccttctgctgccaccagctcgcccacatgggggctgaggtgatcaaggtggaaacgcccggcacgggcgacctcgcacgtcagcttggcgccgatgccgagctgaaccgcaagctgatgggcgtctcgttcctggcgcagaaccccggcaagcgctcgatcacgatcaacctcaagcacgcgcgcggcaaggaagtcttccgcaagctggtgcagagcgccgacgtcgttgtcgagaacttccgccccggcgtgatgacgcgcctgggcctgggctacgacgaactcaagctggtgaacccgcgcctgatctactgcgcgatctccggattcggccaggatgggccgctctccgacctgccggcctatgaccagatcatccagggcatggcaggcgtgatgagcatcaccggcgacccgcagaccgcgccgtatcgcgtcggttatcccgtctccgacaccatcggcggcatgaccgcggccttttccatcgccgcctcgctggccgataccgaacgcacggaaggctacttcctcgacgtatcgatgctggaagccacgctggtcacgatgggctgggtggtttccaaccatctggtggcgggcaaggaccctgccccgatgggcaacgagaacatgacagcgagcccgtctggcacgttccgcactggcgacggcccgctcaatatcgcggccaacaagcaggagcagttcgaagcggtgtgccgcgtggtgggccgccccgagctcgcgaccgacccgcgctttgccgagcgccagtcgcgcctggcgaaccgcgcggcgctgaccgccgaactggaagcggaactggcgaagaagtccgccaccgactggtggcaactgctcaatgaggctggcgtgccggccgggccggtgctgaaggtgccggacacgctcgcacttccgcaggtgcgcgaccgcggcatgatcggcgcgttcgaaaacgtgcctggcgtgggtcgcgacatccgcctgctgcgcaccggtttcaaggtcaacgggcaggcaccgtccgtggacacgcccccgccgcaactcggcgagcataccgacgacatcctcggcgaactcggctatgacgccgccgccatcgacaccctcaaacaggagcgcgcgctatga

SEQ ID NO: 6848 - protein, 414 aa, Ralstonia metallidurans CH34
MNKTNNMPGRTHIPLMQKPLRNIRVLDLTNVLAGPFCCHQLAHMGAEVIKVETPGTGDLARQLGADAELNRKLMGVSFLAQNPGKRSITINLKHARGKEVFRKLVQSADVVVENFRPGVMTRLGLGYDELKLVNPRLIYCAISGFGQDGPLSDLPAYDQIIQGMAGVMSITGDPQTAPYRVGYPVSDTIGGMTAAFSIAASLADTERTEGYFLDVSMLEATLVTMGWVVSNHLVAGKDPAPMGNENMTASPSGTFRTGDGPLNIAANKQEQFEAVCRVVGRPELATDPRFAERQSRLANRAALTAELEAELAKKSATDWWQLLNEAGVPAGPVLKVPDTLALPQVRDRGMIGAFENVPGVGRDIRLLRTGFKVNGQAPSVDTPPPQLGEHTDDILGELGYDAAAIDTLKQERAL

SEQ ID NO: 6849 - DNA, 1242 bp, Ralstonia metallidurans CH34
  CDS (1)..(1242): transl_table=11
atgcaaacccacgcagacacccagacccatccccccggcgcccttgccggcctgcgcgtggtcgacctcacgcagatgctcgccggaccgttctgcacccaggtgctggccgatcacggcgcggacgtgatcaaggtggaagcgatgaccggtgatggcacccgcatcaccggccccttctgtgacgacgacacgctgcgcgaattcggcggctacttccagagcgtcaatcgcaacaagcggtcgatcgcggtggacctcaagagcagcactgggcgcgagatcctgcgcaagctgatagacagcgccgacgtcgtggtcgagaactttcgcgccggcgtcatggagcgccttggcctgtcctacgaaaccctgcgcgaaaccaatccgcgtctggtctatggcacggtacgcggcttcggcgacccacgcagcggcgaaagcccctacgcgcagtggcctgcctacgacgtcgtgtcgcaggcgatgggcggcatgatgggcatcaccggccccgaccgggacactgctacgaagatcggcccgggcgtcggcgatacgatacctgcgctgatgctctgcattggcattctctccgccgtgcaccgcgcgcgcggcaccgggcacggtcagttcgtcgatgtggccatgaccgatgcggtactggccatgtgcgagcgcatcgtctaccagacgtcctacaccggcgtggtaccagcgcccgaaggcaaccgccacccgttgctctgccccttcggcctgttccgctcgcgcgacggccaggtctcgattgcctgcgccaccgatgcattctgggaaaagctggccatcgccatcggccgcccggacatggccaccgacgaggcgttcgccaccaatgcagcccgcgtgcagcaccagcagcaggtcatcgacgcgatcgaagcattcaccaccgtgcgcacaaaggaagagatcgctgccgttctcggcggcaaggtgccgttcggcccggtctacaccgccgcggagatctttgctgacccgcactacgcggtgcgcgagatgctggtcgaagtcgaacagcccggctcggccagaccggtgaagatcgccggcgtgcccatcaagctgagcgacacccctggcgcggtacgtcggcgcgcgccgctgctgggcgagcacaccgaggaaatcctgctggccaccggctacaccgaacgggacatcaagggcctgcgggagacaaaagccgttcgctag

SEQ ID NO: 6850 - protein, 413 aa, Ralstonia metallidurans CH34
MQTHADTQTHPPGALAGLRVVDLTQMLAGPFCTQVLADHGADVIKVEAMTGDGTRITGPFCDDDTLREFGGYFQSVNRNKRSIAVDLKSSTGREILRKLIDSADVVVENFRAGVMERLGLSYETLRETNPRLVYGTVRGFGDPRSGESPYAQWPAYDVVSQAMGGMMGITGPDRDTATKIGPGVGDTIPALMLCIGILSAVHRARGTGHGQFVDVAMTDAVLAMCERIVYQTSYTGVVPAPEGNRHPLLCPFGLFRSRDGQVSIACATDAFWEKLAIAIGRPDMATDEAFATNAARVQHQQQVIDAIEAFTTVRTKEEIAAVLGGKVPFGPVYTAAEIFADPHYAVREMLVEVEQPGSARPVKIAGVPIKLSDTPGAVRRRAPLLGEHTEEILLATGYTERDIKGLRETKAVR

SEQ ID NO: 6851 - DNA, 1185 bp, Ralstonia metallidurans CH34
  CDS (1)..(1185): transl_table=11
atgttgcatcgcgcattggaaggcattcgcgtgctggacctgtcgcgcatcctggctgggccgtggtgtacgcagaacctcgccgatctgggcgccgaagttgtcaaggtcgaacatccgcagcgtggcgatgacacgcgcggttggggccccccgtatctggatgccgcggatggcagcgacgcgcgcctttccgcgtacttcatcagctgcaatcgcggcaagcagtcggtgtgcatcgactatggccagcctgaaggtgtcgcgcaattgctggagctggcccgccacgccgacgtgctggtggagaactacaaggtggggacgctcaaacgctacgggctcgactatgcgtcgctcaaggcgatcaatccgcgtctgatctatctgtcgatcacggggttcggtcaggacggcccgatggccgacaagcccggctatgactacgtgttccagggtatgggcggactgatgagctacaccggccagccggatggtagccccggcgctgggccgttgcgcacgggcgtggcagtggtcgatgtcagcacgggcatgtatgcgacgagtgccgtgctggcggcgctgttccagcgtcagcagaccggtgaaggccagcatctcgatatcgcactgctcgacgtggccgtcgcactgaatgcgaatcagggcgccaactacctggtatcgggaaagaacccgcaacgcacgggcaacgcgcatccaaactgcgcgccgtatgaggtcttccgatgcgccgatggttatctgattctggcgatcggcaacgacacgcagttcgcacgcttctgtgatgtggcggggcgtccggatctcgcgcaagacccgcgctacgtcacgaactcaggccgcatcgaacatctcaccgaactgcgcaaggtactgacggcgttgttcccgacgcgctcgcgtgccgactggacgtcggcgttcgacgccgccggtgtgccctggggcccgattcatacgatggaagaggtcttcgcgcatccgcaggtccagcatcggcaattgcgtcaggtggccacgcatccggtgacgggcgaggtgccaatggtgcgcaatccgatgctgccggccaatccgcagccgctcaagccaccgccgctgctcggcgaacacacgggcgtcacagcagtggccgccatcgctgccgcgcgatag

SEQ ID NO: 6852 - protein, 394 aa, Ralstonia metallidurans CH34
MLHRALEGIRVLDLSRILAGPWCTQNLADLGAEVVKVEHPQRGDDTRGWGPPYLDAADGSDARLSAYFISCNRGKQSVCIDYGQPEGVAQLLELARHADVLVENYKVGTLKRYGLDYASLKAINPRLIYLSITGFGQDGPMADKPGYDYVFQGMGGLMSYTGQPDGSPGAGPLRTGVAVVDVSTGMYATSAVLAALFQRQQTGEGQHLDIALLDVAVALNANQGANYLVSGKNPQRTGNAHPNCAPYEVFRCADGYLILAIGNDTQFARFCDVAGRPDLAQDPRYVTNSGRIEHLTELRKVLTALFPTRSRADWTSAFDAAGVPWGPIHTMEEVFAHPQVQHRQLRQVATHPVTGEVPMVRNPMLPANPQPLKPPPLLGEHTGVTAVAAIAAAR

SEQ ID NO: 6853 - DNA, 1224 bp, Ralstonia metallidurans CH34
  CDS (1)..(1224): transl_table=11
atgagcaaggcgcttggccatatcaaggtgctggacctgtcccgtgtgctggccggaccctgggccacccagaatctggcggacatgggggccgaagtcatcaaggtggagcgacctggcgccggcgacgacacgcgcggctgggggccgccgttcctgaaggacccgcaaggcaacgagaccgatgattcgtcgtacttcctcagcgcaaaccggggcaagaaatcgatcacgatcgaccttgcatcgccaaagggccaggacatcatccgggcgctggcccgcgaatgcgatgttgtggtcgagaactacaaggtgggcacgctggctcgctatggcctgtcctacgaagacctgcgcaagctcaacccgcgtctggtgtactgctcgatcacgggattcggtcagaccgggccctatgcggcattgccgggctacgacttcgttttccagggtatgggcggtctgatgagcatcaccgggatgccggatggcgagcccggcgccggcccggtgaaatccggcatcgccatcacagatctgctcaccggcatgtacgccacatcggccatccttgccgcgcttgagcaccggaacgtcagcggagagggccaatacatcgatatctcgttgctcgattgcgtggtcaccatcaattcgtaccaggccatcaactactttctgtccggcaaggtcccccagcggatgggcaatgcgcactcgaacatggtgccgtaccaggtattccgctgcaaagagggtgacgtcatcgtggcggtcggcaacgacacccagtacgcggcgttctgcggcgtcatcgggcgtcccgatctggcggaagatgcccgatttaccactgcagcacagcgcaaccgaaatcgggagacgctgattccccaggttgccgaggcgatgctggccagaaccatgacggaatgggtgacgctgatggaagcggcgaacgtgccttgcggaccgatctacaacatgaaacaggtgttcgaagacccgcaggtcaggcatcgggacatgcagctcgttctggagcacagcagcggttcgaaagccccatcgcttgcgaatccgattcgtttctccgatacgccgattcgctaccaacgctccgcgccaaccctgggtgaacacaccgacagggttctgcaggacatgcttgccttttcagccgagaccatcgacgccttgagggagcagggcgtgatctga

SEQ ID NO: 6854 - protein, 407 aa, Ralstonia metallidurans CH34
MSKALGHIKVLDLSRVLAGPWATQNLADMGAEVIKVERPGAGDDTRGWGPPFLKDPQGNETDDSSYFLSANRGKKSITIDLASPKGQDIIRALARECDVVVENYKVGTLARYGLSYEDLRKLNPRLVYCSITGFGQTGPYAALPGYDFVFQGMGGLMSITGMPDGEPGAGPVKSGIAITDLLTGMYATSAILAALEHRNVSGEGQYIDISLLDCVVTINSYQAINYFLSGKVPQRMGNAHSNMVPYQVFRCKEGDVIVAVGNDTQYAAFCGVIGRPDLAEDARFTTAAQRNRNRETLIPQVAEAMLARTMTEWVTLMEAANVPCGPIYNMKQVFEDPQVRHRDMQLVLEHSSGSKAPSLANPIRFSDTPIRYQRSAPTLGEHTDRVLQDMLAFSAETIDALREQGVI

SEQ ID NO: 6855 - DNA, 1248 bp, Ralstonia metallidurans CH34
  CDS (1)..(1248): transl_table=11
atgtccgattcccctgcaatcgcgccgggtgcgttgtccggcctgcgtgtgctggaactcgcgcagatcatggccgggcccacctgcggcatgatgctggccgatctcggcgccgacgtgatcaagatcgagaagatcgatggtggcgacgacgcgcgtggctatcgcgagccgaccatcaacggcgtgtcggcgccgttcctgatgctgaaccgcaacaagcgcggcatcgcccttgacctgaagacacccgaaggccgcgaggtgttcctgcgcatggtgcgcaacgccgacgtggtgattgagaacttccgcaagggcacgctggagaagctcgggcttggctacgacacgctgtcgcgcgagaacccgggcctgatttattgcgcgatctcgggctatggccgcaccgggccgttcgccgacaagggcggcttcgatctgatcgcgcagggttacacggggcttatgagcattacgggcgaggagggcgggccgccgctgcgcaccgggaattccatcgccgatatcaatgcgggcatcctggcggcgttcggcattcttgccgcgtatcagcatcggcagaagaccgggcgcgggcagatcgtggaaacgtcgctgatcgaggccggcctgcagcagctctactggcacgcggcgatccatttcgccacgggcgagtcgccggggccgagcgggtcggcgcacgtgctggccacgccataccaggcatttccgacgcaggacggccatatcatcgttggcggcgcgaacgagaagaactgggcgcgtatcgcacaggttctcggacatccggaatgggtcgaagacccacgttttcggcgcaacgccgaccggatgcgtcatcgcgacacgttgcttccggagatggccggcatcctgatgacgcgcccgtccgctgactggctggcggcattcgatgcagcgggcgtcccggccggacccgtgcattcgattggcgaggcactgaaccatccgcagacgctggcgcgtggcatggtggtacggcaacagcacgcggaagccgggccgatccggacgctggggctgccgatacagctatcggaaacgccggcgcagtaccatcgcccgtcaccgaggctgggcgaacatacgcggacgttgctggcggaatgtggttatggcgaggcggagatcgaggcgatgctcgaagccggcgtggtcacggagacggccgcatcggcggcgaccgtgaccgagatatag

SEQ ID NO: 6856 - protein, 415 aa, Ralstonia metallidurans CH34
MSDSPAIAPGALSGLRVLELAQIMAGPTCGMMLADLGADVIKIEKIDGGDDARGYREPTINGVSAPFLMLNRNKRGIALDLKTPEGREVFLRMVRNADVVIENFRKGTLEKLGLGYDTLSRENPGLIYCAISGYGRTGPFADKGGFDLIAQGYTGLMSITGEEGGPPLRTGNSIADINAGILAAFGILAAYQHRQKTGRGQIVETSLIEAGLQQLYWHAAIHFATGESPGPSGSAHVLATPYQAFPTQDGHIIVGGANEKNWARIAQVLGHPEWVEDPRFRRNADRMRHRDTLLPEMAGILMTRPSADWLAAFDAAGVPAGPVHSIGEALNHPQTLARGMVVRQQHAEAGPIRTLGLPIQLSETPAQYHRPSPRLGEHTRTLLAECGYGEAEIEAMLEAGVVTETAASAATVTEI

SEQ ID NO: 6857 - DNA, 1140 bp, Ralstonia metallidurans CH34
  CDS (1)..(1140): transl_table=11
atgacgccactcacacccggcgcgctggcaggcattcgcgtagtcgatctgtcgcgcattctgggcggcccgctttgcggccagatcctcggcgatcacggcgcggacgtactcaagatcgagcctccgcagggcgatgacacacgcacctgggggccgccgttccgcgatggcgtggcgtcgtactacttcggcctcaatcgcaacaagcgcatcatgaagctggacctgacggccgacaccgaccgcgaagtcttgctgacgctgctggccgatgccgacgtgctgatcgagaacttcaagaccggcacgctcgagaaatggggccttggtttcgatgtgctgtcgcagcgcttcccccggctcgtgcattgccgcgtgtcgggcttcggcgccgatggtccgctgggtggactgccgggttatgacgcggcgatccaggcgatggccggcatcatgagcatcaacggcgaggccgaccgagaaccgctgcgcgttggtttgcccgtggtggacatggtcactggtctgaacgccgcgctgggcgtgctgctggcattgcaggagcgcgaacgcagcggccgtgggcagttcgtggaatcggcgctatatgactcgggcctgtcgctgctgcatccccatgcggccaactggttcatgagtggcaagacgcccgggcgcaccggtaacgcgcatccgaacatctacccgtacgacacggtggccaccgcgaccgatccgatcttccttgccgtcggtaacgaccggcaattccgcatcctgtgcgagtacctcggcgtggcggagctggccgacgacgaacgctttgcaacggcaggcgcgcgctcggtcaatcgggcgcaattgaagggcacgctggaatcgaagctggccacgtgggacggcaaggcgctggccgacgaactgtctgcggccggtgtaccgtgcgcaccggtgttgtcggtgcccgatgcactgacgcatccgcataccgcccatcgcgagatggtggtggagatgcccggcggttacaagggcctgggcgctccggtcaaactgagccgcacgccggcgacgtaccggtatgcaccgctgaccgaaggcaaccagttcctgccgcgcgaggcggcgaacgattga

SEQ ID NO: 6858 - protein, 379 aa, Ralstonia metallidurans CH34
MTPLTPGALAGIRVVDLSRILGGPLCGQILGDHGADVLKIEPPQGDDTRTWGPPFRDGVASYYFGLNRNKRIMKLDLTADTDREVLLTLLADADVLIENFKTGTLEKWGLGFDVLSQRFPRLVHCRVSGFGADGPLGGLPGYDAAIQAMAGIMSINGEADREPLRVGLPVVDMVTGLNAALGVLLALQERERSGRGQFVESALYDSGLSLLHPHAANWFMSGKTPGRTGNAHPNIYPYDTVATATDPIFLAVGNDRQFRILCEYLGVAELADDERFATAGARSVNRAQLKGTLESKLATWDGKALADELSAAGVPCAPVLSVPDALTHPHTAHREMVVEMPGGYKGLGAPVKLSRTPATYRYAPLTEGNQFLPREAAND

SEQ ID NO: 6859 - DNA, 1149 bp, Silicibacter sp. TM1040
  CDS (1)..(1149): transl_table=11
atgttagcccccctcgacggattgatcattctcgacctcacacatgttcttgccgggccctatgcctccatgacgctttcggatctcggcgcgcgggtcatcaaggtggaacgccctggcgttggtgacgacacccgcgcctttccgccgttcaaagacggcgagagcgcctattttgcaaccatcaatcatggcaaggaaagcatcgcgctcgacctcaagaatgccaaggaccgtattgtttttgaagagctacttcaaaaatcggatgtggttcttgagaactatcgccccggtgtgatggaacgcctcggatatggttgggatgaccttcaccccaagtaccccaagctcatctatggtgcggtttccggctttggtcacagtggtcccgacagtcagcgccccgcctacgacatggtggtgcaggcccgcggcggcgtgatgtcgatcaccggtgaacgagaccgcgaacctgtgcgcgtgggcgcctctatcggagacatcgccgccggtatgtttctggcgcaagggatcctggccgccctgttgcagcgcgagaaaaccggtgaaggacaaaagatcgacattgccatgcttgattgccaactcgccatgctggaacatgcaattgcactgaccaccataagcggcgaggcgccccggccctcgggggcaagacatccctcgattaccccgtttgagacctttcatgcggcagatgggctgtttgtaatcgcggcaggaaatgacgttctgtttgcccggctctgcgaggcattggagttgcccattgcgcaggatgagcgctttgccaccaatcccgcaagatgcgaaaatgcgcgccttctcaagcggttgatcgaagcagttacactggagcatggcaaacggcactggatcgacctactgaccaaagctggggtgcccacagggccgatacagaatgtggccgaggtgctggaggacccgcagatccgggcacgcaacatggtggtggatgtgctcgatcgggacggaaacccggcctatgtggcggcaggcaacccaatcaagatgagcgcgctcaaggacccaagcacccgccccgccgcacccaagctggacgagaatcgcgaagagatcctgacgtggctgagagaggcctga

SEQ ID NO: 6860 - protein, 382 aa, Silicibacter sp. TM1040
MLAPLDGLIILDLTHVLAGPYASMTLSDLGARVIKVERPGVGDDTRAFPPFKDGESAYFATINHGKESIALDLKNAKDRIVFEELLQKSDVVLENYRPGVMERLGYGWDDLHPKYPKLIYGAVSGFGHSGPDSQRPAYDMVVQARGGVMSITGERDREPVRVGASIGDIAAGMFLAQGILAALLQREKTGEGQKIDIAMLDCQLAMLEHAIALTTISGEAPRPSGARHPSITPFETFHAADGLFVIAAGNDVLFARLCEALELPIAQDERFATNPARCENARLLKRLIEAVTLEHGKRHWIDLLTKAGVPTGPIQNVAEVLEDPQIRARNMVVDVLDRDGNPAYVAAGNPIKMSALKDPSTRPAAPKLDENREEILTWLREA

SEQ ID NO: 6861 - DNA, 1203 bp, Silicibacter sp. TM1040
  CDS (1)..(1203): transl_table=11
atgatggccgcatctgataccaccgcccccgcgcgtttgccccacggtgccctcaaaggcgtaaaagtgctggatctctcgcgcatcctggctggcccaaccgcaacgcaacttttgggagatctgggcgccgatgtgatcaaggtcgaaaacccaaccacgggcggcgacgacacccgtcaatggggcaagagcgtcgccgaagatgctgatctcacgccctatttcatggccgccaaccgcaacaaacgctcgctcgcgctggatatttctgcccccgaaggacaggccatcatccgacgcctcgccgcgcaagcagacgtcttgatcgagaacttcaaaccgggcgggctcgcgaaatatggacttgattacgcctccctgcgcgaaagctgcccacatctggtctatgcgtcgatttccggctatggccagaccggcccgaaccgtgcaaagcccggctatgatctgatggcacagggctatggcggtatcatgtcccttaccggcgaccccgaaggcgcgcctgtcaaggtcggggtcggcatcgcggatgtgatgtgcggaatgtatgcgaccatcggcattctctcggcattgcgccaccgcgatctcacgggcgaaggccagcaggtcgaacttgccctggtggatgcgcagatcgcctggctgatcaacgaaggtgtgagttacctcaataccggccagaaacccgtgcgacgcggcaatgagcacccctcgatcatgccctatggcacctatgaaacccgcgacggccatgtgatcctcgcagttgggaatgatagtcagtttcgccgatttatggcattccttgccctcgagggattggccgaagatccccgatttgccaccaatccggcccgtcttgagcatcgcggcgcactcaatgatatcctgatcccggcgctacagcgctatcgcaccgatgaggtcattgccgcgatggaagccgccaaggtgcccgtcggcccggtcaagacactcgatcaggtctttgagaccgatcaggttgccgcgcgggacatggtggtgacgatgcaggccggtgacaccgaggtgcggctcttgggcaatccgctcaagttctcgcgcacccccgtaacctaccgcaaggctccgcccagatgcggggcggacagcacggagattctcgcgtctgacgcgccctttgagaccgactga

SEQ ID NO: 6862 - protein, 400 aa, Silicibacter sp. TM1040
MMAASDTTAPARLPHGALKGVKVLDLSRILAGPTATQLLGDLGADVIKVENPTTGGDDTRQWGKSVAEDADLTPYFMAANRNKRSLALDISAPEGQAIIRRLAAQADVLIENFKPGGLAKYGLDYASLRESCPHLVYASISGYGQTGPNRAKPGYDLMAQGYGGIMSLTGDPEGAPVKVGVGIADVMCGMYATIGILSALRHRDLTGEGQQVELALVDAQIAWLINEGVSYLNTGQKPVRRGNEHPSIMPYGTYETRDGHVILAVGNDSQFRRFMAFLALEGLAEDPRFATNPARLEHRGALNDILIPALQRYRTDEVIAAMEAAKVPVGPVKTLDQVFETDQVAARDMVVTMQAGDTEVRLLGNPLKFSRTPVTYRKAPPRCGADSTEILASDAPFETD

SEQ ID NO: 6863 - DNA, 1188 bp, Rubrobacter xylanophilus DSM 9941
  CDS (1)..(1188): transl_table=11
ttgctgccgctagagaagataaaggtgctcgacctcacgcaggttatggccggcccgttctgctgccagcttctggcggacatgggggccgacgtcaccaaggtggagccgccggggaccggggaccaggcccgccggtccatgggcttcaccatgaagggggaggacaccgccgcctttctcgccgtcaaccgcaacaaaaagagcgtgaccctcaacctcaaggacggggaggcgcgcgagatcttctaccggctcgtgcgggaggcggacgtgctcgtggagaacttccgccccggcgtcaccaggaagctcggcatagactacgagacgctgaaagagatcaacccgcgcctcatctacgccagcatctccggcttcgggcagaccgggccctacgccgcgcgggccggctacgacctcatcgcccagggcatgtccggggtgatgagcgtcaccggcgagcccgggcggccgccggtgaagtgcggggtccccatcggcgacctctcggcgggcctgttctgcgccttcggggtgctcaccgcctacatcgcccgccagagcacggggcgcggccagtacatcgacacctccctcttcgagggggcgctcgcgctctccatctgggagaccgccgagctgtgggccaccgggcgcatcccgcagcccttcggctcggcccaccgcctcacggctccctaccaggcgctcaggacccgcgacggctacatcaacgtgggggccaacaaccagcggctctggaagcgcctgtgcgccgccataggccgcgaggagctcatagaggacgagcgtttcgccaccaacgagcggcgcatggccaaccgcgaggagctggccagggagctggagtccaccctgcgcgagaggaccaccggggagtggatggaggtgctgctcgaggcgggcttcccggccggccccatctacaactacgggcaggtcttcgaggacgagcacaccctggcgcgggagatgatggtcgagatggagcaccccgtggaggggacggtgcgggggctcggcatccccgtcaagctcagcgagacgccgggggccgtgcgccgggcggccccgctgctcggggagcacacccgggagacgctgcgccggctcgggtattctgaagagaagatagccgagctagaggagagggaggcgatatga

SEQ ID NO: 6864 - protein, 395 aa, Rubrobacter xylanophilus DSM 9941
MLPLEKIKVLDLTQVMAGPFCCQLLADMGADVTKVEPPGTGDQARRSMGFTMKGEDTAAFLAVNRNKKSVTLNLKDGEAREIFYRLVREADVLVENFRPGVTRKLGIDYETLKEINPRLIYASISGFGQTGPYAARAGYDLIAQGMSGVMSVTGEPGRPPVKCGVPIGDLSAGLFCAFGVLTAYIARQSTGRGQYIDTSLFEGALALSIWETAELWATGRIPQPFGSAHRLTAPYQALRTRDGYINVGANNQRLWKRLCAAIGREELIEDERFATNERRMANREELARELESTLRERTTGEWMEVLLEAGFPAGPIYNYGQVFEDEHTLAREMMVEMEHPVEGTVRGLGIPVKLSETPGAVRRAAPLLGEHTRETLRRLGYSEEKIAELEEREAI

SEQ ID NO: 6865 - DNA, 1149 bp, Rubrobacter xylanophilus DSM 9941
  CDS (1)..(1149): transl_table=11
atgagcgccggggggcccctctccgggatactggtggtcgacctcacccgggcgctcgccgggccctacgccaccatgatgctcgccgacgcgggggccgaggtggtgaaggtggagcgccccgggacgggcgacgacacccgcggctggggcccgcccttcgtgggcgggcccggggaggaggagtccacctacttcctctcggtgaaccgctccaaaaagagcgtcgtgctcgacctcaaggagcccggggacctcgagcgcctcaaggggctcatccggcgggccgacgtgctggccgagaacttccggcccggggtcatggagcggctcgggctcggcccggaggatctggagcggctcaacccccgcctcgtctcgctctccatcaccggcttcggggagggcgggccggagggccaccggccggggttcgaccagatcgcgcagggcgagggagggctcatgagcttcaccggccccgtcggggggccgcccaccaaggtgggggtccccatcgcggacatcctggccgggatgttcggggccttcggggtggtggccgcgctgcacgagcgcgagcggagcgggaggggccagcgggtcacctcctcgctgctcggggccatcgtgggcatccacgccttccagggcacccgctggctcatcgccggcgaggtgccccgcccggagggcaaccgccaccccaccatagccccctacggggcctacgagtgcgccgacgggatgatcaacatcgccgtcggctccgaggggctgtggcgccgcttcgcgccgctggtgggcctcgacccggaggacgggcgcttcgacaccaacaaaaagcgcgtctcgcgggtggaggagctcgaggaggccatggccccggcgctgcgctcggcgggggtggaggagtggatgcggcggctgggggaggcgggggtccccgccgggagggtgctctcgctggacgaggtctacgcctcgccgcaggtggagcacctcgggctcgtagacgcggtggagcaccccaggctgggggagatccggctgccgggctggccggtgggctggagccgctccggccgccgccgccccgagccgccgcccaccctcggccagcacggcggcgaggtgctcggcggctag

SEQ ID NO: 6866 - protein, 382 aa, Rubrobacter xylanophilus DSM 9941
MSAGGPLSGILVVDLTRALAGPYATMMLADAGAEVVKVERPGTGDDTRGWGPPFVGGPGEEESTYFLSVNRSKKSVVLDLKEPGDLERLKGLIRRADVLAENFRPGVMERLGLGPEDLERLNPRLVSLSITGFGEGGPEGHRPGFDQIAQGEGGLMSFTGPVGGPPTKVGVPIADILAGMFGAFGVVAALHERERSGRGQRVTSSLLGAIVGIHAFQGTRWLIAGEVPRPEGNRHPTIAPYGAYECADGMINIAVGSEGLWRRFAPLVGLDPEDGRFDTNKKRVSRVEELEEAMAPALRSAGVEEWMRRLGEAGVPAGRVLSLDEVYASPQVEHLGLVDAVEHPRLGEIRLPGWPVGWSRSGRRRPEPPPTLGQHGGEVLGG

SEQ ID NO: 6867 - DNA, 1170 bp, Rubrobacter xylanophilus DSM 9941
  CDS (1)..(1170): transl_table=11
atgcgggaagcggctttcgggctgcccctccgggggctcagggttctggacctctcgcgggttctggccggtccctacgccacgacggtgctcggggacctgggggcggacgtgatcaaggtcgagcaccccgagcgcggcgacgacacccgcagctgggggccgcccttcgccgggggcgagtcggcgtactttctctccgccaaccgcaacaagcgctcggtggcgctggacctcaagacgcccgaggggctgaagaaggcgcgggagctcgccgcgggggccgacgtgctcgtggagaacatgcggcgcggcgcgctggagaggctcgggctcgggtacgcggcgctgcgggagaggaaccccggcctcatctactgctccatcaccggcttcggcccgggcccggaccaggggcggcccggctacgacttcctcgtgcaggcgcgggccgggatcatggggataaccggctggcccggggggccgccgacgaaggtgggcgtggcggtcgcggacgtcgtctgcgggctgtacgcggcggtggccgtcctggccgcgctgcgccggcgctcggagaccggagagggggcccgcatcgaggtgccgctcttcgagagcgccctctcctggctcgccaaccgggcgcaggagtacctggtctccggggtggacaccggcaggctgggcaacgaccaccccaccatcgtcccctaccggaccttcgaggcctcggacaagaccttcgccgtcgcggtgggcaacgacgcgcagttcgcccggctgtgccgggcgatcgggcgcgaagatctggccgaagacgggcgcttcgccgacaacccggggcgggtcgccaaccgcgaggagctggtggcggagctgcagaagaccttctccgggcggaccgccgcggagtgggtgcagcgcatcggggaggccggggtcccctgcggcccggtcagcagcctcgccgaggtcttctccgacccgcacgtgctgggctgcgggatcctgcgggaggtggatcatcccgccgcgggggcgctgaggatgctcgcttcccccctgcttgtggacggggagcgcccccccatccgccgcccgccgcccacgctcggggagcacacggacggggccggttgggaggccgccccggacggacccggataa

SEQ ID NO: 6868 - protein, 389 aa, Rubrobacter xylanophilus DSM 9941
MREAAFGLPLRGLRVLDLSRVLAGPYATTVLGDLGADVIKVEHPERGDDTRSWGPPFAGGESAYFLSANRNKRSVALDLKTPEGLKKARELAAGADVLVENMRRGALERLGLGYAALRERNPGLIYCSITGFGPGPDQGRPGYDFLVQARAGIMGITGWPGGPPTKVGVAVADVVCGLYAAVAVLAALRRRSETGEGARIEVPLFESALSWLANRAQEYLVSGVDTGRLGNDHPTIVPYRTFEASDKTFAVAVGNDAQFARLCRAIGREDLAEDGRFADNPGRVANREELVAELQKTFSGRTAAEWVQRIGEAGVPCGPVSSLAEVFSDPHVLGCGILREVDHPAAGALRMLASPLLVDGERPPIRRPPPTLGEHTDGAGWEAAPDGPG

SEQ ID NO: 6869 - DNA, 1173 bp, Mesorhizobium sp. BNC1
  CDS (1)..(1173): transl_table=11
atggccgaaccgccgctttccaatatccgtgtcatcgagcttgcccgcattctcgcaggcccctgggcaggccagcttctggccgatctcggcgccgaagttatcaaggtcgaaaacccggacgggggcgatgacacccgcaaatggggcccgcccttcgtgacgggaaaggacggagagaacctttcggccgcctattttcattcctgcaacaggggaaagcgctcgatcgcgcttgatttcacgagggaggaagaccgcgcggttctcctgaagctgatcgcctcggccgacgtgctgatcgagaacttcaagctcggcggcctaaaaaaatacggcctcgattacgagagcctgaaggcgatcaacccgcgcctcgtctactgctccatcaccggattcgggcaggatggaccctatgctccgcgtgcgggctatgatttcatcatacagggcatgtccggcctgatgtcgatcaccgggcccgccgacggcgagccgcagaaggtgggtgttgccgtcaccgatatcttcaccggcctttattccgtcatcgcaattcaggcggcgctccgccacgcggaaaagaccggcgaggggcagcatatcgacatggcgctgttcgatacgcaggtttcggtgctcgccaaccagaacctgaattatttggtctccggcatcgccccggtccgcatgggcaatgcgcatcccaatatctccccttacgaggtcttcgaggtggtggacgggcatttcatcctggctgtcggcaatgacgggcagttcgagcgtttctgcgccgtaataggccgcgaggaactggcggccaatcctgaattctccaccaacgccgcgcgcgtcgccaaccgcgagcggctcaggagcgaaatcgcgctgaggctgaagacattcgcacgcgatctgctccttaaaagcctcgaagaggcgggcgtgccggcaagccccattaacacgatcgccgacatgttcgccgacccgcagaccatcgcccgcggaatgcggctcgacctgaaggacgcggacggcaacgcgcttccctccgtgcgcgcgccgatggtcatgtcgcaaaccccgcttgcctatacgcgcccaagcccgcggctgggcgaacataccgaggaaatcctgcgcgaactggaggaaagcacgtga

SEQ ID NO: 6870 - protein, 390 aa, Mesorhizobium sp. BNC1
MAEPPLSNIRVIELARILAGPWAGQLLADLGAEVIKVENPDGGDDTRKWGPPFVTGKDGENLSAAYFHSCNRGKRSIALDFTREEDRAVLLKLIASADVLIENFKLGGLKKYGLDYESLKAINPRLVYCSITGFGQDGPYAPRAGYDFIIQGMSGLMSITGPADGEPQKVGVAVTDIFTGLYSVIAIQAALRHAEKTGEGQHIDMALFDTQVSVLANQNLNYLVSGIAPVRMGNAHPNISPYEVFEVVDGHFILAVGNDGQFERFCAVIGREELAANPEFSTNAARVANRERLRSEIALRLKTFARDLLLKSLEEAGVPASPINTIADMFADPQTIARGMRLDLKDADGNALPSVRAPMVMSQTPLAYTRPSPRLGEHTEEILRELEEST

SEQ ID NO: 6871 - DNA, 1260 bp, Mesorhizobium sp. BNC1
  CDS (1)..(1260): transl_table=11
atgaaacagagtaaacagaacatgcagcagacatcgctcaaaggcgcacgtgtaatcgacctgacgcgggtcgttgcaggtcctttctcaacgactattctcgctgatctcggcgcggatgtgataaaggtggagcgccctggcgtgggcgatgacagcagaagctgggggccacccttcgtcggggaagcgagttcgtattttcttggcttgaaccgcaatcggcgcagcatcgcgattgacctgcagtctccagagggcgcgcagattatccgcgatctggtcaagcatgcggatgtgcttgtcgagagtttccgtccaggcgtgatggagcgactgggcctgggttacgaaacgctcaggcagatcaatccttcgctcgtctattgtgccatctccgcctacggtcagaccgggccatacaaatcacgccccggatatgatctgatgatatcagccatgggtgggctgatgagcgtaaccgggactccgggtggcgagccggtcaagacgggcgtggcgctcatcgacgtgtgcacaggccttcacgctgctatcggcatccttggcgccttgtatcaccggcaggctaccggagaaggccagcgcgttgacgcttcgctgctgggttcacagcttgcgatgttgatcaatgtggccagtgaatacctcatcgggggcagcattgcgaagccgcagggctctgcccatgccaatgttgctccctatcaggcattcccaagcaaggatggctgggtgctcatgggatcgccgaacgacaagctgttcggggtgatgtgcgatgcgctcgggcaacctcaatggaagcatgatccgcgcttcgtcaccaatggggatcgcgtggcgcaccgcgaagagctcgttgccttgatcagcgatgtcacgcgccagcatccaaccgattactgggtggacctcttgtcttcgaccggcgcgccggttgctccgatcaatacaatggacaaggtgttccagaacgagcaggttcagcatctcgcgcaagtcgaacaggtcgagcatccattgttcggcagttatccggttgtcacctctgccttgcgtatgtcggctacaccaccggtgaaggccgcgcctgcaccgcgtctcggacagcatagtcgtgaggtcctgtcggaagtgctcgggtgggaagacgatcaaatcgagaagttaatcgcggcaggcgttatagaattccgtgaagccggcgaacctttccaaggcaagaacggctcctag

SEQ ID NO: 6872 - protein, 419 aa, Mesorhizobium sp. BNC1
MKQSKQNMQQTSLKGARVIDLTRVVAGPFSTTILADLGADVIKVERPGVGDDSRSWGPPFVGEASSYFLGLNRNRRSIAIDLQSPEGAQIIRDLVKHADVLVESFRPGVMERLGLGYETLRQINPSLVYCAISAYGQTGPYKSRPGYDLMISAMGGLMSVTGTPGGEPVKTGVALIDVCTGLHAAIGILGALYHRQATGEGQRVDASLLGSQLAMLINVASEYLIGGSIAKPQGSAHANVAPYQAFPSKDGWVLMGSPNDKLFGVMCDALGQPQWKHDPRFVTNGDRVAHREELVALISDVTRQHPTDYWVDLLSSTGAPVAPINTMDKVFQNEQVQHLAQVEQVEHPLFGSYPVVTSALRMSATPPVKAAPAPRLGQHSREVLSEVLGWEDDQIEKLIAAGVIEFREAGEPFQGKNGS

SEQ ID NO: 6873 - DNA, 1173 bp, Rhodococcus sp. RHA1
  CDS (1)..(1173): transl_table=11
atgtccgcgtttgacggcatccgggtcctcgaattgggccaaatctacaacggtccgtactgcggacttcttctcgcgcagctgggcgccgaggtcatcaagatcgagccacccggcggcgagcaattgcgcttccgctcacaccagccggtcgagtcccacgagttcgtgatgctcaactccaacaaggtcagtgtggtcctcgacctgaagaccgacgccggtcgccacgcgctgctcgatctggccgagaccgccgacgtactcatcgaaaacttcgcgccgggcaccatcgagcggctccagctcggcccggaacaactcctcgagcataatccgcgtctgatcgtggcccgcggcaagggctacgggtcgacgggcccgtacgcacacatgtcggccatggacatcaccgtgcaggcgatgtccggcagcgccgcggccaccggaatgcccgacggcccaccgaccaaggcgggcgccgcattcgtggacttctccggcggcatccacctgttcggggcgatcagcgcggccctgttccaacgtgaacgcacggggcgggggcagctcgtcgaggtgtcgatgcacgacaccatctatcccatgcttgcctccagcctcggcggcctgcacaacaatcccgaccgaaaactgcccgagcgcaccggaaatcggcattcgggcatggcgctcgcgccctacaacatctacgaggccagcgacggatggctggcaatcatctgcatctccgaacggcactggcgcggtgtcgcgaccgcactgggccggcccgagctggtcgacgaccccagattctccaaggagagcgacagggccgcaaacatcgacgcggtcgacgaagagatgtcggcgtgcaccaagacccgcacacgcgccgaactggtgcgggacctacaggccgccggtgtgccgtgtgcgccggtcaagtcgatccgggagatcgacacggacgagcacctgatcgagcgcggcatgatccggtacgtcgagcacccggcgaggggtcgggtgccggtaccgggatgtccgctcagactcagtgactcgccggtgggaccactgcgcgccgccccgctgctggggcagtcgacagaggagatcttggcggaactgtccggtgaggagccccagcatgtccccactgcttga

SEQ ID NO: 6874 - protein, 390 aa, Rhodococcus sp. RHA1
MSAFDGIRVLELGQIYNGPYCGLLLAQLGAEVIKIEPPGGEQLRFRSHQPVESHEFVMLNSNKVSVVLDLKTDAGRHALLDLAETADVLIENFAPGTIERLQLGPEQLLEHNPRLIVARGKGYGSTGPYAHMSAMDITVQAMSGSAAATGMPDGPPTKAGAAFVDFSGGIHLFGAISAALFQRERTGRGQLVEVSMHDTIYPMLASSLGGLHNNPDRKLPERTGNRHSGMALAPYNIYEASDGWLAIICISERHWRGVATALGRPELVDDPRFSKESDRAANIDAVDEEMSACTKTRTRAELVRDLQAAGVPCAPVKSIREIDTDEHLIERGMIRYVEHPARGRVPVPGCPLRLSDSPVGPLRAAPLLGQSTEEILAELSGEEPQHVPTA

SEQ ID NO: 6875 - DNA, 1182 bp, Rhodococcus sp. RHA1
  CDS (1)..(1182): transl_table=11
atgaacaccacccacaccggtccggcgccccttgcgggtgtgcgggtgctggacctctccaagatcctcgccggaccgtacgccaccatgtcgctcgcggacctcggcgccgacgtcacgaaggtcgaacaccccgacggcggcgacccgacacggtcgtggggtccgccgttcgtcggccccgacgccacgtactacctcgcgatcaaccggggcaagaagtcggtgaccgtcgacctcaaatcggaagagggacaggacgtcatccatcgcatcctggaggagaccgacgtcgtagtcgagaacttcaagcccggcagcggattgcagcggatcttcgactatcggacgctgtccgagcggtacccgcatctggtcgtgctgcacatctccgcgttcggggaggacggtccgctgcgcgacgaaccgggttacgacatgatcgcgcaggccgcaggcgggctgatgtcgctcaccggtgagccgggcggggcgccgatgaaggcaggattcgcgatgggtgatctgggggcggcgctcttcggtctgatcggcgtgctcgctgccctggtggagcggtcgcggaccggccgagggcagtacgtgacgacgtcgctgttcgaatgccagctcgccctgcacgtgaactgggcgaccaactacttcgcgaccggcgagcgtcccggcgcgctgggctccggtcatcccaatctcgctccgtatcaagcatttcccgcgagcgacggatacttcgtcgtcgcggtgggcaacgacaatcagtgggggagcctgtgctccgcgatcgcacgcgaagacctgacgaccgacccgcgattcgagcgcaaccgtgaccgcgtggcgaatcgtggcgatctcgagcgggaactgtcgtcggccttcgcgtcgggcaccgtggagcaatggtgcgacacactcgccgcgcacgccgtgcccgtgtcaccgatccggcacctcgacgagatctacgcggacccgcacactgccgcgctcgggatgatcggcacggtcgaccacccgacgctgggcagcctgcagcagatcgcgttcccggtcagtttcgcaggcgagcgcccgcatctgacgtccgcgccgccggtactcggcgccgacaccgacgagatcctcggtgctcaccggccgcagtcggtggtcggcgggtag

SEQ ID NO: 6876 - protein, 393 aa, Rhodococcus sp. RHA1
MNTTHTGPAPLAGVRVLDLSKILAGPYATMSLADLGADVTKVEHPDGGDPTRSWGPPFVGPDATYYLAINRGKKSVTVDLKSEEGQDVIHRILEETDVVVENFKPGSGLQRIFDYRTLSERYPHLVVLHISAFGEDGPLRDEPGYDMIAQAAGGLMSLTGEPGGAPMKAGFAMGDLGAALFGLIGVLAALVERSRTGRGQYVTTSLFECQLALHVNWATNYFATGERPGALGSGHPNLAPYQAFPASDGYFVVAVGNDNQWGSLCSAIAREDLTTDPRFERNRDRVANRGDLERELSSAFASGTVEQWCDTLAAHAVPVSPIRHLDEIYADPHTAALGMIGTVDHPTLGSLQQIAFPVSFAGERPHLTSAPPVLGADTDEILGAHRPQSVVGG

SEQ ID NO: 6877 - DNA, 1149 bp, Rhodococcus sp. RHA1
  CDS (1)..(1149): transl_table=11
atgcctcccctgcctcccctggacggcgtccgcgtcgtcgatctctcccgcgtcctcgccggaccgtattgcacggcgctgctcgcagacgccggcgccgacgtcgtcaagatcgagcccgctgccggcgaggactcgcggcacctgggcccgttccgcgacggcgagagcatctatttcaacgtgctgaaccgcggaaaacgctcgctggcactgaatctcaaggacgactcggaccggaaggtgctgttcgacctgctcgacacggcggatgttctcgtcgagaatttccggcccggcgtgaccgcccgcctcggcatcgactacgacaccgtccacacccgcaacccccggctcgtctacgcgtccatttccggtttcgggcaggacgggccgctcgcgggttcggccgcctacgacctcgtcgtgcaggcgatgtcggggatcatgagcatcaccggttcccccgaatccgggccgacccggctcggcgaatcgttcggcgacctcgtcgcgggactgttcgcggcgtggggcatcagctccgccctggtcggtacgcgggagtcgggtgtggggcaacacctcgacgtcgccatgttcgacagcatgctggccatgctccccaccgcgcacagccagttgcaggcgtcgggggtcgcaccggtgggagtgggcaatcgccatcccgtctccaccccgttcgacacgtaccgggcgtcggacggcctgttcgtcctggccgtcgccagccagtccggattcgagaagctcgcccgcaccatggatcgcgcagaccttctcggcgacaaccgtttcgccgacgacacgtcccgcaccgatcacgaaccggccctgcgcgcggagatcgagatctgggcgaaggacaagacggtcgccgaggtggtcgccgtcctcggcgcggccggactggcgagctccgagatctggaacgtggaacaggcgttgtcgtccgagcagagcagacaccggggactcgtggagtcgttcgatcatccggtcgcgggaacgatcgactacgtccggcagccggtcgtgttcggcgacagcgcgcgccccggggtccgccgcagcccgctgctcgacgaacaccggcagcccctgctgtccgagatcgcgtcgcggtag

SEQ ID NO: 6878 - protein, 382 aa, Rhodococcus sp. RHA1
MPPLPPLDGVRVVDLSRVLAGPYCTALLADAGADVVKIEPAAGEDSRHLGPFRDGESIYFNVLNRGKRSLALNLKDDSDRKVLFDLLDTADVLVENFRPGVTARLGIDYDTVHTRNPRLVYASISGFGQDGPLAGSAAYDLVVQAMSGIMSITGSPESGPTRLGESFGDLVAGLFAAWGISSALVGTRESGVGQHLDVAMFDSMLAMLPTAHSQLQASGVAPVGVGNRHPVSTPFDTYRASDGLFVLAVASQSGFEKLARTMDRADLLGDNRFADDTSRTDHEPALRAEIEIWAKDKTVAEVVAVLGAAGLASSEIWNVEQALSSEQSRHRGLVESFDHPVAGTIDYVRQPVVFGDSARPGVRRSPLLDEHRQPLLSEIASR

SEQ ID NO: 6879 - DNA, 1191 bp, Rhodococcus sp. RHA1
  CDS (1)..(1191): transl_table=11
atgaagctgctcgacggaatccgagtcttggatctcaccaacgtccttgccggcccgtatgcgagctaccagctctcgctgatgggtgccgacgtcgtcaaggtcgaagtacccggcagcggcgacctggctcgacagctcggtgccgacaccgcgctgtcgagccagaagctcggcgcctcgttcgtggcccagaacgccggtaagcgctcgatgacggtcaacctcaagagccctaccggccggaacgtgttcgaccggttgatcgccggcgccgacgtcctcgtcgagaacttccgcccgggagtactcgcccggctcggctactcctgggacgagttgcacgcgatgaacccgcggctggtgtactgcgcgatctccggtttcgggcagaccgggccgatgcgggagcgcccggcgtacgaccagatcatccaggggctgtccgggatgagcgcggtcaccggcacacccgacaccgcaccgttgcgcgtcggattcccggtgtgcgacaccctcggcgggatgaccgccgccatggccatcaacggcgctctcgcgtcccgcgcccggaccggcgagggcgtctaccttgatgtgtcgatgctcgacagttcactgaccgcactgggctgggtggtctcggactacctcatcgccggacggcaacccagcgcgaacggcaacgaaaaccccaccggcgcaccgtcggcgaccttccagaccggatcgggtgccctcaacatcgcggccaacaagcaggaacaattcgagatcctgtgcaagctgatcggccgtgaagacctcatcgacgacccccggttcgcgctgcgcgacgaccgcaagaaccgtcgcccggaactgcgcgtcgagatcgaggccgccctcgccgccaagtccgcccgcgagtgggagcccctgctcaacgaggcgggggtgcccgcgggactggtcctcgacgtcaccgactccctcgacctcgaccagatcaccgagcgtgaactggtccaccaggtcgacctgcccgaccgcacggtcagcgtcctcggcaccggcttccacgtcaacggccgccccctcgccccggggtcggcgcccccgacgctgagcgaacacaccgacgaactgctcaccgatctcggcttcaccgccgacgagatcaccgaactgcacacggaaggcgcggtatga

SEQ ID NO: 6880 - protein, 396 aa, Rhodococcus sp. RHA1
MKLLDGIRVLDLTNVLAGPYASYQLSLMGADVVKVEVPGSGDLARQLGADTALSSQKLGASFVAQNAGKRSMTVNLKSPTGRNVFDRLIAGADVLVENFRPGVLARLGYSWDELHAMNPRLVYCAISGFGQTGPMRERPAYDQIIQGLSGMSAVTGTPDTAPLRVGFPVCDTLGGMTAAMAINGALASRARTGEGVYLDVSMLDSSLTALGWVVSDYLIAGRQPSANGNENPTGAPSATFQTGSGALNIAANKQEQFEILCKLIGREDLIDDPRFALRDDRKNRRPELRVEIEAALAAKSAREWEPLLNEAGVPAGLVLDVTDSLDLDQITERELVHQVDLPDRTVSVLGTGFHVNGRPLAPGSAPPTLSEHTDELLTDLGFTADEITELHTEGAV

SEQ ID NO: 6881 - DNA, 1254 bp, Rhodococcus sp. RHA1
  CDS (1)..(1254): transl_table=11
atgagtgtaccgacccgaacgcagatcgacgggcgcggcgcttggcgcacggccgacactgccaccggaaacggggtgttgaccggtgtgcgcgtcctcgatctgagtcgtgtgctcgccggtccctacacggggcagatcctcgccgaccacggtgccgaggtcatcaaggtcgaggcgccgtccggtgacgaaacacgtggctggggtccaccgttcgaagagtcgggcgcgagcagtgcctactacgcgagcctgaatcacagcaaggagaacatcaccctcgatctgcgcaccgacgacgggcgcgagatcctcggcaatcttctcgccggtgccgacatcgtcatcgagaacttcaaggcgggaacgttggcgcgctgggggttcgactacgaaaccgtgctcgccgattcgaaccctcgaatggtctactgccgtatcaccggtttcggtgtcgacgggccgatgggtggccttcccggctacgacgccgtgctgcagtcgttcggtgggttgatgagcatcaacggctaccccgacggcaatccgttgcgaatgggtgtcccgatcgtcgacatcgtggcggccaacatggcggtcagcggcattctgctcgcaatgctggagcgcgaacgtaccggccgtgggcagctcgtcgacatcaccctgctcgactcggtgatctcgattctccacccccatgccgccaactggatcgccagtgggagggtgccgcaacgaaccggagacttccatccgacggtggtcccgtaccaggtcttctgcgccaaggacggtgacttcttcgtcagcgcggccaatgatcgtcagttccgttctctgaccgaggtgcttggagtccccgaacttgccaccgatccccgattcgtctccaacggggagcgttacgcccatcgccacgacctgatcgcgatactgtccgagcggatctccgggtacaggcgtgacgagctcgctgtacggctggaagaggcgggggtgccggccagtccggtgcacaccgttgaggaggcgttgcagtccgcgcaggtgcgacatcgaggcctgttcctggagtccgaggactaccgcggtgtcggcgttccgatctcgctgagcagatcccctcatcgggcgcctcgacgtgcggtgccgcgcggcgcggacaccacaaatgtgctgtccgcgatggggtacagtgccgagcgtatcgccgaactcgtttcggcaggtatcctcggagattcgtga

SEQ ID NO: 6882 - protein, 417 aa, Rhodococcus sp. RHA1
MSVPTRTQIDGRGAWRTADTATGNGVLTGVRVLDLSRVLAGPYTGQILADHGAEVIKVEAPSGDETRGWGPPFEESGASSAYYASLNHSKENITLDLRTDDGREILGNLLAGADIVIENFKAGTLARWGFDYETVLADSNPRMVYCRITGFGVDGPMGGLPGYDAVLQSFGGLMSINGYPDGNPLRMGVPIVDIVAANMAVSGILLAMLERERTGRGQLVDITLLDSVISILHPHAANWIASGRVPQRTGDFHPTVVPYQVFCAKDGDFFVSAANDRQFRSLTEVLGVPELATDPRFVSNGERYAHRHDLIAILSERISGYRRDELAVRLEEAGVPASPVHTVEEALQSAQVRHRGLFLESEDYRGVGVPISLSRSPHRAPRRAVPRGADTTNVLSAMGYSAERIAELVSAGILGDS

SEQ ID NO: 6883 - DNA, 1203 bp, Hyphomonas neptunium ATCC 15444
  CDS (1)..(1203)
atgccatcattgccgccccgtacaggcccgcttaccgatttgcgggtcatagaacttggacagctgatcgcaggtccattctgtggacagatatttgccgacatgggcgccgacgtgatcaaggtggaaccgcctgggcagggcgacccgctgcgtgactggggccgggaaggatttccgctctggtggtcagtcgtggcgcgcggcaaacgctgcatcacctcgaaccttcgggaagcagaaggtcaggacatcgtgcgcaagctcgtcgcgcaggctgatttcctcctggagaattttcgccccggaacattggagaagtgggggctgggctatgaggcactcagggaaatcaatccgcgcctgatcatgatccgcgtttcaggttatgggcagacgggcccctatgcctctcgcgccggctatgcctcggtgggcgaagcaatgggcggactgcggtatgtgatgggtgaagcagaccggcgcccttcgcgggcgggcatttccttgggcgacagtctggccggtgtgtatgccgcgctcggcgctctggcggctttgcatcaccgtgaaaaaaccggcgaaggccagatgatagatgcgacgatctacgagtcggtgctctcggtcatggaggcgcttgtgcccgaacaccagtttgagggctatacgcgcgaacggtccgggtcgatcctgcccaatattgcgccctccaacatttatgaaggctgtgatggcatggtcatcatcgcagctaatcaggatacggtgtttgcccggctttgtgtggccatcggcctgccagatctgaaggacgaccccgaatacaaatcccacgtcgcacgcgggcgcaatcaaaaggcgctcgacgacatgatccaggcttgggccgcgtcgcgcacgatcgatgagatcgagcagattatgatcgagaacggcgtgccggttggcaaggtttaccgcgccgcagacatgctgaatgatccccactacgctgcgcgcgagtccctcaccgaagtgcccagcccgcgttggccgggcatcaaacagcagaacgtctttcccaaactgtctgcgacacccggtaaaatccgctgggctggcccggagtccatcggtcagcataccgaagaggttctgacagagctgctggacctgaccccagagcaggtcgagaagcttcgtgccagcgggataatctga

SEQ ID NO: 6884 - protein, 400 aa, Hyphomonas neptunium ATCC 15444
MPSLPPRTGPLTDLRVIELGQLIAGPFCGQIFADMGADVIKVEPPGQGDPLRDWGREGFPLWWSVVARGKRCITSNLREAEGQDIVRKLVAQADFLLENFRPGTLEKWGLGYEALREINPRLIMIRVSGYGQTGPYASRAGYASVGEAMGGLRYVMGEADRRPSRAGISLGDSLAGVYAALGALAALHHREKTGEGQMIDATIYESVLSVMEALVPEHQFEGYTRERSGSILPNIAPSNIYEGCDGMVIIAANQDTVFARLCVAIGLPDLKDDPEYKSHVARGRNQKALDDMIQAWAASRTIDEIEQIMIENGVPVGKVYRAADMLNDPHYAARESLTEVPSPRWPGIKQQNVFPKLSATPGKIRWAGPESIGQHTEEVLTELLDLTPEQVEKLRASGII

SEQ ID NO: 6885 - DNA, 1218 bp, Rhizobium leguminosarum bv. viciae 3841
  CDS (1)..(1218): transl_table=11
atgacggagaccgtgacgaaaaaaccgccgcttgccggcatccgggtgatcgagcttgcccgtgtgctcgccggcccttgggcgggacagatgctcgccgatctcggtgcagacgtcatcaaggtcgaaaatcccgacggcggcgacgatacgcgccaatgggggccacccttcgtcgaaggcgccgacggcgaaaatctctcggccgcctattatcacgccgccaatcgcggcaagcgctcagtcaccgccgacctgaagagcgccgaaggccaggatctcgtccgccgcctcgtctccaccgccgatgtggtgatcgagaatttcaagctcggcggcctcgtcaaatacgggctcgattatgacagcctgcgcaaggtcaacccgaagctcgtctattgctcgatcaccggcttcggccagaacggcccttatgccagcctcgccggctacgattacatcgtccagggcatgtccggcttcatgtcgattaccggggagccgggcggccagccgatgaaggcaggcgtcgccatcgccgatatcttcaccggcatttatgccgtcgcggcgatcgaagccgccctgatccatgccctgaagtcaggcgaaggccagttggtcgacatggccctgctcgacgtgcaatcggccgtgctcgccaatcagaacatgaattacctggtctccggcgaggcgccgacccgcctcggcaatgcccatcccaatatctcgccctatgaggtcgtgccgacggcggatggttacctcattctcgcggttggaaacgacggccagttccgccgcctctgcaccatcctcggcctggagaccatcgccagcgacgagcgtttcgccaccaacaaggcccgcgtcggcaatcgcggcgaagtgcgccgcctcgtctccaccgaaacgctgaaatggcagaaggcggatctgctgaaggcctgtgaagagaacgcggttccgtcaggcgcaatcaatacgatcgaggaaatgttcgcccatccgcaggtgcaggcccgcggcctgcgcatcgaccttgcggatgccgccggcaccgtgatccccggtgtcaggacgcctgtggtgctgtcggagacgccgctgcgttatatcaggccgagcccgcgtctcggcgaacaccaggcagaaattctggcggaactcgcagagcgcgagaaaggcattgtcgtgaagaaggcatcgtcatga

SEQ ID NO: 6886 - protein, 405 aa, Rhizobium leguminosarum bv. viciae 3841
MTETVTKKPPLAGIRVIELARVLAGPWAGQMLADLGADVIKVENPDGGDDTRQWGPPFVEGADGENLSAAYYHAANRGKRSVTADLKSAEGQDLVRRLVSTADVVIENFKLGGLVKYGLDYDSLRKVNPKLVYCSITGFGQNGPYASLAGYDYIVQGMSGFMSITGEPGGQPMKAGVAIADIFTGIYAVAAIEAALIHALKSGEGQLVDMALLDVQSAVLANQNMNYLVSGEAPTRLGNAHPNISPYEVVPTADGYLILAVGNDGQFRRLCTILGLETIASDERFATNKARVGNRGEVRRLVSTETLKWQKADLLKACEENAVPSGAINTIEEMFAHPQVQARGLRIDLADAAGTVIPGVRTPVVLSETPLRYIRPSPRLGEHQAEILAELAEREKGIVVKKASS

SEQ ID NO: 6887 - DNA, 1224 bp, Pseudomonas aeruginosa UCBPP-PA14
  CDS (1)..(1224): transl_table=11
atgcccggcgccctttcccatatccgcgtactcgacctgtcccgtgtcctggccggcccttgggccgggcagattctcgccgacctcggcgccgaggtgatcaagatcgagcgccccggcagcggcgacgacacccgcgcctggggcccgccgttcctcaaggatgccgaaggcaacgacaccagcgaggcggcctactacctgtcggccaaccgcaacaagaagtcggtgacggtggacttcacccagccggaaggccagcgcatcgttcgcgaattggcggccaaggccgacatcctgctggagaacttcaaggtcggcgggctcaaggcctatggcctcgactatgaatcgctgaagcaggtcaacccgaagctgatctactgttcgatcaccggcttcggccagtccggcccctatgccaagcgcgccggctatgacttcatgatccagggcctgggcggcctgatgagcctcaccgggcgcgccgacaacgaggaaggcgccggtccggtgaaggtcggcgtggcgctgaccgatatcctcaccgggctgtactcctccaccgcggtgctcgccgccctcgcccaccgcgacgtcagcggcatcggccagcacatcgacatggccctgctcgacgtgcaggtcgcctgcctggccaaccagaccctcaactacctgaccaccggcgtgccgccgcggcgcctgggcaacgcacacccgaacatcgtgccgtaccaggacttccccaccgccgacggcgacatgatcctcacggtcggcaacgacagccagttccgcaagttcgccgagctggcagaccacccggaatgggccgacgacccgcgcttcgccaccaacaaggcgcgggtggccaaccgcgaggtgctgatcccgctgatccgccaggccacggtgctgcacaccaccgccgagtggattctttccctggagcgcgccggcgtgccctgcgggccgatcaacgacctggcgcaagtgttcgccgacccgcaggtgcaggcccgcggcctgcgcgtggagctaccgcacccgctggccgggacggttccgcaggtagccagcccgatccgcctgtccgagacgccggtggaataccgcaacccgccgcccaccctcggccagcacaccgacgaggtcctcgagacgctcctcggcctggacgcggccgcgctggaaaggctgcgcgacggcaaggtgatctga

SEQ ID NO: 6888 - protein, 407 aa, Pseudomonas aeruginosa UCBPP-PA14
MPGALSHIRVLDLSRVLAGPWAGQILADLGAEVIKIERPGSGDDTRAWGPPFLKDAEGNDTSEAAYYLSANRNKKSVTVDFTQPEGQRIVRELAAKADILLENFKVGGLKAYGLDYESLKQVNPKLIYCSITGFGQSGPYAKRAGYDFMIQGLGGLMSLTGRADNEEGAGPVKVGVALTDILTGLYSSTAVLAALAHRDVSGIGQHIDMALLDVQVACLANQTLNYLTTGVPPRRLGNAHPNIVPYQDFPTADGDMILTVGNDSQFRKFAELADHPEWADDPRFATNKARVANREVLIPLIRQATVLHTTAEWILSLERAGVPCGPINDLAQVFADPQVQARGLRVELPHPLAGTVPQVASPIRLSETPVEYRNPPPTLGQHTDEVLETLLGLDAAALERLRDGKVI

SEQ ID NO: 6889 - DNA, 1188 bp, Pseudomonas aeruginosa UCBPP-PA14
  CDS (1)..(1188): transl_table=11
atgaccaatcagacgggcgccctgcgtggcctgaaaatcatcgatctcagccgggtcctcggcggaccctactgctcccaggcgctggccgaccacggcgccgaggtgatcaagctggaacccctcggcggcgacgagacccgtggctgggggccgcccttcgagggcgacacggcgtcctacttcaagggcgtgaaccgcaacaagaagggcatcgccgtcgacctggcgacggcggagggcatcgagctgctgctgcgcttgctggaggacgccgacgtactgctggagaacttcaagcccggcaccctggcgcgttgggggatcggctacgaggaggtgcttcgccagcgcttcccacggctggtccactgcgcggtatcgggcttcggcgccgacggcccgctcggcggcctgcccggctacgacgcggcgatccaggctatggccggactgatgagcgtgaacggcgaggccggcggcgacgcgttgcgcatcggcctgccgatcgtcgacatggtcaccgggctgaacgccatggccggcatcctcctcgccctccacgagcgccaggtcagcgggcgcgggcagtcggtggacatcgccctgtacgactgcggtatctccctgctgcacccgcacctgccgaactacttcgcttccggacgtacgccccggcgtagcggcaacgcccatccgaacatcgcgccctacgacagctaccgcaccggtaccgagccgatcttcctcgccgtcggcaacgaccgccagttcgcccgcctgtgcgagtacctgggagccgatgaactgccgggggacccgcgcttcgccgacaacggcaagcgctcggtcaaccgcgaggcgctgaagcgcgccctggaggactacctggcggcccacgacggtcgcgagctggccgagctgctgatccgtctcggcgtgccctgcggagtgatcgccacggtggatcgggtggtggaacacccgcacacccgccatcgcgggatggtcgtcgaactcgagggctatcgcggcatcgcctcgccggtgaagctttcgcgcaccccggccagctaccgcgccacgccgccggtactgggcggagacacccgggaagtcctggcggaactgggattgagcgccgaggcgatcgacgcgctggtccggcgcggcatcgtccgcgcctga

SEQ ID NO: 6890 - protein, 395 aa, Pseudomonas aeruginosa UCBPP-PA14
MTNQTGALRGLKIIDLSRVLGGPYCSQALADHGAEVIKLEPLGGDETRGWGPPFEGDTASYFKGVNRNKKGIAVDLATAEGIELLLRLLEDADVLLENFKPGTLARWGIGYEEVLRQRFPRLVHCAVSGFGADGPLGGLPGYDAAIQAMAGLMSVNGEAGGDALRIGLPIVDMVTGLNAMAGILLALHERQVSGRGQSVDIALYDCGISLLHPHLPNYFASGRTPRRSGNAHPNIAPYDSYRTGTEPIFLAVGNDRQFARLCEYLGADELPGDPRFADNGKRSVNREALKRALEDYLAAHDGRELAELLIRLGVPCGVIATVDRVVEHPHTRHRGMVVELEGYRGIASPVKLSRTPASYRATPPVLGGDTREVLAELGLSAEAIDALVRRGIVRA

SEQ ID NO: 6891 - DNA, 1206 bp, Solibacter usitatus Ellin6076
  CDS (1)..(1206): transl_table=11
atgcatttgaagcctctggatgacattcgagttctggatttttcgcacgcgcttgccggcccttactgcacgatgctgctggcggagtacggggccgacgtttataagctggaatcgcgcgcgggcgacatgggacgcgggtgggggccgccgttcgcgggcggggtggcgagtttctttttgggattgaatcgcggcaagcgcgggatctccttcgacctgaagcatgcggaggggctggagctttgcctgaggctgatcgaccggatggacgtgctgatcgagaacttccgtccgggcgcgatggaccggctcggactggggtacgaagccctgcacgcgcggcatccggcgctggtctactgctcgatttcgggctacgggcaggacggtccttcgcgggacgaagcggcgatggacctggtggtgcaaggttcgagcgggctgctgagcatcacgggcacggccgatggcgaatcggtgcggtgcgggtacggggtgacggacgtgacggcgggacagttcgcgattatcggcatcctgctggcgctgcgggcgcgcgagcggaccggccgcgggcagttcatcgacgtttcgatgctggacggaatgatttccacgatgagctcgaattacatgacgtacctgggatcgggccgcgtgccggaaccgatggggacggcattcccgacggtggtgccgtaccgggtgttccacacgctggaccgtccgattgcgatcgcggtgggaagcgagaagctgtggtcggcgttctgccgcgcgatcgaacgtcccgacctggagcggcacgcggattacgatacgaatgccgggcggatccgcaaccgggcggcgctggaaccgctgctggacgaggtcttcaagatgcgcgcggtgggcgattggatggagcggctgcaggcggcgggaattccttcgtcgccggtgcgcactttcgaagacgtggtggagcacgagcaagcggcggtgcgggagatgttcccgacgctgcagcaccccacggccggagcgcatcgcgtgacggggacgcctgtgaagctttcggaaacgcccggacgtcccgggctgccggctccactgctggggcagcatacgcgggagacgctggcggagttgctgggcctgggcgcggcggaggtggacggcctggcggcgcgcggcgtggtgtacgaagcggccggctag

SEQ ID NO: 6892 - protein, 401 aa, Solibacter usitatus Ellin6076
MHLKPLDDIRVLDFSHALAGPYCTMLLAEYGADVYKLESRAGDMGRGWGPPFAGGVASFFLGLNRGKRGISFDLKHAEGLELCLRLIDRMDVLIENFRPGAMDRLGLGYEALHARHPALVYCSISGYGQDGPSRDEAAMDLVVQGSSGLLSITGTADGESVRCGYGVTDVTAGQFAIIGILLALRARERTGRGQFIDVSMLDGMISTMSSNYMTYLGSGRVPEPMGTAFPTVVPYRVFHTLDRPIAIAVGSEKLWSAFCRAIERPDLERHADYDTNAGRIRNRAALEPLLDEVFKMRAVGDWMERLQAAGIPSSPVRTFEDVVEHEQAAVREMFPTLQHPTAGAHRVTGTPVKLSETPGRPGLPAPLLGQHTRETLAELLGLGAAEVDGLAARGVVYEAAG

SEQ ID NO: 6893 - DNA, 1221 bp, Mycobacterium smegmatis str. MC2 155
  CDS (1)..(1221): transl_table=11
atgacggacaccatccacccgagcgacggaccacagttggcgttgtcggccggccccttggccgacctcacggtcgtcgatctgacccgcgcactcgcaggcccgcacgccgcgatgatgctgggcgatctcggcgccgacgtcatcaaggtcgagagtcccgttggcggtgacgacacccgcggctgggggccaccgttcatcgaacccaccggggcagaacgggaatcgacctacttcctgagcgccaaccgcaacaagaagtccgtcacgctcgacctgaagagccccttgggtcgcgacgcgctgaccgaactgctgcgccgcgccgacgtcctcatggagaacttccgccccggcgtgctcgaccggctcggcttctccgaagaagtgctgcaggaactcaacccgcgcctgatcatcctgtcgatcagcggattcgggcacgacggccccgaggccggccgcgccgggtacgaccagatcgcccagggcgaggcgggcctgatgtcactgaccggagccaatccccatgacctgcaacgcgtcggggtgccgatcgccgacctgctggcgggcatgtacggcgccttcggtgtcctggcggccctcaacgaacgcgcccgcacaggacggggtcaggtggtccgcgcgtcgctgctggcggccgtggtgggcgtacacgccttccagggcaccaagtggaccgtcgccggtcagatcggcgaggcgaccggcaaccatcatccgtcgatctgcccgtacggcttgttcgacaccgccgacggtgccgtacagatcgccgtcggcagcgaaggcctgtggaaacgcttctgtgacggcttccacctcgacgcccacgcgcccggcatggcgaccaaccccgagcgcgtcgccaaccagaaacgcgtcaacgaccttgtccagaacgtgttctcgctgtactccaccgacgaactgctcggcatcctcgaccagatcggggtacccgccgggcggatccggaatctgcgggaggtctacgaatgggagcagacccggtcacagggactgctcatcgacgtcgaccacgcaaccctgggcaagatcaccctgcccgggccgccgctgcgcttcttcgatgtcgcgggtcccgagcgcacgcgacgggaccacagtgccccgcccgtgctgggcgccgacaaccacctgatcgacgagctcacggcaggacggcgatga

SEQ ID NO: 6894 - protein, 406 aa, Mycobacterium smegmatis str. MC2 155
MTDTIHPSDGPQLALSAGPLADLTVVDLTRALAGPHAAMMLGDLGADVIKVESPVGGDDTRGWGPPFIEPTGAERESTYFLSANRNKKSVTLDLKSPLGRDALTELLRRADVLMENFRPGVLDRLGFSEEVLQELNPRLIILSISGFGHDGPEAGRAGYDQIAQGEAGLMSLTGANPHDLQRVGVPIADLLAGMYGAFGVLAALNERARTGRGQVVRASLLAAVVGVHAFQGTKWTVAGQIGEATGNHHPSICPYGLFDTADGAVQIAVGSEGLWKRFCDGFHLDAHAPGMATNPERVANQKRVNDLVQNVFSLYSTDELLGILDQIGVPAGRIRNLREVYEWEQTRSQGLLIDVDHATLGKITLPGPPLRFFDVAGPERTRRDHSAPPVLGADNHLIDELTAGRR

SEQ ID NO: 6895 - DNA, 1104 bp, Mycobacterium smegmatis str. MC2 155
  CDS (1)..(1104): transl_table=11
atgagcgcggccgcactcgagggcgtcgtcgtcgcggacttcagccgcgtgttggccgggccgtacgcgacgatgatgctcgcggacttcggcgccgaggtcatcaagatcgagcggccgggcaccggggacgacacccgacagtggggccctccgtacgactcgaccggcgtggcaacgtatttcaactcggtcaaccgcaacaaacgctcggtcgcactggacctgggcagcacggaaggacgcgagcaggcgcgtgagctgatccgccgcgccgacatcgtggtcgagaacttccgaccgggcacgatggagaaactcggcctcggctacgacgacgtccgcgcgatccgccccgacgtcatctactgctcgatcacgggattcggccacggcggcggggccgccctgccgggctacgacctgctggtgcaggccgtcggcggtctcatgagcgtcaccggcaccgaaccgggcgatcccaccaaagccggtgtggcactggtggatgtgctggccggtatgcatgcgctcagcggcatcctggtcgccctggcgcaccgcgaccgcacgggcgagggccagcgggtcgacaccaacctgttctcggtgctgctgtcgtcgatggtcaaccaggcgtcgggttatctgggcgccggtgtggtgccgggcatcatgggcaaccggcatccgagcatcacgccgtaccagaccttcgacaccgccgaccggcccatcgcgatcgcggtgggcaacgacaagcagttccgggcgttcgccgcggtgatcggcagtcccgaactggccgacgacccgcggttctcgaccaacccgcagcgggtggcccaccgggacgtgctgtgtcccttgatcgaggccgcgctcaaggccaagggcgccgaccactggtatcacgaactgaccgcggtcggggtgcccgcgggacccatcaacgacctgtcggaggcgttcgcgttcgccgaggaactcggcatcgaggccgtggtgcagatgcccgacggtccgactccgcaggtcgccaacccgatcacgctgtcggcgaccccggtgacctaccgcaacagcccgcctccgctcagctga

SEQ ID NO: 6896 - protein, 367 aa, Mycobacterium smegmatis str. MC2 155
MSAAALEGVVVADFSRVLAGPYATMMLADFGAEVIKIERPGTGDDTRQWGPPYDSTGVATYFNSVNRNKRSVALDLGSTEGREQARELIRRADIVVENFRPGTMEKLGLGYDDVRAIRPDVIYCSITGFGHGGGAALPGYDLLVQAVGGLMSVTGTEPGDPTKAGVALVDVLAGMHALSGILVALAHRDRTGEGQRVDTNLFSVLLSSMVNQASGYLGAGVVPGIMGNRHPSITPYQTFDTADRPIAIAVGNDKQFRAFAAVIGSPELADDPRFSTNPQRVAHRDVLCPLIEAALKAKGADHWYHELTAVGVPAGPINDLSEAFAFAEELGIEAVVQMPDGPTPQVANPITLSATPVTYRNSPPPLS

SEQ ID NO: 6897 - DNA, 1188 bp, Mycobacterium smegmatis str. MC2 155
  CDS (1)..(1188): transl_table=11
atgcgggggcttcgcgtgctcgacttcacccacgtcgtcgcgggtccgctgtgcaccatgaccctcgccgacctgggtgccgacgtggtcaagatcgaaccgcccgccggtgagatcggccgccgcatcggcccgccatggcgcgacgggcaaagtgtcatctggcaaagcgtcaatcggaacaaacgcagcctgaccctcgacctgaagacgccggcgggccgacgcgcggcgcgacgcatggcccgccaggccgacgtcgtcgtcgagagcttccggcccggtgtcatgaccgacctcgacctcgggtacgacacgctggcgtcggccaaccccgcactggtctactgctcgatctccgcgttcggccaggcgggcccggccagcgaccgccccggtgtggacggcatcatgcaggccgtcaccgggctgatgagcactctgggtgagcccgagtccgggcccgcgaaggtccaggtgcccgcggccgacatggtgaccggctacctcgcgtcgatagccgtgctcgccgcactgcacgaggtgcgcgacggtggacgtggacagcatctcgacgtcagcctctacaacgcgacgatcctgttgcagcagatcgggttcacctcctacctggcctcgggtgccgaaccccagcggctcggcagcgccgccccgtacgccgcacccaacgaggcgctcccgacggccgacggctggatcatgatcgccgcgtacgacccggcgcgctggaacgcgctgtgcgacgcgctcggtgcaccggacctgagttcggatgcccgcttcgccaccaacgacgaccgtgtccgcaaccgcccggccctgcgcaccgagttgggccgtctgctgcgggcccgcaccacacaggtgtggctcgacgtcctctcggcacgggacatcctgtgcgccccggtcaacggatacgggcaggtcgtggcgtcccccgaatacgccgcgagcggtctgcaccgacccatcggtccgatcgatacaccgggcctggtcctcggcccgtcacagccggccgccccgccggacaccgcacccccggcacccggccagcattccgcggaagtgcttgccgaatacggactttcggaggacgaggtggcagccctgatcgaacacggcgtcgtcaacgacgtcgcaccatcccgagccgcgagctga

SEQ ID NO: 6898 - protein, 395 aa, Mycobacterium smegmatis str. MC2 155
MRGLRVLDFTHVVAGPLCTMTLADLGADVVKIEPPAGEIGRRIGPPWRDGQSVIWQSVNRNKRSLTLDLKTPAGRRAARRMARQADVVVESFRPGVMTDLDLGYDTLASANPALVYCSISAFGQAGPASDRPGVDGIMQAVTGLMSTLGEPESGPAKVQVPAADMVTGYLASIAVLAALHEVRDGGRGQHLDVSLYNATILLQQIGFTSYLASGAEPQRLGSAAPYAAPNEALPTADGWIMIAAYDPARWNALCDALGAPDLSSDARFATNDDRVRNRPALRTELGRLLRARTTQVWLDVLSARDILCAPVNGYGQVVASPEYAASGLHRPIGPIDTPGLVLGPSQPAAPPDTAPPAPGQHSAEVLAEYGLSEDEVAALIEHGVVNDVAPSRAAS

SEQ ID NO: 6899 - DNA, 1158 bp, Nocardioides sp. JS614
  CDS (1)..(1158): transl_table=11
atgactgaaggccccctctccgacctggtcgtgctcgacctgacccgcgccctcgcgggcccgcacgccgcgatgatgctcggcgacatgggcgcgcgggtgatcaagatcgagccgcccgccggcgacgacacccgcggctggggtccgccgttcgtcggcgcggacgacgagcgcgagtcgacgtacttcctctcggcgaaccgcaacaaggagtcgatcgtcctcgacctgaagtccgaggacgacaaggacgtgctggcgcggctggtcgagcgggccgacgtgctgatggagaactaccgcgtcggcgtgctggaccgcctgggcttcccggtctcgcggctgcacgagctcaaccccgggctggtggtgctgagcatcaccggcttcgggcacgacgggccggaggccacgcgggcgggctacgaccagatcgcgcagggcgagggcgggctgatgtcgatcaccggcaccacccagcccaccaaggtgggcgtcccgatcgcggacctgatcgccggcatgaacggcgccttcggcgtgctggccgccctgcacgagcgcacccgcaccggccgcggccgggtggtccggacctcgctgctcgccgggatggtcggcgtgcacgcgttccagggcacccggtggacggtcgccggcgaggtgcccgggctggccggtgaccaccacccctcgatcgcgccgtacggcatgttcgcgaccgcgaccgcgcccgtgcagatcgcgtgcgggtcggagaacctgtggcgcgcgctgtgcacggcgttcggctgggacgccgcggagccgggcttcgccaccaaccccgagcgggtcgccaaccgcgacgcgctgaccgcgcggatcgaggacctgttcgccaccgagcccgccgagcactggctggcggcgctcgccgacgccggcgtgccgtcgggcaaggtgcgctcgatggacgacgtgtactcctgggagcagaccctgtcgcagggcctgctgctcgccgtcgagcacgccacccagggcgagctgaagctgcccgggtcgccgatccgcttcgacgacgacccgtggtccggtggccggtccacccacctggcgccgcccacgctgggccagcacgacgcctcgatccgggagtggctcgactcgtga

SEQ ID NO: 6900 - protein, 385 aa, Nocardioides sp. JS614
MTEGPLSDLVVLDLTRALAGPHAAMMLGDMGARVIKIEPPAGDDTRGWGPPFVGADDERESTYFLSANRNKESIVLDLKSEDDKDVLARLVERADVLMENYRVGVLDRLGFPVSRLHELNPGLVVLSITGFGHDGPEATRAGYDQIAQGEGGLMSITGTTQPTKVGVPIADLIAGMNGAFGVLAALHERTRTGRGRVVRTSLLAGMVGVHAFQGTRWTVAGEVPGLAGDHHPSIAPYGMFATATAPVQIACGSENLWRALCTAFGWDAAEPGFATNPERVANRDALTARIEDLFATEPAEHWLAALADAGVPSGKVRSMDDVYSWEQTLSQGLLLAVEHATQGELKLPGSPIRFDDDPWSGGRSTHLAPPTLGQHDASIREWLDS

SEQ ID NO: 6901 - DNA, 1224 bp, Nocardioides sp. JS614
  CDS (1)..(1224): transl_table=11
atgaccgacggggacaactcggaccttcggcccaggcctggaccgttgcgaggaaccaccgtcatcgacatgacgcgtgcccttgccggtccccacgctgcaatgctcctaggtgatctcggtgcccatgtgatcaaagtggagtcggcagcgggcgacgagtccagatcttggggacccccgttcatcggcgatggcgacgacgaccgggtctccacctacttcctcgcggccaaccgcaacaagcagtccttccaactggacctcaagtcaggcgacgacatatctctcctgatccgccttgttcgtcacgcggacgtactgatggagaactttcgccccggcgtactagagcgtctgggcctgccgccagagcgtttgcttgacatcaacccgaagctcgtcgttctctccatcaccggattgggacatgacggaccagaaggcgcccgccccggctacgaccaaattgcacaaggcgaggccggcctgatgtcgataacgggtccgccgggggagccgacgcgggtcggagttcccatcgcggacctgctggccggaatctacggcgcttacggcacgctggccgcgatcctccgggctcgcgagactggcgagggtgccattgtcagaacgtctcttctggccgcgatctgcggggtgcacagtttccaggcgacgcggtttctcgtgggtggtgagaaccccgtctcgtccggaaatcaccacccatcgatcgcaccgtacggaacattcacggcatctgacgggatcatccaaatcgcggccgccaacgatcgactgtggagcgcgctcgcgcatgagctgcgaatcgacccaacggctacggaattcgctaccaaccaggcgcgagtcgcccacagggcagaactgatcgagtccatcgagacccggttgaccagcaacacgtcagatcactggatcgatgtcatcacggccgccggtgtgccatgtggtcgagtgcggtcaattgaagacgtttacgaatggccccaggccctcagccaaggccttgtcatacaagtcgaacacgagactgcaggtcggctcaaccttccaggctcgccagtgcgaatcgagaatcgcgatggggcagacctgatgccgagctggcatctgcccccaccgggcctgggtgagcacaaccgagcggtccgagactggctcgaccaacgagactcgattgataaccagaagcattga

SEQ ID NO: 6902 - protein, 407 aa, Nocardioides sp. JS614
MTDGDNSDLRPRPGPLRGTTVIDMTRALAGPHAAMLLGDLGAHVIKVESAAGDESRSWGPPFIGDGDDDRVSTYFLAANRNKQSFQLDLKSGDDISLLIRLVRHADVLMENFRPGVLERLGLPPERLLDINPKLVVLSITGLGHDGPEGARPGYDQIAQGEAGLMSITGPPGEPTRVGVPIADLLAGIYGAYGTLAAILRARETGEGAIVRTSLLAAICGVHSFQATRFLVGGENPVSSGNHHPSIAPYGTFTASDGIIQIAAANDRLWSALAHELRIDPTATEFATNQARVAHRAELIESIETRLTSNTSDHWIDVITAAGVPCGRVRSIEDVYEWPQALSQGLVIQVEHETAGRLNLPGSPVRIENRDGADLMPSWHLPPPGLGEHNRAVRDWLDQRDSIDNQKH

SEQ ID NO: 6903 - DNA, 1224 bp, Azoarcus sp. BH72
  CDS (1)..(1224): transl_table=11
atgcccggcgcactttcccacatccgcgtgctagacctctcccgcatcctcgcgggcccttgggccggccagttgctcgccgatctcggcgccgacgtcatcaaggtggaacgccccggcgccggcgacgacacccgcggctggggtcctcccttcctgaaagacgaacagggcgaaaacacaccggtcgccgcctactacctctgcgccaaccgcaacaagcgctccatcaccatcgacatcacccggccggaaggccaggcgctggtgaaacagctcgctgccgaatccgacgtggtgctggaaaacttcaagctcggcgggctcgcccagtacggcctcgactatgccgcgctgaaggcgatcaacccgcgcctcatctactgctccatcaccggcttcggccaggacggcccctacgcaccgcgcgccggctacgacttcctgatccagggcctcggcgggctgatgagcctcaccggccgcccggacgacgaagagggtggcgggccgatgaaggtcggcgtcgcgctcaccgacatcctcaccggcctgtatgccaccaacgccgtgctcgccgcgctcgcctggcgggagaaaagcggggaagggcagttcatcgacctcgcgctgctcgacgtgcagatcgcctgcctcgccaaccaggcgatgaactacctcaccaccgggcagaaccccaagcggctgggcaacgcccaccccaacatcgtgccctaccaggacttcccgaccgccgacggctacatgatcctcgccatcggcaacgatggtcagttcgcccgcttctgcaccgaagccggcgccccggaactcgccgccgacccgcgctacgccaccaacaaggcgcgggtggaaaaccgcaacacgctgattcccgcgctcaagcgcctgaccatcgagcgcagcaccgccgactgggtcgccgcactcgaagcgctcgccgtgccctgcggcccgatcaacacgctggccgacgtcttcgccgacccgcaggtgcaggcccgcggcctcaaggtcacgatgccgcatccgctcgctggcgaagtgccgctggtcgccaaccccctacggctttcggccaccccggtcgagtaccgcaacccgcccccgctgctcggccaacataccgagcagatcctcagcaccacgctcggcctcagcgcaacgcagatcgaagaattgcgcgccgcgggcgtgatctga

SEQ ID NO: 6904 - protein, 407 aa, Azoarcus sp. BH72
MPGALSHIRVLDLSRILAGPWAGQLLADLGADVIKVERPGAGDDTRGWGPPFLKDEQGENTPVAAYYLCANRNKRSITIDITRPEGQALVKQLAAESDVVLENFKLGGLAQYGLDYAALKAINPRLIYCSITGFGQDGPYAPRAGYDFLIQGLGGLMSLTGRPDDEEGGGPMKVGVALTDILTGLYATNAVLAALAWREKSGEGQFIDLALLDVQIACLANQAMNYLTTGQNPKRLGNAHPNIVPYQDFPTADGYMILAIGNDGQFARFCTEAGAPELAADPRYATNKARVENRNTLIPALKRLTIERSTADWVAALEALAVPCGPINTLADVFADPQVQARGLKVTMPHPLAGEVPLVANPLRLSATPVEYRNPPPLLGQHTEQILSTTLGLSATQIEELRAAGVI

SEQ ID NO: 6905 - DNA, 1248 bp, Acidovorax sp. JS42
  CDS (1)..(1248): transl_table=11
atgacccagccggctgccctgcaacccggcgcgctgcagcacgtgaaggtgctggacctgtcgcgcgtgctggccggcccctgggccgcccagacgctgggtgacctgggcgccgaggtcatcaaggtggagcgccccggcagcggcgacgacacgcgcgcctggggcccgccctacgtgaccgaccccgccggccagcccacgggcgagtcggcctactacatgtgcaccaatcgcaacaagcagtcggtgaccatcgacttcatccgccccgaggggcaggagctggtgcggcgcctggcgcagcagtgcgacgtgctggtggagaacttcaagacaggcggtctggcgcagtacgggctggactatgcctcgctgagcgcgctcaacccgcgcctggtgtactgctccatcaccggcttcgggcagagcgggccgtatgcgcaccgcgccggctacgacttcctgatccagggcatgggcgggctgatgagcgtcaccggccgccccgacggcgaggacggcggcggcccgatgaaggtgggcgtggcgctcaccaacatcctcaccggcctgtacgccagcaccgccatcctggccgcgctgcaggcgcgcgagcacaccggccgcggccagcacatcgacctggcgctgctggacgtgggcgtggcgtgcctggccaaccagggcatgaactacctgtacggcggcaaggtgccgcagcgcatgggcaacgcccaccccaacaccgtgccctaccaggacttccccacggccgacggccacatgatcctggccgtgggcaacgacgggcagttcgcgcgcttgtgccacgccgtgggccagcccggctgggcgcaggatgcgcgctttgccaccaacgccgcgcgtgtggcgcaccgcgacgaactggtggcgctgatccgcggcgtgacggtgggcaagcccacgcgcgactggatcgcgctgctggagcagcacgccgtgccgtgcgggcccatcaacaccgtgcgcgaggtcttcgaagatccgcaggtgcgcgcgcgtggcttgcagatccgcatggagcatccgcgcgccggcgccgtgccgctggtggccagccccatgcgcctgtcggacacgccggtcacctatcgccacaccccgccgcagctcggccagcacaccgacaccgtgctgcgcgaacacttgggcctggcgcccgaggccatcgatgcgctgcgcgcgcagggggtggtggcatga

SEQ ID NO: 6906 - protein, 415 aa, Acidovorax sp. JS42
MTQPAALQPGALQHVKVLDLSRVLAGPWAAQTLGDLGAEVIKVERPGSGDDTRAWGPPYVTDPAGQPTGESAYYMCTNRNKQSVTIDFIRPEGQELVRRLAQQCDVLVENFKTGGLAQYGLDYASLSALNPRLVYCSITGFGQSGPYAHRAGYDFLIQGMGGLMSVTGRPDGEDGGGPMKVGVALTNILTGLYASTAILAALQAREHTGRGQHIDLALLDVGVACLANQGMNYLYGGKVPQRMGNAHPNTVPYQDFPTADGHMILAVGNDGQFARLCHAVGQPGWAQDARFATNAARVAHRDELVALIRGVTVGKPTRDWIALLEQHAVPCGPINTVREVFEDPQVRARGLQIRMEHPRAGAVPLVASPMRLSDTPVTYRHTPPQLGQHTDTVLREHLGLAPEAIDALRAQGVVA

SEQ ID NO: 6907 - DNA, 1287 bp, Acidovorax sp. JS42
  CDS (1)..(1287): transl_table=11
atgaccacccctgattcctcctcttccccaggcgcaggccgcgccggcgcgctcggccatctgcgcgtactcgacctatcgcgcgtgctggccggcccgtggtgcacccagaacctggccgacatgggcgccgacgtgatcaagatcgagaagcccggcgatggcgacgacacgcgccactggggcccgccgttctttcccgatgccgacggccagccgagcgaacacgcctgctacttcgccgcctgcaaccgcaacaagcgctccgtcaccgtggacatggccacgcccgaggggcagcggctgatccgcgagctggcccagcaaagcgatgtggtggtggagaacttcaagaccggcggcctcaagcgctacgggctggactacgaaagcctgtcggccctgaacccgcgcctgatctactgctcggtcaccggcttcggccacaccgggccgtatgcgccacgggccggctacgacctgctgatccaggccatgagcggcctgatgagcatcaccggccatgccgatggcgagcctggcggcggcccgatgcgcgtgggcgtggccgtgatcgacctgttcaccggcatgtatgccaccaccgccatcctgggcgcgctggaggtgcgccaccgcacgggacgcggccagcacatcgacatggcgttgctggacgtggccacggcggtgctggccaaccagggtgcgggcttcctcaacgccggcaacattccgaagcgccagggcaacacccaccccagcgtcgtgccctaccaggactttcccacgcaggacggcaacatgctgctggccatcggcaacgatgggcagttcgcgcgcttttgcgaagcggcgggcacggactgggccggcgacgaacgctttgccaccaacgccggccgggtgacccaccgtgagacgctgatccctctgatggccgccctcacgcgcacgcggcccacggccgcctggatcgcgctgttggaggacaaggccgtgccctgcggcccgatcaaccacgtcggccaggcgttcgacgatgcgcaggtgcgcgcacgcggactgcgcgtggagcagcagcgctaccccggcgcccagccgccggccggcgaggtggtcaaccgcgtggtgaccaccgccagcccgctgcgcttgtccgatacgcccgtcaccctgcgctatgccccgcccgcactgggtcagcacaccgacgaggtgctgcgcgagcggctggggctggatgccgcgcagctgcaggcgctgcgcgcgcagcgcgtgctctga

SEQ ID NO: 6908 - protein, 428 aa, Acidovorax sp. JS42
MTTPDSSSSPGAGRAGALGHLRVLDLSRVLAGPWCTQNLADMGADVIKIEKPGDGDDTRHWGPPFFPDADGQPSEHACYFAACNRNKRSVTVDMATPEGQRLIRELAQQSDVVVENFKTGGLKRYGLDYESLSALNPRLIYCSVTGFGHTGPYAPRAGYDLLIQAMSGLMSITGHADGEPGGGPMRVGVAVIDLFTGMYATTAILGALEVRHRTGRGQHIDMALLDVATAVLANQGAGFLNAGNIPKRQGNTHPSVVPYQDFPTQDGNMLLAIGNDGQFARFCEAAGTDWAGDERFATNAGRVTHRETLIPLMAALTRTRPTAAWIALLEDKAVPCGPINHVGQAFDDAQVRARGLRVEQQRYPGAQPPAGEVVNRVVTTASPLRLSDTPVTLRYAPPALGQHTDEVLRERLGLDAAQLQALRAQRVL

SEQ ID NO: 6909 - DNA, 1257 bp, Acidovorax sp. JS42
  CDS (1)..(1257): transl_table=11
atgagtgcttccaccccccgcggcgccttggacggtatcaaggtactggatctttcgcgcgtgcttgccggtccctggtgcacccagatgctggccgatctgggcgccgacgtggtcaaggtcgagcgcccccaggccggtgacgacacgcgccactggggcccgcccttcctgaaggacgacgctggccgcgacacgcgcgaggccagctacttcaccgcctgcaaccgcaacaagcgcagcatcaccgtggacatggcccatcccgagggccaggcgctgctgcgccgcatggccgccgaggccgacgtggtggtcgagaatttcaaggtggggggcctcgcgcaatacgggctggactacgccagcctgaaagcgctgaacccgcgcctggtctactgctccatcaccggcttcggccaggacgggccgtatgccgaacgcgccggctatgacctgatggtgcaggccatgtgcggcctgatgagcatcaccggccatgccgacgggcagcccggcggcgggcctctaaaggtcggcgtggccgtggtggacgtgttcaccggcctgtacgccagcaacgccatcctggccgcgctgaacgcgcgcgacaacgcccgcaacggcaccggcgaagggcagcacatcgacatggctttgctcgacgtgggcatggccgtgctggccaaccaggcggcgggctacctggccaccgggcaggcgcccggacgcgccggcaacatccaccccagcctggcgccctaccaggactttcgcagccgcgacggcaacgtgctgctggcgatcggcaacgacggacagttcgcgcgcttttgccaggcgtgcggccaccccgaatgggcacaggacgcacgctttgccaccaataccgcacgcgtgcagcaccgcgctgcgctgctggcgctgatggagcccgtcctgcagacccgcagcaccgccgagtggatcgccctgctggaggacaaggccgtgccctgcggccccatcaacaccatcgcccaggccttcgacgacccacaggtgcgcgcgcgcggcatccgcagggagctgccccgcgacgccggcgacggcatcgcccccatggccacggtggccaaccccatgcggctgtcgggcacgcccgtcagctaccatcgcgcgccacccgcgctcggccagcacaccgacgaggtgctgcgcgagctgggcctggatgcttcggccatcgcagcgctcaaagcggggggtgccatctga

SEQ ID NO: 6910 - protein, 418 aa, Acidovorax sp. JS42
MSASTPRGALDGIKVLDLSRVLAGPWCTQMLADLGADVVKVERPQAGDDTRHWGPPFLKDDAGRDTREASYFTACNRNKRSITVDMAHPEGQALLRRMAAEADVVVENFKVGGLAQYGLDYASLKALNPRLVYCSITGFGQDGPYAERAGYDLMVQAMCGLMSITGHADGQPGGGPLKVGVAVVDVFTGLYASNAILAALNARDNARNGTGEGQHIDMALLDVGMAVLANQAAGYLATGQAPGRAGNIHPSLAPYQDFRSRDGNVLLAIGNDGQFARFCQACGHPEWAQDARFATNTARVQHRAALLALMEPVLQTRSTAEWIALLEDKAVPCGPINTIAQAFDDPQVRARGIRRELPRDAGDGIAPMATVANPMRLSGTPVSYHRAPPALGQHTDEVLRELGLDASAIAALKAGGAI

SEQ ID NO: 6911 - DNA, 1221 bp, Magnetospirillum magnetotacticum MS-1
  CDS (1)..(1221): transl_table=11
atggagaagccgaagacgttcgggccgcttgccggcctccgggtcgtcgaactcgcgcacatcatggccggcccggtctgcgggctgatgctcggcgatatgggtgccgaggtgatcaaggtcgagaagatcgacggcggcgacgacacccgccgctcggtcccgcccgccctcgccggcgagagcgcggcctacatgatgatgaaccgcggcaagcgcggcatcgccctcgatctcaagagtgaggacggcaaggccgttctgcgtcgcctgctcgcggatgccgacgtgctgatcgagaattatcgcgccggcacgatggagcgcctcggcctcggctacgacgtgctgagccgggattttccggggctgatctactgttcgctctcgggcttcggccgctccggcccctatgccgagcgggcggggttcgacctcgtggcgcagggcatgagcgggctgatgagcatcaccggcgaggggccgggccgcccgccgatgaaatgcgggccgccggtgaccgacatcaccgccggcatcctggcggcgatgggcgtcctcgccgcctatgcccacaagcagaagaccggccaggggcaggtggtggatacctcgctgttcgaggcgggcatcaccctcacctactggcaatcggccatcgccatggcgaccggggtggcgccgggcccgatgggatcggcccatcccctcaacgccccctacgaggcgttcgagaccggagatggctggatcaccatcggcgcggccaaccagaccaactggctgcggctgctcgccgtcctcggtgccgaggatctcgccaacgatccgcgcttctcgaccaaccgtgagcgcatggcgaatcgcgaggccctggccgaggcgctggccccgcatttccggaacgcctcctccgccgagtggctggcgcggctggaggccggcggcgtgccggccgggccggtcctcgacgtgctggcgatgcaggccgatccccaggcccgtgcccgcgagatggtggtcgaggtcgagcacagccgcgtcggccggatggacaccctcgggcttccggtgaaattctcggcgaccccggggcgcgtccacggcccggcgccgttgctcggcgagcatagccgcgccatcctgcgtcaggccggctatgaggacgcggcgatcgacgacttgatcgcccgtggcgtcgtgcgcgagacgacggcctga

SEQ ID NO: 6912 - protein, 406 aa, Magnetospirillum magnetotacticum MS-1
MEKPKTFGPLAGLRVVELAHIMAGPVCGLMLGDMGAEVIKVEKIDGGDDTRRSVPPALAGESAAYMMMNRGKRGIALDLKSEDGKAVLRRLLADADVLIENYRAGTMERLGLGYDVLSRDFPGLIYCSLSGFGRSGPYAERAGFDLVAQGMSGLMSITGEGPGRPPMKCGPPVTDITAGILAAMGVLAAYAHKQKTGQGQVVDTSLFEAGITLTYWQSAIAMATGVAPGPMGSAHPLNAPYEAFETGDGWITIGAANQTNWLRLLAVLGAEDLANDPRFSTNRERMANREALAEALAPHFRNASSAEWLARLEAGGVPAGPVLDVLAMQADPQARAREMVVEVEHSRVGRMDTLGLPVKFSATPGRVHGPAPLLGEHSRAILRQAGYEDAAIDDLIARGVVRETTA

SEQ ID NO: 6913 - DNA, 1221 bp, Magnetospirillum magnetotacticum MS-1
  CDS (1)..(1221): transl_table=11
atgcgggctttggacgacatcttggtcctcgacctgtcgcgggtgctggccggtcccttctgcacccagatgctggccgatctgggcgccaaggtgatcaaggtggaaaagcccggttccggtgacgacaccaggggctggggcccgcctttcctcgccgacccggaaacggcggagaaaggcgacgccgcctattatctcgccgccaaccggggcaagcattcggtgaccatcgacttggcgaagcctgagggccaggagctgatccgcgccctggcggccaaggccgacgtgcttgtggagaactacaagctgggcgggctggccaaatacggcctggactacgcgtccttgaagaccatcaacccccggctggtctattgctcgatcacgggatttggccaggacggcccttatgcgccgcgcgccggttacgacttcatgatccaggccatgggcggcatgatgagcgtgacgggcgagaaggacggcctgcccggcggcgggccccaaaaggcgggcatcgccatcgccgatctgtccaccggtctgcacgcggtcatcgcggttctggcggcgctcaaccagcgccatcgcaccgggcgcggccagtatatcgatctcggcctgctggacgtgcaggtctccatgatgtccaatcaagccatgacctatctggtcagcggcaaagcccccggacgcgcgggcaacggccatgccgccatcgtgccctatcaggcctttgccaccatggacggccatctgatcatcgcggtgggcaatgacgggcaattcgccaaactggcggacgaactcgggcatcccgaatgggccgaggacgagcgcttcgcgctcaaccgcacccgcgtcgagcaccgcgacgtgctgacccccctgatcgaggcagaaacccggcgctatgattcggcccagttgctcgaagccttggagcgccgccagattccttgcggccccatcaacaccatggacaaggtcttcgccgatccccaggccaaggcgcgcggcctggaccaggaggttccccacgcaagggccgggaccattcccaccgtggccagcccgctgcgcctgtctgattcccccgtcctctatgaccggggaccgccgctgttgggcgagcacaccgagagcgtcctgaccgagatgctggggcttgatagcgcaatgctggccgcgcttcgcgacaaaggcgtggtgtga

SEQ ID NO: 6914 - protein, 406 aa, Magnetospirillum magnetotacticum MS-1
MRALDDILVLDLSRVLAGPFCTQMLADLGAKVIKVEKPGSGDDTRGWGPPFLADPETAEKGDAAYYLAANRGKHSVTIDLAKPEGQELIRALAAKADVLVENYKLGGLAKYGLDYASLKTINPRLVYCSITGFGQDGPYAPRAGYDFMIQAMGGMMSVTGEKDGLPGGGPQKAGIAIADLSTGLHAVIAVLAALNQRHRTGRGQYIDLGLLDVQVSMMSNQAMTYLVSGKAPGRAGNGHAAIVPYQAFATMDGHLIIAVGNDGQFAKLADELGHPEWAEDERFALNRTRVEHRDVLTPLIEAETRRYDSAQLLEALERRQIPCGPINTMDKVFADPQAKARGLDQEVPHARAGTIPTVASPLRLSDSPVLYDRGPPLLGEHTESVLTEMLGLDSAMLAALRDKGVV

SEQ ID NO: 6915 - DNA, 1212 bp, Magnetospirillum magnetotacticum MS-1
  CDS (1)..(1212): transl_table=11
atggccggtcccttgtcccatcttcgcgtcctcgatctcagccgggttctggccggtccgtggtccggtcaattgctggccgatctgggcgccgaggtcatcaaggtggagcgccccggcgagggcgacgacacgcggggctgggggccgcccttcctcaaggacaaggacggcaaggacaccgccgagagcgcctattacctctccaccaaccggggcaagcgctctgtcaccatcgacttcacccagcccgagggccaggaactggtgcgccgtctggccgccaagtccgacatcgtgctggagaatttcaagttgggtggcctggccaaatacggcctggactatgccgggctgaaggcggtcaagcccgacatcatctattgctccatcaccggctttggccaggacggcccctatgcccagcgggcgggatacgacttcctgatccagggcatgggtgggctgatgagcctgaccggagagcccggcggccagcccatgaaggtgggcgtggcgctcaccgatatcttcaccggcatgtatgcttcgacggcggtgctggccgccctggcccatcgcgaccgcaccggcgtggggcagcatatcgatctgtccctgctggacgtgcaggtggcggttctggccaatcaggcgaccaattatctggtgggaggcaaggtgcccaaccggttgggcaatgcccatcccaacatcgtgccctatcaggccttcgccaccaaagacgggcatatcattctggcggtgggcaatgacggccagttccgccgtttcacccaggtggcgggacggcccgaactggggaccgatcccctctttgcggccaatgtggaccgggtgcgcaaccgcgcccaactggttcccattctggaagaactgatcgcccagcgccccagcgcccgttggatcgatgagctggagcaggcgggcgtgccctgcgggcccatcaacaccctggatcaggtcttcgccgatccccaggtccgccatcgcggcatggcggtcaatatggcgcatccccaggcgggcgaggtcaccttggtggccaatcccatcaagatgtccgaaaccccggtggcctatgaccgggcgccgcccagtctgggagcggacagctccgaagtgctgaccacgttgctgggtctcgacaccgatgaactggggcggttgggcgccaagggcatcatctga

SEQ ID NO: 6916 - protein, 403 aa, Magnetospirillum magnetotacticum MS-1
MAGPLSHLRVLDLSRVLAGPWSGQLLADLGAEVIKVERPGEGDDTRGWGPPFLKDKDGKDTAESAYYLSTNRGKRSVTIDFTQPEGQELVRRLAAKSDIVLENFKLGGLAKYGLDYAGLKAVKPDIIYCSITGFGQDGPYAQRAGYDFLIQGMGGLMSLTGEPGGQPMKVGVALTDIFTGMYASTAVLAALAHRDRTGVGQHIDLSLLDVQVAVLANQATNYLVGGKVPNRLGNAHPNIVPYQAFATKDGHIILAVGNDGQFRRFTQVAGRPELGTDPLFAANVDRVRNRAQLVPILEELIAQRPSARWIDELEQAGVPCGPINTLDQVFADPQVRHRGMAVNMAHPQAGEVTLVANPIKMSETPVAYDRAPPSLGADSSEVLTTLLGLDTDELGRLGAKGII

SEQ ID NO: 6917 - DNA, 1113 bp, Sulfitobacter sp. EE-36
  CDS (1)..(1113): transl_table=11
atggcggccccgctggcagggctcaaggttattgagctggcacggattctggcgggcccttgggccggtcagacgctttcggatctcggctgcgaggtgatcaaggtcgaaagcccggcgggcgacgacacccgccagtgggggcctccgttcatcgagcgcggggaagataaatccgcgtcgtatttccactcggccaaccggggcaaagcctcggttgttgtcgatctgaccaccgatgaaggtcaggccaagatgaaagagcttttggccgatgccgacatcttgatcgagaatttcaaaaccggcgggcttgccaaatacgggatggattacgccagcctgtccaagcagttccccaagctgatctattgttcgatcaccggtttcgggcaagacggcccctatgcgcatcgcgcgggctatgatttcatcatccaaggcatgtccggcctaatgtcgatcacgggtgaacccgaccgtcagccgcagaaacacggcatggcgatcaccgatatctttaccggcgtctatgccaccacggccattctggcagcggtacaccagcgcagccagaccggcgtgggccagcatattgatatggcattgctggattgcgctgttgcggtgacgggcaatcaggcgatgaactatctgaccacgggcaatgcgccgacgcggatgggcaatgcacacccgaacctgaccccctacgaggtgttcacatcctctgacgggcatctgatcatcgccacgggcaatgatgggcagttccagcggctgtgccggatgctggggctggatgatatggcaacctcggcagactatgccaagaacgccgaccgcgtcgccaaccggcccgagatgatccgccgtctgaacggggctaccagccaacgcacccgcgacgatctgctcgccgcctgcgaggcagagggcgtgccagccggtccgatcaacgacatggccgatatgttcgaagacccccaagtcatcgcgcgcggcatgaaggtcgaactggacggggtgccgggcatccggtcgccgttcaaattctcgggcgctgaactggctttgcatcgcgccgcgccaaagctggggcaggacgactag

SEQ ID NO: 6918 - protein, 370 aa, Sulfitobacter sp. EE-36
MAAPLAGLKVIELARILAGPWAGQTLSDLGCEVIKVESPAGDDTRQWGPPFIERGEDKSASYFHSANRGKASVVVDLTTDEGQAKMKELLADADILIENFKTGGLAKYGMDYASLSKQFPKLIYCSITGFGQDGPYAHRAGYDFIIQGMSGLMSITGEPDRQPQKHGMAITDIFTGVYATTAILAAVHQRSQTGVGQHIDMALLDCAVAVTGNQAMNYLTTGNAPTRMGNAHPNLTPYEVFTSSDGHLIIATGNDGQFQRLCRMLGLDDMATSADYAKNADRVANRPEMIRRLNGATSQRTRDDLLAACEAEGVPAGPINDMADMFEDPQVIARGMKVELDGVPGIRSPFKFSGAELALHRAAPKLGQDD

SEQ ID NO: 6919 - DNA, 1107 bp, Roseovarius nubinhibens ISM
  CDS (1)..(1107): transl_table=11
atgaccagcccgctggatggtttgaaagtcattgaactggcacgcattctggccggcccctgggccggtcagacgctgtcggatctgggcgcggatgtgatcaaggtcgagagcccggcgggggatgacacccgcaattggggcccgccctttatcgagcgtgaggacgaccgcagcgccgcctatttccacggctgcaaccggggcaagaccagcgttgcggtggatttccgcaccgaagagggccaggctcaggtccgcgagatggtccgcgacgccgatattctcatcgagaatttcaaggtcggcgggctcgagaaatacgggctcgactatgccagcctgcgcgaaatcaacccgcggctgatctattgttcgatcaccggctttgggcaggatgggccttatgcgcatcgtgcgggctatgattacatcattcagggcatgtctgggctgatgtcgatcaccggcgatccggcggggcagccgcagaaggttggcgtggcgatcaccgatgtctttaccggggtctatgccaccaccgcgatccttgccgcgctgcatcagcgtgagcgcaccggcgaggggcaacagatcgatatggcgctgctcgatgtggcggtggcggtcacggccaatcaggcgatgaactacctgtccaccggcgatgcgccgcagcggatgggcaattatcatcccaacctgtcgccctatcaggtgttcgactgctcggacgggcatatcatcatcgccaccggaaatgacccgcaatatcaacggctttgcgaccttttgggcctgcccgagctggcgcaggcgccggaatacctcaccaatgccgaccgggtgaagaaccgcgaggcgctgaccgcgcggctcaatgccgcctcggcgcgctatagcaaggcggcgcttctggcggcctgcgaggcgcagggcgtgccggcggggccgatcaacgatatggacgaggtgtttgccgacccgcaagtgcaggcccgtggcatgcgcatcgaccccgaaggggtgcccggcgtgcgggcgccgatgagcttttcggcggccgagctcaagctcgaccgggcgtcgccgaagctcggcaaataa

SEQ ID NO: 6920 - protein, 368 aa, Roseovarius nubinhibens ISM
MTSPLDGLKVIELARILAGPWAGQTLSDLGADVIKVESPAGDDTRNWGPPFIEREDDRSAAYFHGCNRGKTSVAVDFRTEEGQAQVREMVRDADILIENFKVGGLEKYGLDYASLREINPRLIYCSITGFGQDGPYAHRAGYDYIIQGMSGLMSITGDPAGQPQKVGVAITDVFTGVYATTAILAALHQRERTGEGQQIDMALLDVAVAVTANQAMNYLSTGDAPQRMGNYHPNLSPYQVFDCSDGHIIIATGNDPQYQRLCDLLGLPELAQAPEYLTNADRVKNREALTARLNAASARYSKAALLAACEAQGVPAGPINDMDEVFADPQVQARGMRIDPEGVPGVRAPMSFSAAELKLDRASPKLGK

SEQ ID NO: 6921 - DNA, 1191 bp, Oceanicola batsensis HTCC2597
  CDS (1)..(1191): transl_table=11
atgaacgcggcggctgacagtggcccgctggccggtctcagggtgatcgacctcgggcaggtctaccttgggccctattgcggtctgatgttcgcgctcatgggggcagaggtcatcaaggtcgagccgcccggcggcgacagtatccgcggcatcgcgggtgggcgcgagaaccccgcagcgatgatgctcaattccagcaaacagagcgtgacgctcgatctggggtccaaggacgggcgcaccgccctgctggcgctggcagatacggccgatgttctaatcgagaatttccgtcccggtacaatggagaaactggggctggggcgggaaacactttgtgcccgcaatccgcgcctggtcatggggtcaggaaagggctacgcggaagattcagccttccgtgatgcggcagcgatggatttccccattcaggccttgtccgggttgatgtcggtcacggggtttgctgacggaccgccggtgaaatgcggggccgccatcaccgattttttgggcggtatccatctgttcggcggcatcatggcggcgctgcacgtgcgcggcaccacagggcgcggcgatttcgtgcagatcgccatgcaggacgtggcgcatcacgcgctggcgtccaacatttccagttttctgcttgcgcccgacgggttcacggacagggccgggaacggtcaggcggtgctcaaggtcgcgccttacgacctgtttccggcgcgcgatggacaggtggcgatcatgtgcctgaacgatcgccactggcaacaactgacccgcgccatgggtcgcagggatcttgcagatgatccggaattggccgaggggcccgcgcgctgcgcgcgccgggccgaggtcgatggatgggtgtccgagtggacctcctgccatacccgcgacgacatttttgcggccttgagcgccgcgcatgtgccgggcgctccggtgcgcacaatcggagaggtggtatccgacgaggacatgcgcgcccgcggcatgatccgggatcttccgcatcccgagctgggcacggtccccgttccggggctgcccattcggtttgccgggcacgcacaggccgcgcccgaacccgcaccagccgcaggcgccgatacggcacgcattctgaccgccctgaaccggggccggccttccgctcaatcaaaggacaacaactga

SEQ ID NO: 6922 - protein, 396 aa, Oceanicola batsensis HTCC2597
MNAAADSGPLAGLRVIDLGQVYLGPYCGLMFALMGAEVIKVEPPGGDSIRGIAGGRENPAAMMLNSSKQSVTLDLGSKDGRTALLALADTADVLIENFRPGTMEKLGLGRETLCARNPRLVMGSGKGYAEDSAFRDAAAMDFPIQALSGLMSVTGFADGPPVKCGAAITDFLGGIHLFGGIMAALHVRGTTGRGDFVQIAMQDVAHHALASNISSFLLAPDGFTDRAGNGQAVLKVAPYDLFPARDGQVAIMCLNDRHWQQLTRAMGRRDLADDPELAEGPARCARRAEVDGWVSEWTSCHTRDDIFAALSAAHVPGAPVRTIGEVVSDEDMRARGMIRDLPHPELGTVPVPGLPIRFAGHAQAAPEPAPAAGADTARILTALNRGRPSAQSKDNN

SEQ ID NO: 6923 - DNA, 1119 bp, Oceanicola batsensis HTCC2597
  CDS (1)..(1119): transl_table=11
atggcggcgccgctggacgggttgcgggtcgtcgaactcgcccggatcctggccggcccctgggccggtcagaccctgtcggacctcggtgccgaggtgatcaaggtcgaaagccccgagggcgacgacacgcgccgctggggtccgcccttcatcgaccgcgatgaggaccataccgccgcctatttccattcctgcaaccgcggcaagacctcggtggcggccgatttccgcaccccggaggggcaggagacggtgcgcgacctggtccgcgacgccgatatcctgatcgagaacttcaaggtcgggggcctgaagaaatacgggctcgactatgacagcctgtcggagctgaacccgcggctgatctactgctcgatcaccggtttcgggcaggacggcccctatgcgcaccgggcgggatacgactatatcatccagggcatgtcggggctgatgtcgctgaccggagagcccgacggccagccgctgcgggccggggtggcggtgaccgacctcttcaccggggtctattccgcgaccgcgatcctggcggccctgcaccagcgcgccgcgaccgggcgcggccagcacatcgacatgtccctgctggattgcgccgtctcggtcacggcgaaccaggcgatgaactatctttcgaccggaacgccgccggcgcggacggggaattatcatcccaacctcaccccctaccaggtcttcgaggtctcggacgggttcatcatcatcgccacgggcaacgatgcccagtacggacggttgtgcgacgtgctgggcctgcccgggatgaaggacgacccggattacctccacaacccgcagcgggtggccaaccgcccccggatgatccgccgcctgcaggaggcctgcctgcgcttcaccaaggccgagcttctggcgcaatgcgaggccaaggggatccccgccgggccgatcaacgacatggccgaggtcttcgaggatccgcaggtgatcgcgcgcggcatgcggatcgatcccgagggcgtgccgggcgtgcgcggccccttccgtttctcggaggccgagctgaaactggagcgcgccagcccgaaactggggacgcgcggcgagtcctga

SEQ ID NO: 6924 - protein, 372 aa, Oceanicola batsensis HTCC2597
MAAPLDGLRVVELARILAGPWAGQTLSDLGAEVIKVESPEGDDTRRWGPPFIDRDEDHTAAYFHSCNRGKTSVAADFRTPEGQETVRDLVRDADILIENFKVGGLKKYGLDYDSLSELNPRLIYCSITGFGQDGPYAHRAGYDYIIQGMSGLMSLTGEPDGQPLRAGVAVTDLFTGVYSATAILAALHQRAATGRGQHIDMSLLDCAVSVTANQAMNYLSTGTPPARTGNYHPNLTPYQVFEVSDGFIIIATGNDAQYGRLCDVLGLPGMKDDPDYLHNPQRVANRPRMIRRLQEACLRFTKAELLAQCEAKGIPAGPINDMAEVFEDPQVIARGMRIDPEGVPGVRGPFRFSEAELKLERASPKLGTRGES

SEQ ID NO: 6925 - DNA, 1152 bp, Erythrobacter sp. NAP1
  CDS (1)..(1152): transl_table=11
atgtggctcgacacaccccgtaatcccaacgccccgcttgccggattcaaggtgctggaactcgcgcgcgttctcgcgggcccatgggctggacagatcctgtccgatcttggcgctgatgtcatcaaggtcgaaagccccgaaggcgatggaactcggctttggggaccgccctgggtcgaacgcagagggcctgatggcgaaacccggcgcgaggcggcctattaccacgcagccaatcgcgggaagcgctccatcattgcggacttcgcggaccaatccgaccgcgagcggattgtcgagctcgcgcgcggcgctgacgttttgatcgagaatttcaagaccggtggtctgataaagttcgggctggattatgaagcgctttcgcagatcaatcccgcgctggtctattgttcgatcacaggctttggccagacaggccctcgcgctcacgaagcgggctacgatttcgtcattcagggcatgagcggctttatgtccgtgacgggcgaacctgacggcgtgccggtcaagatgggcgtatctataagcgacctgtctacgggcgtttacgcggcgaacgcaattcaggctgcgcttcttcagcgtgcgcgcaccggcaaggggcaacatgtcgacatgagtctgctcgattgctcggtcgcattgctcgcaaaccaggcaagctatcactttacgactggcgaaaacccgccgcgcatgggcaacgcgcatgcgcaggttgcaccctacggcgtgtttccagtgagcgacgggcacgtcatcctcgcccctgccaatgatcgccttttcgcaaggctcgtagaggttctcggcctccccgagcttgcaaatgatccgcgtttcgctggcaatggcgatcgtgtcacaaatgcaggtgaactcgacgaactcatcgcccaggcgacggtcacttggtccaaggccgacctgttggctgcatgcaaggccaaaggcgtgcctgccggaccaatcaatcacttggatgaggtgttctcggaccctcaggtgatcgctcgcggtatgcggatcgatctcggcggaatgccaggggttcgtagcccgttcacattttcggatgctgagcttgcgctcgaccgtccttcaccaatgcttggtgaggacggctag

SEQ ID NO: 6926 - protein, 383 aa, Erythrobacter sp. NAP1
MWLDTPRNPNAPLAGFKVLELARVLAGPWAGQILSDLGADVIKVESPEGDGTRLWGPPWVERRGPDGETRREAAYYHAANRGKRSIIADFADQSDRERIVELARGADVLIENFKTGGLIKFGLDYEALSQINPALVYCSITGFGQTGPRAHEAGYDFVIQGMSGFMSVTGEPDGVPVKMGVSISDLSTGVYAANAIQAALLQRARTGKGQHVDMSLLDCSVALLANQASYHFTTGENPPRMGNAHAQVAPYGVFPVSDGHVILAPANDRLFARLVEVLGLPELANDPRFAGNGDRVTNAGELDELIAQATVTWSKADLLAACKAKGVPAGPINHLDEVFSDPQVIARGMRIDLGGMPGVRSPFTFSDAELALDRPSPMLGEDG

SEQ ID NO: 6927 - DNA, 1221 bp, Pseudomonas putida GB-1
  CDS (1)..(1221): transl_table=11
atgggcgcgctatcacatctgcgggtgctggacctttcgcgcgtgttggccggcccgtggtctggccagattctcgctgaccttggcgctgacgtgatcaaggtcgagcgccctggcagtggcgacgatacccgctcatgggggccacccttcctcaaggatgtcgagggtgagaacaccggcgaggcggcctactacctgtcggccaatcgcaacaagcgttcggtgaccatcgactttacccagcccgaggggcagcgcctggtgcgtgagttggcggctaagtgcgatatcgtcatcgagaacttcaaggtgggtgggctggctgcctatggcctggactaccagagcctgaaggcagtcaacccacagcttatctattgctccattacgggcttcggccagaccggcccatatgccaagcgcgctggctatgacttcatgatccaggggctgggtgggctgatgagcctgaccggtcgcccggaaggtgaggcaggtgcagggccggtgaaggtgggtgtagcgcttaccgacattctgaccgggctgtattccacggttgccatgcttgctgccctcgcccaccgggatcagaccggggtcggccagcatgtcgatatggcattgctcgatgtgcaggtggcctgcctggcgaatcaggcaatgaactatctgaccacaggcacctcgcctcgccggctgggtaatgcgcatcccaacatagtgccttatcaggatttcccgacggcggatggcgacttcattcttaccgtgggtaatgacagccagttccgcaagttcgccgaagtggccgggcagccgcaatgggcggatgacccgcgctttgtgaccaataaactgcgggtggcgaacagggccgagctgattccactgatacgccaagccacggtgttcaagaccacggctgaatgggtgcgccagctggaagctgcaggggtgccgtgtgggccaatcaatgacctggcgcagatgttccaggacccccaggtgctggcgcgagggctggcggtaagtatggcgcatccgttggcgggtagcgtaccgcaggtcgcgagcccgatacgcttgtcggagacgccggtggagtatcgccgggcgccgccactgttgggcgagcataccgacgtggtgctgggggaagtgttggggttgggtgccggcgagctgcagcgactacgcggcgctggtgtactttag

SEQ ID NO: 6928 - protein, 406 aa, Pseudomonas putida GB-1
MGALSHLRVLDLSRVLAGPWSGQILADLGADVIKVERPGSGDDTRSWGPPFLKDVEGENTGEAAYYLSANRNKRSVTIDFTQPEGQRLVRELAAKCDIVIENFKVGGLAAYGLDYQSLKAVNPQLIYCSITGFGQTGPYAKRAGYDFMIQGLGGLMSLTGRPEGEAGAGPVKVGVALTDILTGLYSTVAMLAALAHRDQTGVGQHVDMALLDVQVACLANQAMNYLTTGTSPRRLGNAHPNIVPYQDFPTADGDFILTVGNDSQFRKFAEVAGQPQWADDPRFVTNKLRVANRAELIPLIRQATVFKTTAEWVRQLEAAGVPCGPINDLAQMFQDPQVLARGLAVSMAHPLAGSVPQVASPIRLSETPVEYRRAPPLLGEHTDVVLGEVLGLGAGELQRLRGAGVL

SEQ ID NO: 6929 - DNA, 1188 bp, Marinobacter sp. ELB17
  CDS (1)..(1188): transl_table=11
atgcttcccttgaaaaacataaaagttctggatgtctcgcaaatcatggccgggccctattgcaccatggtactgggtgacatgggggctgaagtcattaaggtggaaaaagccaatggtggcgatgacagccgacaaatggggccctacgttaatgacgaatctacttgtttctgccagatcaaccgaaacaagaaaagcatttccttaaacctcaaggatgaacgcgcgagggagatattttatcggctcgccaaagacgcagatgtcattgtcgagaactatcggcctggagtgacgaaatctctggggatcgattatgagaccatcaaaatgatcaaccccggcataatttactgctctatttcaggctatggtcaaacgggtccgtacagcaataaagggggttttgatctggtggcccagggcatgagcggtttgatgtcgatgacgggcgagccaggtcgacgaccggtaaaaaccggcattgccgtttacgatatcggcgcaggcatcaccgcggtctattcgattttggcggcgtgcatacacaaaatgaataccggtgaaggtcaacagattgatatagccatcaccgaatgtggcctgccctggttcagttgggaggcggcggcgtacttctccgaaggcaccgtgccggaagccaccggctggcgtcatcgcgtatcagccccttatcaagccgtcaaaacgcaggatggctacatgatgctgggctgcgctaaccagcgaacctgggagcgcttctgccaggatgtcatcgcgcgggacgatttgattgctgatgagcggtttttaaccaatagcgaccgtgggcgcaatgttgagcaactcgaacgtgttctggaagaaatcctgtcccttcgtgaaacggcgcattggctggatcgatgcgacattgcaggcgtgcccgccggaccgatcaacaatttcgcccaggccgtgcaggatgagcattttctcgccagaggcatggtcgaggaaatcgaccacccggtgatcggcaagatgaaaacgatcggttttcccagcaaattttcccgtacaccctcacagattcgttacccggcgcccctctttgcgcaacacaccgatgaaatcttgtatggcgctggtttgagcgcagaggaggttagtaatctccgccaggagggatgtatcaagtag

SEQ ID NO: 6930 - protein, 395 aa, Marinobacter sp. ELB17
MLPLKNIKVLDVSQIMAGPYCTMVLGDMGAEVIKVEKANGGDDSRQMGPYVNDESTCFCQINRNKKSISLNLKDERAREIFYRLAKDADVIVENYRPGVTKSLGIDYETIKMINPGIIYCSISGYGQTGPYSNKGGFDLVAQGMSGLMSMTGEPGRRPVKTGIAVYDIGAGITAVYSILAACIHKMNTGEGQQIDIAITECGLPWFSWEAAAYFSEGTVPEATGWRHRVSAPYQAVKTQDGYMMLGCANQRTWERFCQDVIARDDLIADERFLTNSDRGRNVEQLERVLEEILSLRETAHWLDRCDIAGVPAGPINNFAQAVQDEHFLARGMVEEIDHPVIGKMKTIGFPSKFSRTPSQIRYPAPLFAQHTDEILYGAGLSAEEVSNLRQEGCIK

SEQ ID NO: 6931 - DNA, 1194 bp, Marinobacter sp. ELB17
  CDS (1)..(1194): transl_table=11
atgattggcccactcaacggcatccgaattattgacctgaccgccatggtgtctggccctctggctaccatgatgctggcagaccagggcgccgaggtgatcaaggtcgagaatccgtccggcggcgatttcactcggtctgccgccaatcggcagggcaatgtgtcagcgtcttttctcaataacaaccgcaacaagaagtcggtggcgctcaacctgaaagagccggcgggtcgcgaagcgctgttaaagctggtggccaccgccgatgtgtttgtgcagaatttccgccccggtgtgatcgacaggatgggcctgggcgaggacgaattgcgcaaggttgctccgaacctgattatggtgtccatcagtgggtttggtgacaccggtcccttcgcccagcggccggtttacgatccgctgattcaggccctgtctggtctggccacggtgcaggcgggcactgacgaacggcgtccgcaactggtcagaaccatcctgcctgacaaactcaccggcgtaacggctgcccaggccatcaccgcggccctgtttgcccgcgagcgcaccggtgagggtcaacatgtccggctgtccatgctggacgccatcatcgcgtttctgtggagttctgacatgggcagccaaacgtttgtgcaacgcgaattgccacagcaggccgccgccagctttcaggatctgatctacgagacgaccaccggttatgtcaccatcgcggtgcagaatgaccgcgagtggcaggcgctgatccgtgctgtgaatcggccggaatgggccgaggacccgaggttcttgacggcagagctacggcagaaaaacatcgacgctcggcttgatctgatccagtccgttatcatgtcagactcggcagagcattggctggcgagactagaagaagagtcggtgccctgcgcgccggtactgacccgcacggaggtgttgaaccatccacaggttcaggccaatgacttactggtggagtacaaccacccgcaggctggctatattcgccagacccgcgccccggcccgattttcagccgcgccaacgcaacctttgcaaggcgccccggccctcggtcaggacaccgtggctttgctggcaggctgtggctattccgggggtgacatacaaacgatggtcgatacaggcgtggcaggcctgccagagtaa

SEQ ID NO: 6932 - protein, 397 aa, Marinobacter sp. ELB17
MIGPLNGIRIIDLTAMVSGPLATMMLADQGAEVIKVENPSGGDFTRSAANRQGNVSASFLNNNRNKKSVALNLKEPAGREALLKLVATADVFVQNFRPGVIDRMGLGEDELRKVAPNLIMVSISGFGDTGPFAQRPVYDPLIQALSGLATVQAGTDERRPQLVRTILPDKLTGVTAAQAITAALFARERTGEGQHVRLSMLDAIIAFLWSSDMGSQTFVQRELPQQAAASFQDLIYETTTGYVTIAVQNDREWQALIRAVNRPEWAEDPRFLTAELRQKNIDARLDLIQSVIMSDSAEHWLARLEEESVPCAPVLTRTEVLNHPQVQANDLLVEYNHPQAGYIRQTRAPARFSAAPTQPLQGAPALGQDTVALLAGCGYSGGDIQTMVDTGVAGLPE

SEQ ID NO: 6933 - DNA, 1344 bp, Aspergillus oryzae
  CDS (1)..(1344)
atgagcgtcacattgaagttgcaccaggcttttagagcccgtcggccagctctccgctggtcgagctctgttctccgcaccacagctcaatggcgcacatactccagcacaccggcggacgatacactacccttgaagggcgttcgggtgcttgatatgacaagggttttggctggtccatactgtacgcagattcttggagatttaggagcagatgttatcaaaattgaacacccggtgcggggcgatgacactcgcgcctggggaccaccatatgccaaataccaggatgagtcgcgacaaggtcccggcgaaagcgcatattatctaggtgtcaaccgcaacaagaaatctttaggactgtcgtttcaacacaagtcaggcgtggaaatcctgcaccgccttgcgaaagaatgtgacgttctcgtcgagaactacctccctggaagtctgaagaaatacaacatggactacgaaacgctgcgagagattaaccccaagctgatctacgcgagtatcaccggatacgggcagacggggccgtacagtaaccgggctgggtacgatgtcatggtcgaggcggagatgggcttgatgcatattactggcgccaggggtggggatccggtgaaagttggtgtagcggttacggatttgacgactgggttgtatacatctaatgcgattatggcggcgctgctggctcgcgtgaggacgggtatgggccaacacatcgatgcttgcttgagcgattgtcaggtcgcgacgctggcaaatattgctagctctgcgctgattagtggggagaaggatactggaagatgggggaccgcgcatccttccattgttccttaccggagttatcagacgctggatggagacattctctttggcggcgggaacgacagactgttcggtgtgttgtgcgaccgtttaggacacccagagtggaagaccgatccccggttcgttaccaacagtgaccgtgtcaagaatcgaggggagattgatggcctcatcgaggagaaggtcaaacaaaagacgacgcaagaatggctggagatcttggaaggcagcgggatgccatatgccgccgtcaatgatattcaagggaccctcaaccattctcacgtccaagctcgtgggatggtcaccgaagttgatcatccagcatgcggtcccatcaagctagtcaacacgccgattaagtattcccatgccacccctggcgtgcggacgccgcccccaacccttggccaacacacggatgagattcttgaggagattctcgaatacggtaaggatgatattgctcgtttgaagcaagacggtgtagtgtcataa

SEQ ID NO: 6934 - protein, 447 aa, Aspergillus oryzae
MSVTLKLHQAFRARRPALRWSSSVLRTTAQWRTYSSTPADDTLPLKGVRVLDMTRVLAGPYCTQILGDLGADVIKIEHPVRGDDTRAWGPPYAKYQDESRQGPGESAYYLGVNRNKKSLGLSFQHKSGVEILHRLAKECDVLVENYLPGSLKKYNMDYETLREINPKLIYASITGYGQTGPYSNRAGYDVMVEAEMGLMHITGARGGDPVKVGVAVTDLTTGLYTSNAIMAALLARVRTGMGQHIDACLSDCQVATLANIASSALISGEKDTGRWGTAHPSIVPYRSYQTLDGDILFGGGNDRLFGVLCDRLGHPEWKTDPRFVTNSDRVKNRGEIDGLIEEKVKQKTTQEWLEILEGSGMPYAAVNDIQGTLNHSHVQARGMVTEVDHPACGPIKLVNTPIKYSHATPGVRTPPPTLGQHTDEILEEILEYGKDDIARLKQDGVVS

SEQ ID NO: 6935 - DNA, 1257 bp, Aspergillus oryzae
  CDS (1)..(1257)
atggctccctggcggccgctatctcaggcgttgtattctcggataccaggcgctcgcagcgtttcaacccagacctcacctaaaggacccctctctggtattacagtggttagccttgaacaggccattgcagctccattttgtacgcggcagctggcagatcttggggcccgcgtcatcaagattgagcgacctggtgtcggggactttgcacgtaattacgacactcgggtcaatggtcttgcatcgcacttcgtctggacaaatcggtcgaaggaaagtctcgcgttggatctcaagaagccacgcgaccatggggtcttgatgcgcttgctgggtaaagcagacgtcctagttcagaacttggctccgggagctagtgcacggctaggactgtcccatgaagagctcaaggcgaagcatccgtcactgattgtgtgcaatatctctggatacggaccagatggtccgtatcgcgataagaaggcctacgacttgcttatacaaagcgaggcaggcatgctctctgttacagggaccgcccaagagcctgctaaagtcggcatttccatcgcggatatttctgccggaagctacgcgtactctaacattttggcggctatcatccaaaggggaaatgacccggagaagcgtgggtgtaacatcgatatctctatgttggagagtatggtcgaatggatgagctttccgctgtactatacctaccagaacgcacctagaccgacaccaacgggagcctcgcacgctgcagtctacccgtatgggccgtttgaaactggagatggaaagtctgtcatgctggggatccagaatgaacgtgaatgggtcaatttctgcgagaaagttctgtctttgccagacttgatgacggatgaacggtttgtcaacaactcccttcgatcgcagaatcgtgatgcgcttaaggaaatcatttgcgaggctttctcatcgttgacagcggagaaagtggtcaccctcttggatgaggccgccatcgccaatggtaaggtcaacgatatgcagggtgtttgggaacatccacagctcaaagcgcgtggccggtggactgaggtttccactccggctggcacagttccggccttgctgccaccaggactaacgcaaggggatgctggtagattctcggctagaatggatgcagttccggatgtcggagaacataacgcggcgatcctggccgagttggggatcgaagatgcgggggaggatttataa

SEQ ID NO: 6936 - protein, 418 aa, Aspergillus oryzae
MAPWRPLSQALYSRIPGARSVSTQTSPKGPLSGITVVSLEQAIAAPFCTRQLADLGARVIKIERPGVGDFARNYDTRVNGLASHFVWTNRSKESLALDLKKPRDHGVLMRLLGKADVLVQNLAPGASARLGLSHEELKAKHPSLIVCNISGYGPDGPYRDKKAYDLLIQSEAGMLSVTGTAQEPAKVGISIADISAGSYAYSNILAAIIQRGNDPEKRGCNIDISMLESMVEWMSFPLYYTYQNAPRPTPTGASHAAVYPYGPFETGDGKSVMLGIQNEREWVNFCEKVLSLPDLMTDERFVNNSLRSQNRDALKEIICEAFSSLTAEKVVTLLDEAAIANGKVNDMQGVWEHPQLKARGRWTEVSTPAGTVPALLPPGLTQGDAGRFSARMDAVPDVGEHNAAILAELGIEDAGEDL

SEQ ID NO: 6937 - DNA, 1191 bp, Saccharopolyspora spinosa
  CDS (1)..(1191): transl_table=11
atgacggggtccgcacataccgaggggctgaacctgctcgcgggggttcgggtcgtcgacttcacccaggcgctgtccggcccgtactgcacgctgatgcttgccgatctcggtgctgaggtgatcaaggtcgaaagtccgcatcgtggtgacgatgcgcggcattgggggccgccatttgtgggaaacgatgcggcgtacttcatgtcggtcaaccgcaacaagcacagcgtcgcactcgacctcaaagacgacggggaccgcaggcgggtgcgcgagctgatcggcaccgcggacgtcgtcgtcgaaaactggcgaccgggtacggccgaccgactgggattgggtgccgcgtccctgcgcgccgcacacgccgcgttggtctattgctccatcagtggattcgggcagggccagggaacccggtccggctacgaccagattgtgcagggcaccagcggcgtcatgcggatgacgggccgaccgggtgagccggcgaagtggggcgtcccggtcgccgacatcgcggctggcatgttcgccgctaccgccgtcgtcagtgcgctgttcgaacgttcacgcaccggactcggccgcgccatcgacatcgcgatgcaggacagcgtcgtctccatgctgacgcaccacgcggcccggttcctcgaaaccggtgtcgtgccggaatccgaccacaacggtcattccacgatcgctccctatggcatgttccgcacgggcgatggcttcatcaacatgtgcgtcggcaacgactcccaattcgagcggatgtgcgaggcactcggacagcccgacctggccgttgacgcgcggttccgcaccaacccgctgaggctggctcacaagcacgagcttctgcgcgaggtcgacgccaccctcacccgcatgagcaccgaacaggtcatcgccgagctcgaagcggtcggggtgccggtcgggcctgtcctggacatcggaagcgtgctggaagaccctgccacgcacgagcgtcagatggtccttcatttccatcgcgacgatgcgggcgaggcccgggtcgtcaacacaccgtggaagttcgacggaatcgcccctacagtccggctggcgccccctcggctgggcgaacacaacgacaaggtcattggtggtctgtccgtcgattcggcaggcagcaacggaaggaagagctga

SEQ ID NO: 6938 - protein, 396 aa, Saccharopolyspora spinosa
MTGSAHTEGLNLLAGVRVVDFTQALSGPYCTLMLADLGAEVIKVESPHRGDDARHWGPPFVGNDAAYFMSVNRNKHSVALDLKDDGDRRRVRELIGTADVVVENWRPGTADRLGLGAASLRAAHAALVYCSISGFGQGQGTRSGYDQIVQGTSGVMRMTGRPGEPAKWGVPVADIAAGMFAATAVVSALFERSRTGLGRAIDIAMQDSVVSMLTHHAARFLETGVVPESDHNGHSTIAPYGMFRTGDGFINMCVGNDSQFERMCEALGQPDLAVDARFRTNPLRLAHKHELLREVDATLTRMSTEQVIAELEAVGVPVGPVLDIGSVLEDPATHERQMVLHFHRDDAGEARVVNTPWKFDGIAPTVRLAPPRLGEHNDKVIGGLSVDSAGSNGRKS

SEQ ID NO: 6939 - DNA, 1194 bp, Clostridium propionicum
  CDS (1)..(1194): transl_table=11
atgaaaagacccttggaaggtattcgtgtacttgatttaacacaggcttacagtggccccttttgtacaatgaatcttgctgatcatggtgctgaggttattaaaattgagcgccccggcagtggagatcaaacaagaggttgggggcctatggaaaatgactacagtggctactatgcttacattaaccgtaataaaaaaggaatcaccttaaatcttgcttccgaagaaggaaagaaagtttttgccgaattggttaaatctgccgatgtgatttgcgaaaactataaggttggtgttttagaaaaattaggcttttcctatgaggtcttaaaagaactcaacccccgcatcatttatggctccatcagcggttttggattaacaggtgaattgtcctcccgcccctgctatgatatcgtcgctcaagcaatgagcggaatgatgagtgtaaccggctttgcagacggtcctccctgcaaaatcggcccttctgtaggagatagctatactggtgcatatttgtgcatgggtgttttgatggcattatacgaaagagaaaaaacaggcgttggccgccgtatcgatgtgggaatggtagataccctgttctctacaatggaaaactttgttgttgaatacaccattgctggtaagcatccccaccgtgcaggcaatcaagatccaagtattgccccttttgactcctttagggcaaaagattcggattttgtaatggggtgtggcacaaacaaaatgtttgcaggactatgtaaagcaatgggcagagaggatttgattgatgatcctcgtttcaatacaaacctgaatcgttgtgataactatttaaatgacttaaagccaatcatcgaagaatggacccaaacaaagaccgttgcagagttagaggaaatcatctgcggactttccattcccttcggcccaatcctcacgattcccgagatttctgagcattccttaacaaaagaaagaaatatgctttgggaagtttatcagcctggcatggatagaacaattcgcattcccggctcccctattaaaatccacggtgaagaagataaggctcagaaaggtgcccctattctgggagaagacaattttgctgtctacgcagaaattttaggtctctcagtagaagaaattaaatcactggaagagaaaaatgtcatctaa

SEQ ID NO: 6940 - protein, 397 aa, Clostridium propionicum
MKRPLEGIRVLDLTQAYSGPFCTMNLADHGAEVIKIERPGSGDQTRGWGPMENDYSGYYAYINRNKKGITLNLASEEGKKVFAELVKSADVICENYKVGVLEKLGFSYEVLKELNPRIIYGSISGFGLTGELSSRPCYDIVAQAMSGMMSVTGFADGPPCKIGPSVGDSYTGAYLCMGVLMALYEREKTGVGRRIDVGMVDTLFSTMENFVVEYTIAGKHPHRAGNQDPSIAPFDSFRAKDSDFVMGCGTNKMFAGLCKAMGREDLIDDPRFNTNLNRCDNYLNDLKPIIEEWTQTKTVAELEEIICGLSIPFGPILTIPEISEHSLTKERNMLWEVYQPGMDRTIRIPGSPIKIHGEEDKAQKGAPILGEDNFAVYAEILGLSVEEIKSLEEKNVI

SEQ ID NO: 6941 - DNA, 1218 bp, Acinetobacter sp
  CDS (1)..(1218): transl_table=11
atgggtgcattggaaggtattcgcgtattggatttaagccgcgtactggcaggtccttggtgtggtcagattctggcggatttgggtgctgaagtgattaaagttgaacgtcccaaaacaggtgatgatacccgcttgtggggaccaccatggatgaaggatgatcagggtgaagatacgcaggaagctgcctattaccagtctgctaaccgcaataaactttctatcgcaattgatattgccacactggaaggtcagaaattagttcgtacactggcagcaggttcggatgttttaattgaaaactacaaagcgggctcactgaaaaagtacggtctggattatgacagcttaaaagcgattaatccgaaattagtgtattgctcgattaccggatttggccaaaccggtccacgtgcgccagaaccgggttatgattttatcattcaaggtatgggcggtttgatgtctgtgaccggagagaaagatgaccttccgggcggtgggccgcaaaaagtgggtgtggcttttgccgacctgacgactgggctttatgccaccattgcgattcaagcatcacttttgaaccgcaccatgacaggtctgggtcagtatattgatatggcgttattagatgtacaggttgcaacgttagccaatcaaggcatgaattatctatcttcgggtaaagtacctggacgttatggcaatgcacatgcgaatattgtgccttatcaagtgtttaaagcagccgatcaggactttattattgcctgtggaaatgacaagcaattcgttgcgctgtgtcaggccattggtttgccggagctgcagaatgatccgcgtttcttaagcaatgcgttacgaatccagcatcgtcaagagatggataaattactcggcacccattttaaaaccaattctgcacggcactgggtagatgcgattcacacgataaaagttccggtgggtttaatcaacaatttacagcaagcatttgaggagcctcaggtgattgcgcgcaatatgttggttgatatgaagcatccgttgaaggagaagttaacggtgattggttcacccattaaactgtcacgcaccccggtggaatataagaaagcaccgccaatgctgggtgaacatactgatgaaatcttaagtggcattctggatgcagaaaagattgctgaacttaggcagagaggtatcatcgggtaa

SEQ ID NO: 6942 - protein, 405 aa, Acinetobacter sp
MGALEGIRVLDLSRVLAGPWCGQILADLGAEVIKVERPKTGDDTRLWGPPWMKDDQGEDTQEAAYYQSANRNKLSIAIDIATLEGQKLVRTLAAGSDVLIENYKAGSLKKYGLDYDSLKAINPKLVYCSITGFGQTGPRAPEPGYDFIIQGMGGLMSVTGEKDDLPGGGPQKVGVAFADLTTGLYATIAIQASLLNRTMTGLGQYIDMALLDVQVATLANQGMNYLSSGKVPGRYGNAHANIVPYQVFKAADQDFIIACGNDKQFVALCQAIGLPELQNDPRFLSNALRIQHRQEMDKLLGTHFKTNSARHWVDAIHTIKVPVGLINNLQQAFEEPQVIARNMLVDMKHPLKEKLTVIGSPIKLSRTPVEYKKAPPMLGEHTDEILSGILDAEKIAELRQRGIIG

SEQ ID NO: 6943 - DNA, 1146 bp, Escherichia coli
  CDS (1)..(1146): transl_table=11
atgacaaataatgaaagcaaagggccgtttgaaggcttattagttatcgatatgacacatgtccttaatggacctttcggaactcaacttctttgtaatatgggcgcaagggtaattaaagttgagccgccgggtcatggtgatgatacccgcacatttggtccctatgtggatggacagtcactctattacagttttattaatcatggcaaagagagtgtggttcttgatttaaagaatgatcacgataaaagtatatttataaatatgctcaaacaagctgatgtattagctgagaattttcgcccaggtacaatggaaaaactggggttttcatgggaaacgcttcaagaaatcaacccgcgcctcatatatgcttcatcgtcaggtttcggacataccggtccgctaaaagatgctcctgcctacgataccatcattcaggcaatgagcgggataatgatggaaacaggatatcctgatgctccgccagtgcgcgttggtacatctcttgcggatctatgcggcggtgtctatttattcagcggaatagtgagtgcactttatggccgcgaaaagagccagagaggggcgcatgtcgatatagcgatgtttgatgccacgctgagttttctggagcatggtctgatggcatatatcgcaactgggaagtcaccacaacgtctgggaaatcgccatccctacatggcaccttttgatgttttcaatactcaggataagccgattacgatttgttgtggtaatgacaagcttttttctgcgttatgccaggcactggagcttacggaactggttaatgatccccgatttagcagcaatattttacgcgtacaaaaccaggctattcttaaacaatatattgagcggacgttaaaaacgcaggcagctgaagtttggttagccagaatacatgaagttggtgtacccgtcgcgccgttattaagtgtggctgaggccattaaattgccacaaactcaggcgagaaatatgttgattgaagccgggggaataatgatgccgggtaatccgataaaaatcagcggctgcgcggacccgcatgttatgccgggagcggcaacgctcgaccagcatggggaacaaattcgccaggagttctcatcataa

SEQ ID NO: 6944 - protein, 381 aa, Escherichia coli
MTNNESKGPFEGLLVIDMTHVLNGPFGTQLLCNMGARVIKVEPPGHGDDTRTFGPYVDGQSLYYSFINHGKESVVLDLKNDHDKSIFINMLKQADVLAENFRPGTMEKLGFSWETLQEINPRLIYASSSGFGHTGPLKDAPAYDTIIQAMSGIMMETGYPDAPPVRVGTSLADLCGGVYLFSGIVSALYGREKSQRGAHVDIAMFDATLSFLEHGLMAYIATGKSPQRLGNRHPYMAPFDVFNTQDKPITICCGNDKLFSALCQALELTELVNDPRFSSNILRVQNQAILKQYIERTLKTQAAEVWLARIHEVGVPVAPLLSVAEAIKLPQTQARNMLIEAGGIMMPGNPIKISGCADPHVMPGAATLDQHGEQIRQEFSS

SEQ ID NO: 6945 - DNA, 26 bp, Artificial sequence
  primer
atgtcttttcaccttcggcttttttc

SEQ ID NO: 6946 - DNA, 24 bp, Artificial sequence
  primer
ttatgatgagaactcctggcgaat

SEQ ID NO: 6947 - protein, 434 aa, Artificial sequence
  consensus sequence
  Variant (2)..(5): Xaa in position 2 to 5 is any amino acid
  Variant (7)..(7): Xaa in position 7 is any amino acid
  Variant (10)..(14): Xaa in position 10 to 14 is any amino acid
  Variant (15)..(16): Xaa in position 15 to 16 is any or no amino acid
  Variant (19)..(19): Xaa in position 19 is any amino acid
  Variant (20)..(23): Xaa in position 20 to 23 is any or no amino acid
  Variant (25)..(25): Xaa in position 25 is any amino acid
  Variant (27)..(27): Xaa in position 27 is any amino acid
  Variant (30)..(30): Xaa in position 30 is any amino acid
  Variant (34)..(34): Xaa in position 34 is any amino acid
  Variant (36)..(36): Xaa in position 36 is any amino acid
  Variant (38)..(42): Xaa in position 38 to 42 is any amino acid
  Variant (43)..(44): Xaa in position 43 to 44 is any or no amino acid
  Variant (46)..(58): Xaa in position 46 to 58 is any amino acid
  Variant (59)..(84): Xaa in position 59 to 84 is any or no amino acid
  Variant (87)..(87): Xaa in position 87 is any amino acid
  Variant (89)..(89): Xaa in position 89 is any amino acid
  Variant (91)..(93): Xaa in position 91 to 93 is any amino acid
  Variant (95)..(97): Xaa in position 95 to 97 is any amino acid
  Variant (98)..(99): Xaa in position 98 to 99 is any or no amino acid
  Variant (101)..(106): Xaa in position 101 to 106 is any amino acid
  Variant (107)..(107): Xaa in position 107 is any or no amino acid
  Variant (109)..(112): Xaa in position 109 to 112 is any amino acid
  Variant (114)..(116): Xaa in position 114 to 116 is any amino acid
  Variant (117)..(118): Xaa in position 117 to 118 is any or no amino acid
  Variant (121)..(123): Xaa in position 121 to 123 is any amino acid
  Variant (125)..(129): Xaa in position 125 to 129 is any amino acid
  Variant (131)..(135): Xaa in position 131 to 135 is any amino acid
  Variant (136)..(136): Xaa in position 136 is any or no amino acid
  Variant (138)..(141): Xaa in position 138 to 141 is any amino acid
  Variant (143)..(143): Xaa in position 143 is any amino acid
  Variant (145)..(150): Xaa in position 145 to 150 is any amino acid
  Variant (152)..(152): Xaa in position 152 is any amino acid
  Variant (154)..(155): Xaa in position 154 to 155 is any amino acid
  Variant (156)..(161): Xaa in position 156 to 161 is any or no amino acid
  Variant (164)..(168): Xaa in position 164 to 168 is any amino acid
  Variant (169)..(169): Xaa in position 169 is any or no amino acid
  Variant (172)..(174): Xaa in position 172 to 174 is any amino acid
  Variant (176)..(178): Xaa in position 176 to 178 is any amino acid
  Variant (180)..(180): Xaa in position 180 is any amino acid
  Variant (181)..(183): Xaa in position 181 to 183 is any or no amino acid
  Variant (185)..(186): Xaa in position 185 to 186 is any amino acid
  Variant (189)..(190): Xaa in position 189 to 190 is any amino acid
  Variant (191)..(197): Xaa in position 191 to 197 is any or no amino acid
  Variant (199)..(200): Xaa in position 199 to 200 is any amino acid
  Variant (201)..(201): Xaa in position 201 is any or no amino acid
  Variant (203)..(206): Xaa in position 203 to 206 is any amino acid
  Variant (208)..(210): Xaa in position 208 to 210 is any amino acid
  Variant (212)..(220): Xaa in position 212 to 220 is any amino acid
  Variant (223)..(224): Xaa in position 223 to 224 is any amino acid
  Variant (226)..(229): Xaa in position 226 to 229 is any amino acid
  Variant (230)..(234): Xaa in position 230 to 234 is any or no amino acid
  Variant (236)..(259): Xaa in position 236 to 259 is any amino acid
  Variant (260)..(260): Xaa in position 260 is any or no amino acid
  Variant (262)..(266): Xaa in position 262 to 266 is any amino acid
  Variant (267)..(271): Xaa in position 267 to 271 is any or no amino acid
  Variant (273)..(274): Xaa in position 273 to 274 is any amino acid
  Variant (276)..(276): Xaa in position 276 is any amino acid
  Variant (277)..(279): Xaa in position 277 to 279 is any or no amino acid
  Variant (281)..(312): Xaa in position 281 to 312 is any amino acid
  Variant (313)..(317): Xaa in position 313 to 317 is any or no amino acid
  Variant (319)..(319): Xaa in position 319 is any amino acid
  Variant (321)..(326): Xaa in position 321 to 326 is any amino acid
  Variant (328)..(333): Xaa in position 328 to 333 is any amino acid
  Variant (334)..(334): Xaa in position 334 is any or no amino acid
  Variant (336)..(359): Xaa in position 336 to 359 is any amino acid
  Variant (360)..(361): Xaa in position 360 to 361 is any or no amino acid
  Variant (363)..(380): Xaa in position 363 to 380 is any amino acid
  Variant (381)..(381): Xaa in position 381 is any or no amino acid
  Variant (383)..(396): Xaa in position 383 to 396 is any amino acid
  Variant (397)..(410): Xaa in position 397 to 410 is any or no amino acid
  Variant (412)..(423): Xaa in position 412 to 423 is any amino acid
  Variant (424)..(430): Xaa in position 424 to 430 is any or no amino acid
  Variant (432)..(432): Xaa in position 432 is any amino acid
LXXXXVXDLXXXXXXXGPXXXXXLXDXGAXVIKXEXPXXXXXXXRXXXXXXXXXXXXXXXXXXXXXXXXXXXXXXXXXXXXXXXNRXKXSXXXDXXXXXGXXXXXXXLXXXXDXXXXXENXXXGXXXXXGXXXXXXLXXXXPXLXXXXXXGXGXXXXXXXXGPXXXXXXYDXXXQXXXGXXXXMXXTGXXXXXXXXXPXXXGXXXXDXXXGXXXXXXXXXALXXRXXXXXXXXXGXXXXXXXXXXXXXXXXXXXXXXXXXGXXXXXXXXXXGXXHXXXXPXXXXXXXXXXXXXXXXXXXXXXXXXXXXXXXXXXXXXDXRXXXXXXRXXXXXXXLXXXXXXXXXXXXXXXXXXXXXXXXXXPXXXXXXXXXXXXXXXXXXXRXXXXXXXXXXXXXXXXXXXXXXXXXXXXPXXXXXXXXXXXXXXXXXXXPXLG

SEQ ID NO: 6948 - protein, 16 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Ile or Val
  Variant (5)..(9): Xaa in position 5 to 9 is any amino acid
  Variant (11)..(11): Xaa in position 11 is any amino acid
  Variant (13)..(14): Xaa in position 13 to 14 is any amino acid
PXXXXXXXXGXGXXGP

SEQ ID NO: 6949 - DNA, 2871 bp, Escherichia coli
  CDS (1)..(2871): transl_table=11
atgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaataatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgacctagaagtcattggtaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatctactataccccgggtggtcagagcgcaccggaaccgtcaccgcttgaccgccgtatgttcggcaagaaaatgcgtcacgtcggcgatcgtgttgctgcggtcgtcgcagaaagtgaagaaattgcgctcgaagcactgaagctcatcgacgttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgccagtattcatggtcatattggcgatatggacaaaggctttgccgatgccgatgtgatcattgagcgaacctataactcaacgcaagcgcagcagtgcccgactgaaacacatatctgctttactcgtatggacggcgatcgtctggttatccacgcctccacccaggtaccatggcacttacgccgccaggtcgcgcgcctcgtgggcatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgtgcactggaagagatcctgcgtcagggtcgcgagatgatccaatggtcgtcaccgaaaccgcaaaatggtgactggcacatcggtcgcggcgtcgccattatcatgcagaaatcgggtatcccggatatcgatcaggctaactgcatgatcaaactggaatcggacggcacctttatcgttcattctggcggtgcggatattggtactggtctggatactgtagtgacgaaactggcagcagaagtgctgcactgcccaccgcaggacgtgcatgttatctccggtgataccgatcatgcgttgtttgataaaggcgcatatgcctcgtccggtacttgcttctcgggtaacgcggcgcgtttggcagcggaaaatctacgggagaaaattctgttccacggcgcgcaaatgttgggtgagccagtggcagatgttcaactggcaacgccgggcgtcgtgcgcggcaagaaaggcgaagttagtttcggggatattgcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccgttcggggcgaaatcgatctcggaaatcggtgtaaatggcgcagctccggcgattgctaccgcaattcacgatgcatgcggcatctggttacgcgaatggcatttcacaccggagaaaatactcactgcgctggaaaaaatataa

SEQ ID NO: 6950 - protein, 956 aa, Escherichia coli
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIAAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEEIALEALKLIDVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVGMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRVHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEPVADVQLATPGVVRGKKGEVSFGDIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACGIWLREWHFTPEKILTALEKI

SEQ ID NO: 6951 - DNA, 4086 bp, Arabidopsis thaliana
  CDS (1)..(4086)
atgggttcactgaaaaaggacggcgagatcggagatgagtttacggaggcgttactgtacgttaacggcgttcgtagagtcttgcctgatggattggctcatatgacacttctcgaatatctcagagatttaggattgaccggtacaaagctgggatgcggcgaaggtggttgtggggcttgcacggtgatggtgtctagttatgacaggaagtcaaagacctctgtgcattatgctgtcaacgcttgcctagcacctctctattctgtagaagggatgcatgtaatatccattgagggacttgggcatcgcaaacttggcttgcaccctgtccaggagtctttggcatcttcccatggttcccaatgtgggttttgtactcccgggtttatcatgtccatgtattcgttgttgaggtcaagtaaaaactcaccttctgaggaggagattgaagaatgtcttgcaggaaatctatgtcgttgtactggttatcgacccattgttgatgcgtttcgggtttttgcaaaatctgatgatgctctctactgtggtgtatcttcacttagccttcaagatggttctactatttgcccatctactggcaaaccttgctcttgtggatcaaaaacaacaaatgaagttgccagttgtaatgaagatagatttcagtcaatctcttatagtgatatagatggagctaagtatacagataaggagcttattttcccccctgaacttttgctgaggaagttaactcccttaaagttaaggggaaatggggggattacctggtatagacccgtatgtcttcagaacttgcttgagctcaaagcaaattatcctgatgcaaaactactggtaggtaatacagaggtgggaatcgaaatgagattgaagaggttacagtatcaggtgctgatctctgttgctcaagtcccagaactcaacgcattgaatgtcaatgacaatgggatagaggttggttcagctttgagactttctgaactcctgaggttattcaggaagatagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataaccaactgcaatggagatgttaggtctatacctgcaaaagatttcttcctcggttatcgtaaagtggatatggggagcaacgagatcttgttgtcggtattccttccatggacaagacccttagagtatgtgaaagaatttaagcaggcccatcgcagggatgatgatatagctattgtcaatggtggaatgcgtgtgtttcttgaagacaagggtcaacaattgttcgtttctgatgcatccattgcttatggaggtgtggctcctctttctttgtgtgcgagaaagactgaagagtttctaattggaaagaattggaataaagatcttctgcaggatgcgcttaaggtcatacagagcgatgtcgtgattaaggaagatgctcctgggggaatggtggagtttcggaaatctctaaccctaagcttcttctttaaatttttcttatgggtttctcataatgtcaataatgcaaattctgcgatagagaccttcccaccctcccatatgtcagctgtgcaacctgttcctcggttatctagaattggaaaacaagactatgagacagtaaagcagggaacatctgttggctcgtcggaggtgcatctttcagcgagaatgcaggtcacaggggaagcggaatatactgatgatactccagtacctcctaataccttacatgctgcctttgtgctaagcaaagtgccacatgcccgcatcctttcaatcgatgattcggcagccaaatcttcatctggttttgttggtctgtttcttgccaaagatattcctggggataatatgattggaccaattgttcccgacgaagaattatttgctacagatgtggtcacgtgtgtgggacaagtcattggtgtggtcgtcgcggatacacatgaaaatgcaaaaactgcagcaggaaaagttgacgttaggtatgaggaactaccagcaatattatcaatcaaggaggctattaatgctaaaagtttccatccgaacacagagaaaaggctaagaaaaggggatgtcgagctgtgttttcaatctggtcagtgtgacagggtaatagagggagaggttcaaatgggtggtcaggaacacttctacttggagcctaatggtagtttggtttggacagtagatgggggcagcgaagttcatatgatttcatccacacaggctcctcaaaagcaccagaaatatgtgtcgcatgttcttggtcttccgatgtctaaagtggtatgcaaaaccaaacgaattggtggtggctttggtggtaaagaaacaagatcagctttcattgctgcggcagcttctgttccttcctacctattgaatcgacctgtgaaactcatactggaccgagatgtggacatgatgataactggtcatcgtcatagttttcttggaaagtacaaggttggatttacgaacgaaggaaaaatattggcgttggaccttgaaatttacaacaatggtggcaactctttggatctctccctttctgttcttgaacgtgccatgtttcactcggataacgtttatgagatcccgcatgtaaggattgttgggaatgtttgctttactaattttcctagcaacactgctttccgagggtttggaggcccccaaggtatgcttataactgaaaactggattcaaagaatcgcagctgagcttaataaaagccctgaagaaatcaaagagatgaactttcaagtggaaggatcagtcacccattactgtcagactcttcagcactgcacattgcatcagctctggaaagagctgaaagtatcgtgcaacttcttaaaggcccgcagagaagctgacgaatttaatagtcataatcggtggaaaaagcgtggtgtagctatggttcccacaaaatttggcatatcatttaccacaaagttcatgaatcaggccggagctcttgttcatgtttacactgacgggactgttttagtgactcatggtggtgtggagatgggtcaaggattgcatacaaaggtcgctcaagttgctgcatccgcctttaacattccacttagctcagttttcgtgtcagagacaagcactgacaaggttcctaatgcgtcaccaactgctgcttctgcgagctctgatatgtatggtgctgcagttttagacgcttgtgagcagattatagcaagaatggaacctgttgcatctaagcacaatttcaacacatttactgagctagtaagtgcctgctactttcaacggatagacctatcagctcatggttttcacatagttcctgatcttgggtttgactggatatctggaaaagggaacgcctttagatattacacatatggagctgcctttgcggaagttgagatagatacattgactggtgatttccacacaagagcagctgatataatgttggacctcggatattctcttaacccagccattgatgttggacaaatagaaggagcgtttgtacaaggactgggttgggtagctttagaagaactcaaatggggagatgcagctcataaatggattaaaccaggaagtttactcacttgcggacccggaaactacaaaataccttccatcaacgacatgccgttcaacctcaatgtttcgcttctcaaggggaatccgaatacaaaggcaatacattcatctaaagcagtgggtgagccaccattctttcttgcatcatcggttttctttgcgataaaggaagctattaaagcggctagaaccgaggtgggtctcacagactggttccctctagagagtccagccactccagagcgtatcaggatggcttgtttcgacgaattttcagctccttttgtaaattcagatttctaccctaatcttagtgtttga

SEQ ID NO: 6952 - protein, 1361 aa, Arabidopsis thaliana
MGSLKKDGEIGDEFTEALLYVNGVRRVLPDGLAHMTLLEYLRDLGLTGTKLGCGEGGCGACTVMVSSYDRKSKTSVHYAVNACLAPLYSVEGMHVISIEGLGHRKLGLHPVQESLASSHGSQCGFCTPGFIMSMYSLLRSSKNSPSEEEIEECLAGNLCRCTGYRPIVDAFRVFAKSDDALYCGVSSLSLQDGSTICPSTGKPCSCGSKTTNEVASCNEDRFQSISYSDIDGAKYTDKELIFPPELLLRKLTPLKLRGNGGITWYRPVCLQNLLELKANYPDAKLLVGNTEVGIEMRLKRLQYQVLISVAQVPELNALNVNDNGIEVGSALRLSELLRLFRKIVKERPAHETSACKAFIEQLKWFAGTQIRNVACIGGNICTASPISDLNPLWMASRAEFRITNCNGDVRSIPAKDFFLGYRKVDMGSNEILLSVFLPWTRPLEYVKEFKQAHRRDDDIAIVNGGMRVFLEDKGQQLFVSDASIAYGGVAPLSLCARKTEEFLIGKNWNKDLLQDALKVIQSDVVIKEDAPGGMVEFRKSLTLSFFFKFFLWVSHNVNNANSAIETFPPSHMSAVQPVPRLSRIGKQDYETVKQGTSVGSSEVHLSARMQVTGEAEYTDDTPVPPNTLHAAFVLSKVPHARILSIDDSAAKSSSGFVGLFLAKDIPGDNMIGPIVPDEELFATDVVTCVGQVIGVVVADTHENAKTAAGKVDVRYEELPAILSIKEAINAKSFHPNTEKRLRKGDVELCFQSGQCDRVIEGEVQMGGQEHFYLEPNGSLVWTVDGGSEVHMISSTQAPQKHQKYVSHVLGLPMSKVVCKTKRIGGGFGGKETRSAFIAAAASVPSYLLNRPVKLILDRDVDMMITGHRHSFLGKYKVGFTNEGKILALDLEIYNNGGNSLDLSLSVLERAMFHSDNVYEIPHVRIVGNVCFTNFPSNTAFRGFGGPQGMLITENWIQRIAAELNKSPEEIKEMNFQVEGSVTHYCQTLQHCTLHQLWKELKVSCNFLKARREADEFNSHNRWKKRGVAMVPTKFGISFTTKFMNQAGALVHVYTDGTVLVTHGGVEMGQGLHTKVAQVAASAFNIPLSSVFVSETSTDKVPNASPTAASASSDMYGAAVLDACEQIIARMEPVASKHNFNTFTELVSACYFQRIDLSAHGFHIVPDLGFDWISGKGNAFRYYTYGAAFAEVEIDTLTGDFHTRAADIMLDLGYSLNPAIDVGQIEGAFVQGLGWVALEELKWGDAAHKWIKPGSLLTCGPGNYKIPSINDMPFNLNVSLLKGNPNTKAIHSSKAVGEPPFFLASSVFFAIKEAIKAARTEVGLTDWFPLESPATPERIRMACFDEFSAPFVNSDFYPNLSV

SEQ ID NO: 6953 - DNA, 4062 bp, Arabidopsis thaliana
  CDS (1)..(4062)
atggagcagaacgagttcatggaggcaataatgtacgttaatggtgttcgtagagttttgcctgatggattagctcacatgacgcttctcgaatatctcagagatttaggattgaccgggacaaagctcggatgcggcgaaggtggttgtgggtcttgcaccgtgatggtgtctagttatgaccgagagtcaaagacatgtgtgcattatgctgtcaacgcttgcctagcacctctctactctgtagaagggatgcatgtaatatccattgaaggagttggtcatcggaaacttggcttgcaccctcttcaggagtcattggcatcttcgcatggttctcaatgtgggttttgtactcccggttttgtcatgtcgatgtatgccttgttgaggtcaagtaaaaactcaccttctgaggaggagattgaagaatgccttgcaggaaatttgtgtcgttgtactggttatagacccatcattgatgcgtttcgggtttttgcaaaatctgatgatgctctatacagtggtttatcttcacttagccttcaggacggttcaaatatttgtccatctactggcaaaccttgttcttgtggatcaaaaacaacaagtgaagcagctacttgtaatgaagatagatttcagtcaatctcttatagtgatatagatggagctaagtatacagataaggagcttatttttccccctgaacttctgctgaggaagttagctcccttaaagttagggggaaatgaggggattacctggtatagacccgtaagtcttcagaacttgcttgaactcaaagcaaattttcctgatgcaaaactactggttggtaacacggaggtgggaatcgaaatgagactaaagaggttacagtatccggtgctaatctctgctgctcaagtcccagaactcaacgcattgaatgtcaatgacaatgggatagaggttggttcagctttgagactttctgaactcctgaggttattcaggaaggtagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataatcaactgcaatggagatgttagatctatacctgcaaaagatttcttccttggctatcgtaaagtggatatgggaagcaacgagatcttgttgtcggtattccttccatggacaaggcctttagagtatgtgaaagaatttaagcaggcccatcgcagggatgatgatatagctattgtcaatggtggaatgcgtgtgtttcttgaagagaaagggcaacaattgtttgtttctgatgcatctattgtttatggtggtgtggctcctctttcgttgcgtgcaagaaacactgaggaacttctaattggtaagaattggaataaatgtcttctgcaagacgcacttaaggtcatacagagtgatgtcttgattaaggaaggtgctcctgggggaatggtggagtttcgcaaatctctaaccctaagcttcttctttaaatttttcttatgggttactcatcatgtaaataatgtaaatcccactatagagacctttccaccctcgcatatgtcagctgtgcaacttgttcctcggttctctagaattggaaaacaagactatgagacagtaaaacagggtacatctgttggcttgccagaggtccatctttcggcaagaatgcaggtcacaggggaagcagaatatactgatgataccccattgccgccttgtaccttgcatgctgctttagtgctaagtaaagttccacatgcccgcatcctttcagttgatgattcggcagccaaatcttcatctggttttgttggtctgtttcttgccaaagatgttcccgggaataatatgattggaccaattgttgccgacgaagaattatttgctacagacgtggtcacgtgtgtgggacaagtcattggtgtgcttgtcgcggatacacatgaaaatgcaaaaactgcagcaagaaaagttgacgttaggtatcaggaactgccagcaatattatcaatcaaggaggcgattaatgctaaaagtttccatccgaacacagagagaaggcttagaaaaggggatgtcgagctgtgctttcaatctggtcagtgtgacagaataatagagggagaggttcaaatgggtggtcaggaacacttttacttggagcctaatggtagtttggtttggactatagatggaggcaacgaagttcatatgatttcatccacacaagctcctcaacagcaccagaaatatgtgtctcatgttcttggtcttccaatgtctaaagtggtatgcaaaaccaaacgacttggtggtggctttggtggtaaggaaacaagatcagctttcattgctgcagcagcttctgttccttcctacctattgaatcgacccgtgaaactcatactggacagagatgtggacatgatgattactggtcatcgccatagtttcgttggaaagtacaaggttggatttacgaacgaagggaaaatattggcgttggaccttgaaatctacaacaatggtggaaactctatggatctctctctttctaatcttgaacgtgccatgtttcactcggataacgtttatgagatcccacatgtgaggatcgttgggaacgtttgctttactaattttcccagcaacaccgctttccgagggtttggagggccccaaggtatgcttataactgaaaattggattcagagaattgcagctgagctggataaaatccctgaagaaatcaaagagatgaactttcaagtggaaggatcgatcacacattactttcagtcacttcagcactgcacattgcaccaactctggaaagaactgaaagtatccagcaacttcctaaagactcgtagagaagcggacgagtttaatagtcataatcggtggaaaaagcgtggtgtagctatggttcccacaaaatttggcatatcctttaccacaaagttcatgaatcaggccggtgctcttgttcacgtttacaccgatgggactgttttggtgacacatggaggtgttgagatgggccaagggttgcatacaaaggttgctcaagttgctgcaacggcctttaacattctccttagttcggtttttgtgtcagaaacaagcaccgacaaggttcctaatgcgtcacctactgctgcttctgcgagttctgatatgtatggtgctgcagttttagacgcttgtgagcagattatagcaagaatggagcctgttgcatctaaacacaatttcaacacattctctgagctagcaagtgcctgctactttcaacgtatagacctatcagctcacggttttcacattgttccagaacttgaatttgattgggtatctggaaaagggaacgcatatagatattacacatatggagctgcctttgctgaagttgagatagatacattgactggtgattttcacacaagaaaagcagacataatgttggatctcggatattctcttaacccaaccattgatattggacaaatagaaggagcgtttgtacaaggactaggttgggtagctctagaagaactcaagtggggagatgcagctcataaatggattaaaccaggaagtttactcacttgcggacccggaagctacaaaataccttccatcaacgacatgccgttccaactgaatgtttctcttctcaagggtaatccaaatgcaaaggcaatacattcatctaaagcagtgggtgagccaccgttctttcttgcagcatcagccttctttgcaataaaggaagcaatcaaagcggctagaagcgaggtaggtctcaccaactggttccctctggagactccagccactccagagcgtatcaggatggcttgtttcgacgagttttcagctccttttgcaaattcagatttctgcccaaagcttagtgtttga

SEQ ID NO: 6954 - protein, 1353 aa, Arabidopsis thaliana
MEQNEFMEAIMYVNGVRRVLPDGLAHMTLLEYLRDLGLTGTKLGCGEGGCGSCTVMVSSYDRESKTCVHYAVNACLAPLYSVEGMHVISIEGVGHRKLGLHPLQESLASSHGSQCGFCTPGFVMSMYALLRSSKNSPSEEEIEECLAGNLCRCTGYRPIIDAFRVFAKSDDALYSGLSSLSLQDGSNICPSTGKPCSCGSKTTSEAATCNEDRFQSISYSDIDGAKYTDKELIFPPELLLRKLAPLKLGGNEGITWYRPVSLQNLLELKANFPDAKLLVGNTEVGIEMRLKRLQYPVLISAAQVPELNALNVNDNGIEVGSALRLSELLRLFRKVVKERPAHETSACKAFIEQLKWFAGTQIRNVACIGGNICTASPISDLNPLWMASRAEFRIINCNGDVRSIPAKDFFLGYRKVDMGSNEILLSVFLPWTRPLEYVKEFKQAHRRDDDIAIVNGGMRVFLEEKGQQLFVSDASIVYGGVAPLSLRARNTEELLIGKNWNKCLLQDALKVIQSDVLIKEGAPGGMVEFRKSLTLSFFFKFFLWVTHHVNNVNPTIETFPPSHMSAVQLVPRFSRIGKQDYETVKQGTSVGLPEVHLSARMQVTGEAEYTDDTPLPPCTLHAALVLSKVPHARILSVDDSAAKSSSGFVGLFLAKDVPGNNMIGPIVADEELFATDVVTCVGQVIGVLVADTHENAKTAARKVDVRYQELPAILSIKEAINAKSFHPNTERRLRKGDVELCFQSGQCDRIIEGEVQMGGQEHFYLEPNGSLVWTIDGGNEVHMISSTQAPQQHQKYVSHVLGLPMSKVVCKTKRLGGGFGGKETRSAFIAAAASVPSYLLNRPVKLILDRDVDMMITGHRHSFVGKYKVGFTNEGKILALDLEIYNNGGNSMDLSLSNLERAMFHSDNVYEIPHVRIVGNVCFTNFPSNTAFRGFGGPQGMLITENWIQRIAAELDKIPEEIKEMNFQVEGSITHYFQSLQHCTLHQLWKELKVSSNFLKTRREADEFNSHNRWKKRGVAMVPTKFGISFTTKFMNQAGALVHVYTDGTVLVTHGGVEMGQGLHTKVAQVAATAFNILLSSVFVSETSTDKVPNASPTAASASSDMYGAAVLDACEQIIARMEPVASKHNFNTFSELASACYFQRIDLSAHGFHIVPELEFDWVSGKGNAYRYYTYGAAFAEVEIDTLTGDFHTRKADIMLDLGYSLNPTIDIGQIEGAFVQGLGWVALEELKWGDAAHKWIKPGSLLTCGPGSYKIPSINDMPFQLNVSLLKGNPNAKAIHSSKAVGEPPFFLAASAFFAIKEAIKAARSEVGLTNWFPLETPATPERIRMACFDEFSAPFANSDFCPKLSV

SEQ ID NO: 6955 - DNA, 2724 bp, Bradyrhizobium japonicum USDA 110
  CDS (1)..(2724): transl_table=11
atgagcttcgagatcaacggcaagacgtttccgcaggagccgcgtgccggccagtgcctccgcacgttcctgcgcgagctcggtcatttcggcgtcaagaagggctgcgatgccggcgattgcggcgcctgcaccgtgctgctcgacggcgagccggtgcacagctgcctgatcccggcgttccgcgccgaggggcgcactgtgaccacgatcgagggcctcggcggcgagctcggcgcgcatccgatgcagcaggccttcctcgatgcgcagggctttcaatgcggcttctgcaccgccggcatgatcctgacctgcgcctcgctgaaccaggcgcagcgcaccgatctcggcgccgcgctgaaaggcaatatctgccgctgcaccggctatcgcgcgatcgaggacgcgctgctcggcaagatcaacgtcgaggagagcgtcgaggccggcgccgccttcggccgcagccttccggcgccagcaggtcccgatgtcgtgcgcggcaaggcacgctacacgttcgacacgcagattgacggcctgctgaacatcaagctgctgcgctcgcctcacgcgcacgccagaatcaccgcgatcgacaagtctgcggcgctcagcgttcccggcgtgcatgcggtgctgacgcatgaggacgcgccatcggtgctgatctcgaccgcgcggcacgagaaggactggatggaccccgaggacacccgcatcctcgacgacgtcgtgcgcttcatcggccagaaggtcgcggcggtcgtcgccgaaagcgaaggcgccgccgaggaagcctgccggaggctcaaggtcacttacgaggtcctgcctgcgctgatcgatccagagcaggcgatggcgcccggcgcgcccatcattcatcccgaccgcaccaccgagaaccgcgtcgccgacgccaggcgcaaccttgcggctgagacccatggcgagttcggcgatgtcgcagcagcactcgccacatccgccgtcacctacgaagccaccttccacagccatcgcgtgcagcacgccgcgctggagacccatggcggcctcgcctggctcgacgcctccggtgtgcttaacgtccgcacctcgacgcaggtgccgttcctgacccggcgcgcgctgtcggacatcttccagctgcccatggacaaggtccgcgtgttctgcgagcgcgtcggcggcggctttggcggcaagcaggagatgttcgtcgaggatatccttgcgctcgccgcgctgaagaccggacgccccgtgaagctggagctcacccgcgaggagcagttcatcgcgacgtcgacgcggcatccgatgcgggtccacatcaaggccggtgccgatgccgacggcaagctcaccgcactccagctcgacgtgctctccaacaccggcgcctacggcaatcacgccggcccggtgatgttccactcgctgtccgagtccatcgccgtctacaattgtccgaacaagcgggtcgacggctacgccgtctacaccaacacggtgccatcgggtgcgtttcgcggctatggcctgccgcagacgctgatcgcgatcgaggccgcaatcgacgagctggccgggcagctcggcatcagcccctacgacatgcgccggcgcaacatcgtcaagccaggcgaccccatgctgtcgccgccgccatccgaatttcacgacgtgctctatggctcctacgggctcgaccagtgcctcgatctcgtcgagcgcgcgatgcaggcggatggcccgcggccggagctgtcgccggaatggctgatcggcgatggcatcgcgctgaccatgatcgacaccgtgccgcccgccggccacatcgcggacgccatgatcgcgctcaacgacgacggcggcttcgatctcaccgtcggcaccgccgagttcggcaacggcaccagcacggtccaccgccagatcgcggcgacgacgctggcgaccaccgtcgacaggattcgcctgcgccagtccgacaccgcccatggcggccacgacaccggcgcctatggcagcgcgggcaccttcgtcgccggcaaggcgacgcatgcagccgccatgcagcttgccacggacttgagggcggccgcggccggcgcctggctttgcgatgtcggaagctgcgcgctcgaggacgagttcgtcgtgagcggcgtcaggcgcatgtcctttgtggagcttgcgaagcttgcgcgcgaacgcggccagccgctcgcagcacaaggcaattccggcggcacgccgcgctcggtcggcttcaacgtgcagggctttcgcgtggcggtgaacaagggcaccggcgagctcaagattctcagaagcgtgcaggccgccgacgccggcgtcgtcgccaatcccatgcagtgccgcggccaggtcgagggcggcgtcgcgcaggcgcttggtgctgcgctctacgaggagatggtgatcgacgcggacggccgcgtcaccaacgccaagttccgcgactaccacctgccctccttcgcggacgtgccgcgcaccgaagtcttcttcgccgagacctccgacaccatcggccccttgggcgcgaagtcgatgagcgagagtccgtacaatccggtcgccgcggcgctcggcaacgcgattgcagacgccaccggcatccgcttcacggcgccgccgttcaagccggaccggctgtttccggcgctgcacgataaatttggttag

SEQ ID NO: 6956 - protein, 907 aa, Bradyrhizobium japonicum USDA 110
MSFEINGKTFPQEPRAGQCLRTFLRELGHFGVKKGCDAGDCGACTVLLDGEPVHSCLIPAFRAEGRTVTTIEGLGGELGAHPMQQAFLDAQGFQCGFCTAGMILTCASLNQAQRTDLGAALKGNICRCTGYRAIEDALLGKINVEESVEAGAAFGRSLPAPAGPDVVRGKARYTFDTQIDGLLNIKLLRSPHAHARITAIDKSAALSVPGVHAVLTHEDAPSVLISTARHEKDWMDPEDTRILDDVVRFIGQKVAAVVAESEGAAEEACRRLKVTYEVLPALIDPEQAMAPGAPIIHPDRTTENRVADARRNLAAETHGEFGDVAAALATSAVTYEATFHSHRVQHAALETHGGLAWLDASGVLNVRTSTQVPFLTRRALSDIFQLPMDKVRVFCERVGGGFGGKQEMFVEDILALAALKTGRPVKLELTREEQFIATSTRHPMRVHIKAGADADGKLTALQLDVLSNTGAYGNHAGPVMFHSLSESIAVYNCPNKRVDGYAVYTNTVPSGAFRGYGLPQTLIAIEAAIDELAGQLGISPYDMRRRNIVKPGDPMLSPPPSEFHDVLYGSYGLDQCLDLVERAMQADGPRPELSPEWLIGDGIALTMIDTVPPAGHIADAMIALNDDGGFDLTVGTAEFGNGTSTVHRQIAATTLATTVDRIRLRQSDTAHGGHDTGAYGSAGTFVAGKATHAAAMQLATDLRAAAAGAWLCDVGSCALEDEFVVSGVRRMSFVELAKLARERGQPLAAQGNSGGTPRSVGFNVQGFRVAVNKGTGELKILRSVQAADAGVVANPMQCRGQVEGGVAQALGAALYEEMVIDADGRVTNAKFRDYHLPSFADVPRTEVFFAETSDTIGPLGAKSMSESPYNPVAAALGNAIADATGIRFTAPPFKPDRLFPALHDKFG

SEQ ID NO: 6957 - DNA, 4071 bp, Apis mellifera
  CDS (1)..(4071)
atggtccatgatgatggaattattaatcaatctaaacctgtcatgctgaacaatgaagagaaacttgacagaatatcacatactttagtattttatgttaatggcaaggaggtgattgataataacgttaatccagaatggactttattatggtatttaagaaataagttacgtttaactggtacaaaattaggctgtgcagaaggtggttgtggagcatgcactgtaatgatatcaaaattggatcgtacaacaggaattattacacatctagcagtgaatgcatgtttaacattgatttgtgccatgcatggtttagcagtaactaccattgaaggtattggaagtgtaaaaacgacactgcatccagtccaagaacggatagcaaaagcgcatggatcacaatgtggtttttgcacaccaggaattatcatgtctatgtatgctttgctacgtactattcctaaaccaagtatgaaagatcttgaaatagcttttcaaggaaatttatgcaggtgtactggataccgtccaatcatagaagcttataaaacttttacagaagaatgggaaattatgcaattaatatcaaaagataaagaaaaatctttaacaaatggagaatgttctatgggagaaaattgttgtaaaaaaataccaatagtagaacccacagaagtttttgattcaaaagaattttgttcatatgatccttctcaggaaataatatttcctcctaaattacatatttcttcatatttagatgaagagtacttaataataaaaggaaaaaatgttacttggtatagaccaaaaacacttactgaattattatatctaaaaaatcaatatccgaatgcaaaaattgttgtaggaaatacagagataggggttgaagttaaatttaagtatttatcttatccagttcttatacagcctactttaatcaaagaaatgcatactatcgaagaatattcaaaagtactgaatataggtgctagtgttacacttgttgaaatggaaaaatccttaaaaaatcaaattgctataaaacctgaataccaaacgagaatttttaatgaaatagttaatatgctttattactttgctggaaaacaaatcagaaatgtggctgctgttggtggaaatataatgacgggaagtcctatatcagatctgaatccaatttttatggcagctggagtgaagttaaatgtttcaagcttgaaaaatggaaatagacttattccaatggatcatactttttttaagggttatcggcaaaatgttatttcatcagaagaaattttactttcgatacaaataccattttctgaaaaaaatcaatattttattgcttttaaacaagcaagaagacgagacgatgatattgctattgttaatatggcattaaatgtatttttcgagccagaaagtaacatcgttaataaagcatatttagcttttggtggtatggctccaacgacggttttagcaagaaaaacttgtaacattatgattggaaggaaatgggataaagatcttttagaaactatttatgattcattattgaatgaattacctttatcagataatgtaccgggtggaatggtcaaatatcgtaggtcgttgactttaagtttattcttcaaaggatttttgcatatagctaaaaaatttcaaatatttttgccaaaagaagttgaaagtgcaacagaaggattccataccaaaaaattaaaaagttcacaatattatcaagtggttcaaaaagatcaggaagcaaatgatttagttggaagatcaattgttcatgctagtgcatataaacaagcaactggagaagcaatatattgtgatgatatgcccaaatttgtcgacgaactatatttagctgtagttttatctaccagagctcatgcaaagattttgaaaattgatgcaactaaagcattgtcaatggaaggtgtaattgttttttatagtgcaaaggatatacctgagaaacagcgatggtttggtcctatatttaaagacgaagaaatttttgtatcagaaaaggtgacaagtcatggtcaagtaattggagcaattgtagctattaatcaaaccattgcacagaaggcagctagaatggttgaaattgaatacgaaaatttagaaccaataattatttctatagaggatgctattaaacatcgttcttttttcaaccaaacgccaaaacatataaataatggagacatagaaaaggcttttattgaatcacaacatattcttaaaggagaagttcgaacaggagcacaagagcatttttatcttgaaacaaatgcaactttggcaattccaaaagaagaagatgaattagaaatattttgttcaacacaacatcctacagaacttcagaaatttatttcacatcttttaaatatccatgctaataaaattgtggttagaacaaaaagattaggtggtggttttggagggaaagaatctcgttcagcagtacttgctttaccagttgtttttgctgcttataaattaagaaaaccagtacgttgtatgcttgatagagatgaagatattataatgtctggagcaagacatccatttttgttaaaatataaagttggatttgataattctggtttaatcaaaggagcacaagtttatatctataataatgcgggttattcttatgatttatctcctgcagttttagaacgagctatgttccattttgaaaattcttataaaataccagtgtctgatgtatatggttttatatgtaaaactaatataccgtcaagtacggcatttcgtggttttggaggtccacaaggaatgtttttagctgaaacaatgataaggcatattgcagaatatttaaatagagatcctgttgagattgcagaattgaatttatataaagaagaagatacaactcattataatcagaaactctttaattgtacaatacaacgttgctggaaagagtgtattttatcttcaaattataatgaacgtcttttacaagttcaaaaatataacagagaaaatagatacaagaaaaaaggattggcaatagttccaacgaaattcggtatttctttttctatagcctttctaaatcaagcaggggcacttgtacatgtctatacagatggttctgtattaattagtcacggtggtgttgaaatgggacaaggtttacatacaaaaatgatacaagtagcaagtagatcattaaaaataaaacctgataaaatacacataacggaaacagctactgataaagtaccaaatacatctgcaacagcagctagtgcttcttcagatttaaatggtatggccatcatgaatgcttgtaataaaattatggagcgcctaaaaccagtgatagataaaaatcctaatggtacatgggaagaatgggtgacaacagcttatttggaaagaattagcctttctgctgctggtttttacaaaactcccgacatacaatattcatttgaaactaatacaggaaatgtatttaattattttacgtatggtgttgcatgttcagaagtagaaatcgattgtttgactggagatcatcaagtattacaaactgatattgtaatggatttaggtgaaagtctaaatcctgcgattgatattggacaaattgaaggagcttttatgcaaggatatggtttattcacattggaagaaatgatatatttaagaaatggagctattgcgactagaggtccaggtgcatataaaatacctggttttgcagatattccagaaatatttaatgtatccttactaaaaggtgcctcaaatcctagagctgtttattcgtccaaggctgtaggagaacctccactgtttcttgcatcctctatattttttgcaataaaagaagctattaaatctgctcgcacagactataatcttaaaaattactttcaattagatgcacctgcaactgcagctcgtattcgtttagcatgcattgatgactttacatcaaagattgcagaaccaaatttacaacatcaatggaatattgttccataa

SEQ ID NO: 6958 - protein, 1356 aa, Apis mellifera
MVHDDGIINQSKPVMLNNEEKLDRISHTLVFYVNGKEVIDNNVNPEWTLLWYLRNKLRLTGTKLGCAEGGCGACTVMISKLDRTTGIITHLAVNACLTLICAMHGLAVTTIEGIGSVKTTLHPVQERIAKAHGSQCGFCTPGIIMSMYALLRTIPKPSMKDLEIAFQGNLCRCTGYRPIIEAYKTFTEEWEIMQLISKDKEKSLTNGECSMGENCCKKIPIVEPTEVFDSKEFCSYDPSQEIIFPPKLHISSYLDEEYLIIKGKNVTWYRPKTLTELLYLKNQYPNAKIVVGNTEIGVEVKFKYLSYPVLIQPTLIKEMHTIEEYSKVLNIGASVTLVEMEKSLKNQIAIKPEYQTRIFNEIVNMLYYFAGKQIRNVAAVGGNIMTGSPISDLNPIFMAAGVKLNVSSLKNGNRLIPMDHTFFKGYRQNVISSEEILLSIQIPFSEKNQYFIAFKQARRRDDDIAIVNMALNVFFEPESNIVNKAYLAFGGMAPTTVLARKTCNIMIGRKWDKDLLETIYDSLLNELPLSDNVPGGMVKYRRSLTLSLFFKGFLHIAKKFQIFLPKEVESATEGFHTKKLKSSQYYQVVQKDQEANDLVGRSIVHASAYKQATGEAIYCDDMPKFVDELYLAVVLSTRAHAKILKIDATKALSMEGVIVFYSAKDIPEKQRWFGPIFKDEEIFVSEKVTSHGQVIGAIVAINQTIAQKAARMVEIEYENLEPIIISIEDAIKHRSFFNQTPKHINNGDIEKAFIESQHILKGEVRTGAQEHFYLETNATLAIPKEEDELEIFCSTQHPTELQKFISHLLNIHANKIVVRTKRLGGGFGGKESRSAVLALPVVFAAYKLRKPVRCMLDRDEDIIMSGARHPFLLKYKVGFDNSGLIKGAQVYIYNNAGYSYDLSPAVLERAMFHFENSYKIPVSDVYGFICKTNIPSSTAFRGFGGPQGMFLAETMIRHIAEYLNRDPVEIAELNLYKEEDTTHYNQKLFNCTIQRCWKECILSSNYNERLLQVQKYNRENRYKKKGLAIVPTKFGISFSIAFLNQAGALVHVYTDGSVLISHGGVEMGQGLHTKMIQVASRSLKIKPDKIHITETATDKVPNTSATAASASSDLNGMAIMNACNKIMERLKPVIDKNPNGTWEEWVTTAYLERISLSAAGFYKTPDIQYSFETNTGNVFNYFTYGVACSEVEIDCLTGDHQVLQTDIVMDLGESLNPAIDIGQIEGAFMQGYGLFTLEEMIYLRNGAIATRGPGAYKIPGFADIPEIFNVSLLKGASNPRAVYSSKAVGEPPLFLASSIFFAIKEAIKSARTDYNLKNYFQLDAPATAARIRLACIDDFTSKIAEPNLQHQWNIVP

SEQ ID NO: 6959 - DNA, 3741 bp, Strongylocentrotus purpuratus
  CDS (1)..(3741)
atgctttcatatgtccatcctcagacgaaagctatacgccatgaagcagttgtctcctgcctgacgcccatctgtctccttcacggcaaagcaatcactactgtagagggtattggaagcactagagataggcttcatgtagttcaggagcgtcttgccaagagccatggttctcagtgtggtttctgcagtcctgggatggtcatgtccatgtacaccctgctacgtaacaatcccaagccacacgtcaaggatatcctcaggcacctggaaggcaacctgtgtcgctgcaccggatatagacctatccttgatggatttaagtccttctgcgggaaggaggattgctgccagcgaacaggtagctcatgtcagtcagagccggattatcagcctatgagtaccaatgctgaagaatacaatcagacagtgatctttcggaggggtcaatccacatgggtcgtgacgtcaacattggaagaactgcttcaactcttagcggacaactcacaggcgcagctcaccatggggagcaccattatgagtacgctcaagtacgaaggagatcacttccctcttcttgtctcacctggaagaggagtcacagaactgacccaggtcacaacctctgacacaggggtcacctttgggtcaggggtcagcgtgtctcattttgaagagcatctcagggggatggtagagaggttgccggagcaccagactcggtctgccagagctataactgacatgcttggtcagtgggcagggcaacagattcgcaacatggctagtattggtgggagtatagcaggtgcaagtgggatgttggatctgtgtatcatcctcatggcaaccaagacaaccatcactcttgtaaaagctggaggagccagaagaacccttcctctggacaaggatttctacccagagcccaacaagtcagtcctggccagagatgagattattgaatcattacatatacctttcacaggacagaatgattacttcttttctcataaagtggccgagcgtcgtgacaactctcgtgcatcaatcagctgtgggttcagggtgacctttgaacccgaaggtcaaaaggtcgaggatctttgtctggtgtttggtgctattgatgacaatccgtttgtagctcaaaagacatgcaatagtctgatcggacaaccatggaaccaaagttttctgcaggatgcgatccagtcggttaccatggagattacaccaatacctcatcctcatgagatttcagcagagtacaggaagagtggtatggtgacatgtcttctcaggttctatgttcaagtctcccaacgcatcgacaacaagcaggccttgactggtcctttcacccatggtcagttatcagatcctagcatacctgcatcctacaatggggaaggcccagtcagtacacagatctatcagcccccgcccatagaccagccggatgctgatcccctaggtagacccattgtccatcgggcagctcttcagcagtgttctggggaggcggtcttctgtgatgatatacccgtacaagaaggtgagctgtacatggctttggttgtcagttcaagagcccatgcaaagattgtctgtgtggatgcaagcaaggcccttgctctagaaggggtagaagcgtacgtgagccacaaagatattccaggagataagtgtatcgttgaagggtatgaagtcttcgcaacagaggaggtccactgtgttggtcagtgcatcggtgccattgtagctacctcacaccgtctcgccaacaaggctgccaagctggttgaagtccagtatgaagacctacagccggtcatcttgaccattcaggatgcgatcaaagaagatgccatcttccgcggacccgacatcgactctgagttccaccatggtgacctggaggggagcttccagcagtctgaggggatcctggaaggcacctttgatgtgggaggccaggagcacttctacatggagactcagatgtgtgttgtgagacccggtgaagacgatgaaatgaccatccatgccctctgccccaagctattacaaacgtgcaggaaccacatggtccatgtatataaacctaatgctgttgcgagagttcttggtgtccctcgtaatcgcatcgctgttcaggccaagaggatcgggggggcctttggaggaaaagaagagttcctcacccacaatgctgcatgtgctgtagctgccaaaatgttgggccgatccgtgcgcatccgattagaccgctccacagacatgctgatgtcaggtggacgccatccattccacgcaaagtatcgcgtcggttaccgtagcgatggccgtatcctggctctggatgcagatctctatgctaatggaggctatcgtaatgagtctactacttgggttgtgcgccaaagtatgcttgtatttgagggtttttacagcttccctggtttccgagtgaaaggccactgctgtcgaacaaacatgccgtctaacacagctatgaggggctttggtgccccacagtcattggctatcatggagcagatcttgtcagaagtagcgattgcgacgggtgtctcgtcgaggaaggtgcaagagctcaacttcaaacctgatggagcgttgatgatagagggcgcgaatcccatggaaatggacatctttaaggaatgctgggataggtgtctccaactgagtgactatgagaaaagactgaatgcagtggagcagttcaatagggtgaatacttggaagaagcgcggtctttccatcgtccccaccaaacatggaatcggaatatttggtcttatgagcctcaatcaggtgggttccctggttcacatttacaccgacggatcggtcttggtcaaccatgccggcattgagatggggcagggcctctacactaaacttatccaggttgcaagcagagcgctagatgtacctgtgagtaagattcataccagtcctacagctgtggataaggtgcctaatacaacagtaacaggtggaagcactggcaccgatttacatggtactgctgttaagatagcctgcgatatcttaaaggagcgccttgagccataccaaacagccaaccctaaaggtacatgggaagattgggtcagtgcagcctataatgatcgagttagcctgtccactacaggcttttacaagaggcctttctcaccctttgactggaataccctgaccggtaacccatacttctacttcaccatgggggccggtgtgtcggaggtggaaattgactgcctcacaggagagcatcagttactacgaaccgatatcgtcatggacgttggcaagagcatcaacccagccatagacataggccagattgaaggaggcttcctccagggctatggctacttcaccatggaggagaaaagattcaaccaagagggcgccctaaccaccgacagccctgactcctacaagatcccatcagctaaggacattccaaaggagttcaacgtgaccctcctgagaaacatgcgcacccctgaagatcatctctactcctctaagggtatcggagaaccgcccttcttcattggggcttctgtattttttgccatcaagcacgccctcacgagttctcgctctgacaatggcttgggtggtgtcttcaagttcaacgcaccagccactgtccagaatgtacgcatgacatgcggtgatctgaagacggaagaataa

SEQ ID NO: 6960 - protein, 1246 aa, Strongylocentrotus purpuratus
MLSYVHPQTKAIRHEAVVSCLTPICLLHGKAITTVEGIGSTRDRLHVVQERLAKSHGSQCGFCSPGMVMSMYTLLRNNPKPHVKDILRHLEGNLCRCTGYRPILDGFKSFCGKEDCCQRTGSSCQSEPDYQPMSTNAEEYNQTVIFRRGQSTWVVTSTLEELLQLLADNSQAQLTMGSTIMSTLKYEGDHFPLLVSPGRGVTELTQVTTSDTGVTFGSGVSVSHFEEHLRGMVERLPEHQTRSARAITDMLGQWAGQQIRNMASIGGSIAGASGMLDLCIILMATKTTITLVKAGGARRTLPLDKDFYPEPNKSVLARDEIIESLHIPFTGQNDYFFSHKVAERRDNSRASISCGFRVTFEPEGQKVEDLCLVFGAIDDNPFVAQKTCNSLIGQPWNQSFLQDAIQSVTMEITPIPHPHEISAEYRKSGMVTCLLRFYVQVSQRIDNKQALTGPFTHGQLSDPSIPASYNGEGPVSTQIYQPPPIDQPDADPLGRPIVHRAALQQCSGEAVFCDDIPVQEGELYMALVVSSRAHAKIVCVDASKALALEGVEAYVSHKDIPGDKCIVEGYEVFATEEVHCVGQCIGAIVATSHRLANKAAKLVEVQYEDLQPVILTIQDAIKEDAIFRGPDIDSEFHHGDLEGSFQQSEGILEGTFDVGGQEHFYMETQMCVVRPGEDDEMTIHALCPKLLQTCRNHMVHVYKPNAVARVLGVPRNRIAVQAKRIGGAFGGKEEFLTHNAACAVAAKMLGRSVRIRLDRSTDMLMSGGRHPFHAKYRVGYRSDGRILALDADLYANGGYRNESTTWVVRQSMLVFEGFYSFPGFRVKGHCCRTNMPSNTAMRGFGAPQSLAIMEQILSEVAIATGVSSRKVQELNFKPDGALMIEGANPMEMDIFKECWDRCLQLSDYEKRLNAVEQFNRVNTWKKRGLSIVPTKHGIGIFGLMSLNQVGSLVHIYTDGSVLVNHAGIEMGQGLYTKLIQVASRALDVPVSKIHTSPTAVDKVPNTTVTGGSTGTDLHGTAVKIACDILKERLEPYQTANPKGTWEDWVSAAYNDRVSLSTTGFYKRPFSPFDWNTLTGNPYFYFTMGAGVSEVEIDCLTGEHQLLRTDIVMDVGKSINPAIDIGQIEGGFLQGYGYFTMEEKRFNQEGALTTDSPDSYKIPSAKDIPKEFNVTLLRNMRTPEDHLYSSKGIGEPPFFIGASVFFAIKHALTSSRSDNGLGGVFKFNAPATVQNVRMTCGDLKTEE

SEQ ID NO: 6961 - DNA, 3978 bp, Magnaporthe grisea 70-15
  CDS (1)..(3978)
atggccccaattgccatgtctccagagcgggaccccttggcctcgctccattcattgacgactaattatgaagacaccatctcattcttcctcaacggatcaagggtggttcttgacgagatcgaccccgaagtgacacttttggaatatctgaggggcatcggcttgactggcacgaaactcgtcaacgcttgtttggcacctttggccagtgtcgatggcaagcatgtcattaccattgagggtatcggtaacgcgaaaagaccacatccggctcaaaggttgattgctgaaggaaatgggagtcaatgtggcttttgcacgcctggaatcgccatgagctacaggcctatcctcgacgcagcccaggctttcagtgtcaagaaagatgcaagtcttggctgtggcaaatccactgcgaatggcggcgacgggtgttgcatggaaaatggcagcggcggcgcagccggtggattctgtaaagccgacaaatcgagccaatccgaggagtcggggaagaggtttccccaaccaaaactaatgaaatatgaccctgaaacggaactcatatttcctcccgccctgaagaaacaccaattcaaacccctcacgtttggcaacaagcgcaagcgctggtatcggcctgtaaccttacagcagctcttagagatcaagagtgtacatccggacgcaaagatcatcggcggaagcaccgagacccagatagaagtcaagttcaaggccttgagctaccccgtctcggactttgttggcgatatacccgagcttagacagtacgagttgaaggatgaccatctcgagattggtggaaacgtgacgctcacggatctggagggtatctgtcagaaggcaatagagcactttggtgaggctcgctcccaagtctttgctgcgatccacaaacagctcaagtactttgctgggaggcagatcagaaatgttggcacacctgccggtaacctcgcaactgcgtcccccatctcggatctcaaccctatattcgtcgcatcggactccacgctactagctaggtctcttcaagaggagaagccaatagagataccaatggcaagctttttcaaggggtataggatgacagcactaccgaaagatgcgattatcgcctcgatccgaattccaataactcgggaaaagggggatttcttccgatcatacaagcaggccaaaaggaaggatgacgacatctcaattgtcaccggtgccctcagcgtcagtttgaactccgacggcgtagttgagaagtgcaaccttgtctttggcggtatggcagccactactctggccgccaaggaaacatcggaattcatcaccggcaaaaggtttgcggacctggaaacactagaaggtgccatgaacgctctggagaaggatttcaatcttacttttggagtgccgggcggcatggcctcgtaccgaaaatccctcgccctcagtttcttctatcggttttaccacgatgtcatggggagtattggcgcggacagtgatgccacggccctgaccagcactgtggataaggacgccgagctggaactggagcgtgacatctcgactggtacagtggatcgagacacgactgccgcctacgagcaggagatattgggcaagggtaatcctcatcttgcagccctaaagcagacaaccggcgaggcgcaatacacagacgacataccacccttggcaaatgagcttcacggatgcctagttctttccacaaaagcacacgcaaagatcaaatctattgattattcggctgcactagagatcccaggtgtggtagactacgtagacaggcacgacctcccccggcaggacctcaaccgttggggcgcgccgcactttgaagaggtcttctttgccgaggacgaggtgtttactacagggcagcctatcgccctgatacttgcaaaatcggcactgaaggctgccgagggagccagagccgtcaaagtcgagtacgaggaactaccggcaatattctctattgaggaagcaatagaaaaggaaagcttgttcaattacttccgcgagatcaaaaaaggagatccagagggcactttcgacaagtgcgatcacgtttttaccggcatagcccggatcgggggacaagagcacttttacctcgagacgaatgcgactgtggtagtgccaaaaccagaagatggcgagatggagatatactccagcacacaaaaccccaatgagacgcaattgtatgctgcccgcgtatgcgatgtcaagatcaacaagatactagtgcgggtgaagcggctcggtggcggctttggtggcaaagaaacgcgggcggtgcagctcagctccatcatcgcccttgcggcccacaagacgcgccggccagtccggtgcatgctcactcgtgaggaggacatgattatctcgggtcaacgccaccctttcttgggacggtggaaggtcggcgttaacaaagatggcaagatacaagcactggatattgacattttcaacaacggcggctggtcctgggacttgagcgccgccgtctgcgagcgctccatgtctcacagtgatggatgttatcgggtgcccaatgttcatgtgcgcggccgaatctgtaagacaaacaccatgtcaaacacggctttccggggcttcggtggtccgcaaggcatgtttatcgccgagacctacatgtcggaagtcgcagatagactgggaatgcctgtcgagaagttgcgcgagatcaacatgtacaagcacggcgagtcgacgcacttcaaccagacgctcgatggcgactggtttgtacctttgatgtacaagcaggtgcaggaagaaaccaagtatgcagagcgccgcgaggctgtggctcgttttaacgccgaacacaagtggcgcaaacgaggtctggccctcatcccgacaaagttcggcatctccttcactgccctgtggttcaaccaggccggtgccctggtacacatttaccacgacggctcagttctagtcgcacacggaggtaccgagatgggccagggtctccacaccaaaatggccatgatcgctgctcaagcgctcgatgtgcccctggacagcgtccacatttccgagacatcaaccaacaccgtcgcgaacgcatcggctacagcggcgtcagcaagctcggacctcaatggctatgccatcttcaacgcatgcaaacagctcaatgaacgcctggcgccgtatcgcgagaagctcggcaaggacgcgagcatggcaaagctcgccgaagcagcctactttgaccgcgtcaacctgtctgcccagggcttctacaagacccctgagatcggatacacttggggcgagaacaagggcaagatgttcttctacttcactcagggtgtcgcggccgccgaagtcgagatcgacacgctgactggaacctggacctgcctccgtgccgacatcaagatggacgttggccgcagcatcaacccggccatcgactacggccagattcaaggtgcctttgtgcagggtctcggcctgttcacgatggaggagtcgctctggttacgcagcgggccccagaagggcatgctattcacccgtgggccgggcacctacaagattcccggtttccgtgacataccgcaggtcttcaacgtcagcctgctcaaggatgtcgaatggaaggagctgcggacgattcagcggagtcgtggcgtcggcgagcccccccttttcatgggaagctcggtattcttcgctattcgtgacgcccttaaggctgcgagggctcagtatggtgtggaagcaactgtgggaagcgatgacaaggatgatggattgctcaagctcgagagcccggcgacgccggagcgtatccgccttgcttgtgtcgatccaatcatggagcggtctagggtaactcccaatgaaggagagaagaactttttcattgcgatatag

SEQ ID NO: 6962 - protein, 1325 aa, Magnaporthe grisea 70-15
MAPIAMSPERDPLASLHSLTTNYEDTISFFLNGSRVVLDEIDPEVTLLEYLRGIGLTGTKLVNACLAPLASVDGKHVITIEGIGNAKRPHPAQRLIAEGNGSQCGFCTPGIAMSYRPILDAAQAFSVKKDASLGCGKSTANGGDGCCMENGSGGAAGGFCKADKSSQSEESGKRFPQPKLMKYDPETELIFPPALKKHQFKPLTFGNKRKRWYRPVTLQQLLEIKSVHPDAKIIGGSTETQIEVKFKALSYPVSDFVGDIPELRQYELKDDHLEIGGNVTLTDLEGICQKAIEHFGEARSQVFAAIHKQLKYFAGRQIRNVGTPAGNLATASPISDLNPIFVASDSTLLARSLQEEKPIEIPMASFFKGYRMTALPKDAIIASIRIPITREKGDFFRSYKQAKRKDDDISIVTGALSVSLNSDGVVEKCNLVFGGMAATTLAAKETSEFITGKRFADLETLEGAMNALEKDFNLTFGVPGGMASYRKSLALSFFYRFYHDVMGSIGADSDATALTSTVDKDAELELERDISTGTVDRDTTAAYEQEILGKGNPHLAALKQTTGEAQYTDDIPPLANELHGCLVLSTKAHAKIKSIDYSAALEIPGVVDYVDRHDLPRQDLNRWGAPHFEEVFFAEDEVFTTGQPIALILAKSALKAAEGARAVKVEYEELPAIFSIEEAIEKESLFNYFREIKKGDPEGTFDKCDHVFTGIARIGGQEHFYLETNATVVVPKPEDGEMEIYSSTQNPNETQLYAARVCDVKINKILVRVKRLGGGFGGKETRAVQLSSIIALAAHKTRRPVRCMLTREEDMIISGQRHPFLGRWKVGVNKDGKIQALDIDIFNNGGWSWDLSAAVCERSMSHSDGCYRVPNVHVRGRICKTNTMSNTAFRGFGGPQGMFIAETYMSEVADRLGMPVEKLREINMYKHGESTHFNQTLDGDWFVPLMYKQVQEETKYAERREAVARFNAEHKWRKRGLALIPTKFGISFTALWFNQAGALVHIYHDGSVLVAHGGTEMGQGLHTKMAMIAAQALDVPLDSVHISETSTNTVANASATAASASSDLNGYAIFNACKQLNERLAPYREKLGKDASMAKLAEAAYFDRVNLSAQGFYKTPEIGYTWGENKGKMFFYFTQGVAAAEVEIDTLTGTWTCLRADIKMDVGRSINPAIDYGQIQGAFVQGLGLFTMEESLWLRSGPQKGMLFTRGPGTYKIPGFRDIPQVFNVSLLKDVEWKELRTIQRSRGVGEPPLFMGSSVFFAIRDALKAARAQYGVEATVGSDDKDDGLLKLESPATPERIRLACVDPIMERSRVTPNEGEKNFFIAI

SEQ ID NO: 6963 - DNA, 4068 bp, Nasonia vitripennis
  CDS (1)..(4068)
atggaatcgaaacaactgtacgatgtaaaagagaacgaagataaccatcaaattgaaaaaataagcaactttttaatattctatgtgaacggtaaaatgattaaagactgcaacattgagccagaatggacattaatttattacctgcgaaataaattaggattatgcggaacaaaacttggatgctcggaaggtaactgcggagcctgcacagtaatgatatcaagatttgatagaaagaacaacaaaataattcatttagcagcgaatgcatgtttaacaccagtgtgtgcaatgcatggcatggctgtcactactgttgagggcatcggtagtacaagaaacaaacttcacccagtacaagagcgccttgctaaagctcatggatctcaatgcgggttttgtacgccaggcatcgttatgtcaatgtatgctttactaagaagtaatccaaaacctacgatgaatgacatagatatagcttttcaaggtaatttatgcagatgtactggctatagacctataattgaaggattaagaacttttaccaaagaatgggaacaatcacgtatgtcaaagctcaaaaatcatgaggaaaaattatgtgccttaggaaatgcttgttgtaaaaaggctttcacatcagaaccaaccgctttatttgattctaaggaattcacaccgtacgattcttcacaagaacctatttttccgccaagtttacagttatcgtcgaacttagatgatgagtatttaataatcagtggaaaagaagttacttggtatagaccaacgcaattaaagaagctgcttattttaaaaaatcaatatccaaatgcaaaaataatagtaggcaacacagaagtaggtgtggaagtgaaaatcaaacacctaatgtatccagttctaattcaatcaactgcaataaaagaattaaaaatcattgaagaaatgaatgatggaattaaaataggagctagtgtcacgttagtggagatggaatctgcccttcggcatcaaattagtactaaacatgaatccagaacaagaatatttggaagcatcgttaaaatgttacattggtttgctggtcatcaaataagaaatgttgccgcagtaggagggaacatcatgacaggaagtccaatttcggatttgaatccaatttttttggctgtcggtattaaattaaatttgtgtagtcttaacaacggccatagatctgttatcatggataatacattttttcttggttaccgacgcaacatcgttgctccggatgaagtattattatccattgaagtaccttttaacacgccgaatcagtattttgtttcatataaacaatccaaacggcgtgatgacgatattacaatagttaacatggctatgaatgtattttttaaacctaatactaacattgttcagaaaataaatctaacttttggcggcatggctcctattactgtattggcaaaaaaaacttgtgaatctttggtgggaaagaattgggatgaaagtattttagaggctgtaaccaacaatttagttgcggaattgactcttcccgggaatgcaccaggtgggatgatactgtatcgacgttcattaactttgagtttatttttcaaaggtttcataagcatatggaaaaaattacacaaagacatcccaaacatagcaccagtattaaaagaattggaatctgcttctgatggttttcattacttacctcctaagagttctcaatattaccaaatggtttccaaagatcagtcatcgattgatttgattggaaggcctctaatacacgccagtgcatttaaacaagcaagtggagaagcaatctattgtgatgatatccctcgaataacgggcgaactttatttagctctcgtgttatcaacaagggctcatgccaggataacagggatcgataattctaaagctgttgctttagatggcgtagtggcctattttgatgcaaaagatattccggagcatcgccgattcgtcggtcccattataaaagatgaagaagtttttgtttcggaaaaagtaacatgtcatggccaagtgattgcagcaatagtagctgttgatcaagtgacagctcaaaaagcagctaggatggttaaaattgattacgaagaactgcaacctgtacttttgacgattgaggatgctattgaggcaaaatcatttctcgaaaaagatggaagaagtatcaccaaagggaacgtcgacgaagcgtttaccaatgtagatcacatactcgagggagaaataagaatgggaggtcaagagcatttttatttggaaactcagtgctccattgctataccaaaagaagaacatgaaatggaaatcatagcatcaacacaagatcttgcagaaatgcaacgactcattgctcatgttcttgacattccaattaacagagttacagtacgtactaagagattaggtggtggctttggtggtaaagaatcgcgcagtatgcttgctgcactgccagttgcgtttgctgcgcacagcttacaaaaacctgtgcgatgtatgctagatagagatgaggacatgatgatcactggaaccaggcatccatttttgttcaaatacaaagtgggattttctaatgaaggattaataaaagtcctcgaagtatatgtttacgctaatgttggttgttcgtgggatttatcaggcccagctatatcacgtacaatggcccatatagaaaacgcttataggataccagctatcagagtcatcgggtacttatgcaaaaccaatttgccttcaaatacagcctttcgtggttttggaggacctcaaggaatgttttgcgctgaaactataatacgacacattgcggattatcttgatcgagatgttgtgcagctttctgaaataaatttatacaaagaaggcgacatcacacattataaccaaaaactagaaaattgcacgatgcaacggtgttggattgaatgtcttgcattctcaaactatgaacaaagattagcagctgtacaaaaatttaatagtgaaaacagatataaaaaaaaaggaataaccgtgattcccacaaaattcggcatagcatttgagacgctgtttcttaatcaaggtggtgcgcttgttcatatttatactgacggatccgttcttttaacgcatggaggcatagaaatggggcaaggagtacacactaaaatgattcaagttgctagtagaattttgaaagtacatcctgacaaaattcttatcacagagacagctacagacaaagttccaaatgcgactgctacagccgcaagtactgggtctgatttaaatggaatggctattatggatgcatgcaataaaataatgaaacgaatcaaatatataatagatgctaatcccgaaggcacttgggaaagttggatagaaaaagcttatttcgaccgagtaagtctttctgcaactggattttacagaacgcccgatataggatacgattttgcaacaaactcgggcactttatatgattattttacatacggggtagcatgttctgaagtaatcattgatagtcttaccggagaccaccaggtcttaagaactgatatcgttatggatttgggagaaagtttaaatcctgcgatcgatatcggacaagtggaaggaggatttattcaaggttatggactttttacaatggaagagatgatttactcgccaactggaatagtttatagtcgaggtccaggagtttataaaatccctggttttgcagatataccacaagagttcaacgtttcattgttaaagggttcatccaatccaagagcagtatattcatcgaaggccataggcgaaccaccgctatttttatcttcgtcaattttctttgcaataaaaaatgcgatcaaagctgctcgcaaagatatgaacttgcatgggtattttagattcgattcgccagcgactgccgctcgcatccgaatggcttgcactgatgattttacaaaaaagattggagatggtgatggaaaaaaaccttggaatataaccccctaa

SEQ ID NO: 6964 - protein, 1355 aa, Nasonia vitripennis
MESKQLYDVKENEDNHQIEKISNFLIFYVNGKMIKDCNIEPEWTLIYYLRNKLGLCGTKLGCSEGNCGACTVMISRFDRKNNKIIHLAANACLTPVCAMHGMAVTTVEGIGSTRNKLHPVQERLAKAHGSQCGFCTPGIVMSMYALLRSNPKPTMNDIDIAFQGNLCRCTGYRPIIEGLRTFTKEWEQSRMSKLKNHEEKLCALGNACCKKAFTSEPTALFDSKEFTPYDSSQEPIFPPSLQLSSNLDDEYLIISGKEVTWYRPTQLKKLLILKNQYPNAKIIVGNTEVGVEVKIKHLMYPVLIQSTAIKELKIIEEMNDGIKIGASVTLVEMESALRHQISTKHESRTRIFGSIVKMLHWFAGHQIRNVAAVGGNIMTGSPISDLNPIFLAVGIKLNLCSLNNGHRSVIMDNTFFLGYRRNIVAPDEVLLSIEVPFNTPNQYFVSYKQSKRRDDDITIVNMAMNVFFKPNTNIVQKINLTFGGMAPITVLAKKTCESLVGKNWDESILEAVTNNLVAELTLPGNAPGGMILYRRSLTLSLFFKGFISIWKKLHKDIPNIAPVLKELESASDGFHYLPPKSSQYYQMVSKDQSSIDLIGRPLIHASAFKQASGEAIYCDDIPRITGELYLALVLSTRAHARITGIDNSKAVALDGVVAYFDAKDIPEHRRFVGPIIKDEEVFVSEKVTCHGQVIAAIVAVDQVTAQKAARMVKIDYEELQPVLLTIEDAIEAKSFLEKDGRSITKGNVDEAFTNVDHILEGEIRMGGQEHFYLETQCSIAIPKEEHEMEIIASTQDLAEMQRLIAHVLDIPINRVTVRTKRLGGGFGGKESRSMLAALPVAFAAHSLQKPVRCMLDRDEDMMITGTRHPFLFKYKVGFSNEGLIKVLEVYVYANVGCSWDLSGPAISRTMAHIENAYRIPAIRVIGYLCKTNLPSNTAFRGFGGPQGMFCAETIIRHIADYLDRDVVQLSEINLYKEGDITHYNQKLENCTMQRCWIECLAFSNYEQRLAAVQKFNSENRYKKKGITVIPTKFGIAFETLFLNQGGALVHIYTDGSVLLTHGGIEMGQGVHTKMIQVASRILKVHPDKILITETATDKVPNATATAASTGSDLNGMAIMDACNKIMKRIKYIIDANPEGTWESWIEKAYFDRVSLSATGFYRTPDIGYDFATNSGTLYDYFTYGVACSEVIIDSLTGDHQVLRTDIVMDLGESLNPAIDIGQVEGGFIQGYGLFTMEEMIYSPTGIVYSRGPGVYKIPGFADIPQEFNVSLLKGSSNPRAVYSSKAIGEPPLFLSSSIFFAIKNAIKAARKDMNLHGYFRFDSPATAARIRMACTDDFTKKIGDGDGKKPWNITP

SEQ ID NO: 6965 - DNA, 4080 bp, Nasonia vitripennis
  CDS (1)..(4080)
atggaatcacatacttataaggaacagatggaaaacgaactgaaggcgaacaatgatgcacttaacgatatcaatagtataaaaattagtaatactttagttttcttcgtgaatggaaaagaagtaagggacagcagagtcgagccagaatggacgctattatactatctacgaaacaaactaaatctttatggaaccaaactgggatgcgcggaaggaggatgcggggcctgtactgttatggtctcacgatacgatcgtaaacaagataaaattattcacgttgctgtaaatgcatgtttgactcccgtatgtgcaatgcacggcatggctgtaactactgtcgagggcatcggtagcacgagaacaaaacttcatcctgtgcaagagcgtattgcgaaagctcacggatcacaatgtggtttttgcactccgggtattgttatgtcaatgtacgcattactgagaacgaaaccgttgccgtcaattcaagatatcgaagttgcttttcaaggaaacctgtgccgatgtactggataccgaccaattatcgaaggctacaagacatttaccgaagaatgggaaaagtcgcgattgtccagaaatgacgagggtaaagatagaacttgcgctatgggcgatgcttgctgtaggcgtgtcttcacatcagaaccacaggaagtttttgacaccaacacttttacaccatacgacccttctcaagaaataattttccctccaaaattacaactttcttcagaattcgatgacgagtattttattatgaaaggcaaggaggtcacctggtatcgaccaattcatttgagagaaatcttagcattgaaacaacaatacccgaattcgaaaatcatagttggaaatactgaagttggagtcgaagtgaagtttaaacatttcgtgtaccctgtgcttatacaaccaatcaaaataaaagaacttcgtgatataaccgaactaaatgatgcaataagaataggtgctagtgtaacacttattgaaatggaggaggctttacgtcaccaaattcaaactaaaccagaagagaaaacaagaattttcgattcaatagtgggaatgcttaattggtttgctggaaaacaaatacgaaatgttgctgccataggaggtaatattatgaccggcagtcctatatctgacatgaacccagtattgatggcagcaggaattaaattaaacgtgtgcagccttgaaagaggtgtcagatcgattacaatggatcattctttttttgttggatatcgacgtaacgttgttgcaccggatgaagtattactctctattgaaattccttactctactcctaatcaatattttgtatcttataaacaagccaaaagaagagatgatgatatcgctattgtcaatttagccttaaacgtattttttgagccccgaacgagcattgtggccaaatcttatatggcttttggtggtatggcaccaacaacgattttagcgagaaaaagttgtgaagctatgattggaaaaaaatggaatgaacaattggtagagactgttacggattctttagttaatgagttgcccttgagcggtgacgcacctggtggtatggttctatatcgtcgatctcttacactaagtttattttttaagggtttcgtttgtattaccaagaagcttcgtattagtgttaacgacgttgaccctctgccaaaggaacttgaaactgcaggagaaggtttccacttccaagcaccaaaaagttctcaatactttcaagttgttcctaaggatcaaagctcgattgatttaattgggaggcccataattcatatcaatgctttcaaacaggcaactggcgaagcaatttattgtgatgatatacctcgcataactggagaattgtacttagctttggtgctatcgacaaaagctcatgctaagattgtgaaaatcgatccttctcaagcgttagctatggaaggagttgaagcatttttgagtgcggaagatattccagaaaagcagagaattataggtcacaaatgctttgacgaagaagtatttgtttccaaaatagttacgagtcaagggcaatcacttggtgctattttggcagttgatcaaataactgcacaaaaagcagtcaaattagttaaagtcgaatatgaagaattacaaccaatcataattactatcgaggatgctataaagcataaatcgttcttccatgaacgtccaacagtaatatgcaatggagacgttgacaaagtttttgctgaatctgatcacgttatagaaggcgaagtaagaatgggtggccaagaacatttctacttggaaactcaagcatcattagcaaacttccgcgaagaaggagaattggaactattttcttcaacacagaatcctacagaaattcaaaaactcactgcacacgttctgaatctaccgatcagcagaataaacgtccgtgtaaagcgacttggtggtggctttggtggtaaagaaacacgagaagcactagtagcattgcctgttgctattgcagcttacaaatatagaaaacctgtgagatgtatgttagaccgagatgaagatatgatgataacaggaacaagacatccatttctcataaaatacaaagttggatttactaaagacggactaattactgccgctgaagtttgcctttacaacaattgtggttactcaacggacctttcacctgcggttcttgaatgtgctatgttttacgttctcaatgggtacaaagtaccggttgctaaagtatcaggttacatgtgtaaaacaaatctaccttcaaatacagctttccgaggatttggaggaccacagggaatgttttgcgctgaaaatataattcgacaaatagctgattatttgggacttgatcacgttaagatatccgaaaaaaatttgtatagagaaggagacattacattttacaatcaaccactaattaaatgtacactcagaagatgttgggaagagtgcttgttttcgtcaaactacaaagaacgagtaacggaagtgaatcaattcaataaagagcacaggtacaaaaaacgaggaatagctgttgtaccagtgatgttcggaataggatatgaagtagcttttcttaatcaaggtggagcacttgtacatgtatataccgatggatctgttcttttaaatcatggtggtgtcgagatggggcaaggcttatatacaaaaatgattcaaatagcaagtcgtattctaaaagttaagccagataaaatttatactgccgaaacaggcaccgataaagttccaaatacaattgcaactgcagctagtcttggttctgacctcaatggaatggctgttttggatgcctgcacaaaaataatggaacgaattaaatacataattgatgatgatcctgaaggcacttgggaagattgggtaaagcgcgcatattttgaccgaatcagtctttcagctactggatattaccggaccccagaaattggttatgactttgacactaactcaggaaggcgattcaattactacacatatggcactgcctgcacagaagtagaacttgattgtttgacaggagatcacgaggttttacggagtgatgttgttatggatcttggggaaagtttaaatcctgctattgatattggccaagtagaaggtggattcatgcaaggttatggattattcacaatggaagaaatggtgtattctccaacaggagttgtatttagtcgcggaccaggagtatataaaataccgagttttacgaatataccgagagagtttaatgtatcattacttaaggcttcatccaatccacgagcagtattttcttcaaaagctactggtgaaccccctctatttttggcatcttctgcattcttcggcatcaaggaagctattagagctgctcgaaaagacatgggaatccacgggtattttagacttgattcgccagctactgcagcccgcattcgtatggcttgtgttgatcaacttactaaaaaggtcattcaaagcttaatgaaatactataattaa

SEQ ID NO: 6966 - protein, 1359 aa, Nasonia vitripennis
MESHTYKEQMENELKANNDALNDINSIKISNTLVFFVNGKEVRDSRVEPEWTLLYYLRNKLNLYGTKLGCAEGGCGACTVMVSRYDRKQDKIIHVAVNACLTPVCAMHGMAVTTVEGIGSTRTKLHPVQERIAKAHGSQCGFCTPGIVMSMYALLRTKPLPSIQDIEVAFQGNLCRCTGYRPIIEGYKTFTEEWEKSRLSRNDEGKDRTCAMGDACCRRVFTSEPQEVFDTNTFTPYDPSQEIIFPPKLQLSSEFDDEYFIMKGKEVTWYRPIHLREILALKQQYPNSKIIVGNTEVGVEVKFKHFVYPVLIQPIKIKELRDITELNDAIRIGASVTLIEMEEALRHQIQTKPEEKTRIFDSIVGMLNWFAGKQIRNVAAIGGNIMTGSPISDMNPVLMAAGIKLNVCSLERGVRSITMDHSFFVGYRRNVVAPDEVLLSIEIPYSTPNQYFVSYKQAKRRDDDIAIVNLALNVFFEPRTSIVAKSYMAFGGMAPTTILARKSCEAMIGKKWNEQLVETVTDSLVNELPLSGDAPGGMVLYRRSLTLSLFFKGFVCITKKLRISVNDVDPLPKELETAGEGFHFQAPKSSQYFQVVPKDQSSIDLIGRPIIHINAFKQATGEAIYCDDIPRITGELYLALVLSTKAHAKIVKIDPSQALAMEGVEAFLSAEDIPEKQRIIGHKCFDEEVFVSKIVTSQGQSLGAILAVDQITAQKAVKLVKVEYEELQPIIITIEDAIKHKSFFHERPTVICNGDVDKVFAESDHVIEGEVRMGGQEHFYLETQASLANFREEGELELFSSTQNPTEIQKLTAHVLNLPISRINVRVKRLGGGFGGKETREALVALPVAIAAYKYRKPVRCMLDRDEDMMITGTRHPFLIKYKVGFTKDGLITAAEVCLYNNCGYSTDLSPAVLECAMFYVLNGYKVPVAKVSGYMCKTNLPSNTAFRGFGGPQGMFCAENIIRQIADYLGLDHVKISEKNLYREGDITFYNQPLIKCTLRRCWEECLFSSNYKERVTEVNQFNKEHRYKKRGIAVVPVMFGIGYEVAFLNQGGALVHVYTDGSVLLNHGGVEMGQGLYTKMIQIASRILKVKPDKIYTAETGTDKVPNTIATAASLGSDLNGMAVLDACTKIMERIKYIIDDDPEGTWEDWVKRAYFDRISLSATGYYRTPEIGYDFDTNSGRRFNYYTYGTACTEVELDCLTGDHEVLRSDVVMDLGESLNPAIDIGQVEGGFMQGYGLFTMEEMVYSPTGVVFSRGPGVYKIPSFTNIPREFNVSLLKASSNPRAVFSSKATGEPPLFLASSAFFGIKEAIRAARKDMGIHGYFRLDSPATAARIRMACVDQLTKKVIQSLMKYYN

SEQ ID NO: 6967 - DNA, 3990 bp, Anopheles gambiae str. PEST
  CDS (1)..(3990)
ctggtctttttcgtcaatggcaagaaggttaccgatgatggtccggatccggagtgcaccctgctggtgtatctgcgggaaaagttacgcctctgcggcacgaaactcggatgtgccgagggaggatgcggagcatgtacggtgatggtgtcgaaggttgatcgtaaaacgggctcgctgcatcatctggcagtcaacgcttgtctgacgcccgtttgtgccgtgcacgggatggctgtgacgacggtcgagggtatcggaagtactcggacgcgcctccaccccgtccaggagcgcatcgccaaagcgcacggctcgcagtgtggcttctgtactcctggtatcgtcatgtcgatgtactcgttgctgcgcagctctcccgttccctcgatgaaagagctggaggttgccttccaggggaatctgtgtcgctgcaccggctatcgaccaatcctggaggggtacaaaaccttcaccaaggagttcggctgcgccatgggagacaaatgctgtcgcaacggcaatggtaacggatgtggacagaacggcaacggagagctagacaccgagctgttccagccgaacgagttcgttccttacgatccatctcaagagcccatttttccaccggaattgaagctttccgacaagctcgactctgaatcgctggtctttcgtacctcccgtgccgcttggtatcgaccaacaacgctcaacgatctgttggccctcaagaaagcccatccagagacgaagattgtcgtcggtaacacggaagtgggcgtggaagtgaaattcaaacactttgagtatcccgtcctctcccatccaaataaaggagttgacgacgatcgagcgacaagtggactcaaaataggatccgccgtcacgttgatggaaatggagatcgcgctgcggaaagaaatcgaaaccggtcctgaaaccgagactcgcctgtaccaagcgatcgtcgacatgctgcactggttcgctggaaagcaaatccgtaatgttgcctcggttggaggaaacatcatgacgggaagccccatttcggatctaaatcccatcttcacggcagccgcgatcgagctggaagtggccagcctcgacggaggcttccgcaaggtacgcatgggcgatggattcttcactggctaccggaagaacgtcattcaaccgcaagaagcgctcgtttcgctgtttattccacgcaccaccaaggatcaatacttcatcgcgcacaagcaggccaaacgccgcgatgatgatattgccatcgtgaatggagccttcaatgtgcgtttccgacccggtacggatatcgtcgatgagatccatctggcttttggtggaatggcgccaacgacagttctggccaagaagacggccaccgctctagtcgggacgagatgggacgcacaactcgtggagcgttgcaatgatttgttggtggaagagcttcctctgagtccttcggctccgggcggcatgatcgtgtatcgtcgttcattgactttgagtctctttttcaaggcttatcttgccattgcacaatcgctcgataagcaatccattccccacaggacacccattggggagcgggaaaaaagtggagccaatacgttccatacgttggtacccaagagcactcagctgttcgagaaggtttctggtgatcaaccggccacggatcctattcgtcgaccgcaagtgcacgcttccgctttcaaacaagtcaccggagaagctatctattgtgacgacattccaaagtttgccaacgagctgtatctagcatttgtgtacagtacaaaggcacacgccaagattctgtcgatcgatgcatcggaagcactgaaacaggagggtgtgcatcggttctttagcgcagatgacttgaccgaagagcaaaacaaggctggtccagtgttccacgatgaatttgtctttgtgaaagatgtcgtcactacgcagggacaaataattggagctattgtggccgacaatcaaacaattgcccaaagagccgctcgccaggtgaaagtcacttacgaagaactgcaaccggtaatcgttacgctggaggatgctatcagactggagtcgttctatcccggattccccagaatcattgccaagggagacgttgagaaggctctgtccgaggcggatgttatcatcgaaggcgattgtcgcatgggtggacaggagcacttctacctagaaacgcaagcatgtctggctgtgccgaaggattcagacgaaatcgaggtgattagcagcacccagcatcctaccgagattcaacaccacgtggcgcaaactctgggcatacccgcctcgaaggttgtttctcgtgtgaagcgtcttggaggtggttttggtggcaaggaatcgcgtgccgccattgtggccattccggttgccttggccgcgcaccgcatgggcagacccgtccgctgcatgctcgacagagacgaagatatggcagtgtccggtacgcgacatcctttctacttccattacaaagtgggagtcagcaaggacggcaagctgttggccggcgatttccgcgcttacaacaatgccggccattcgatggacctgtcctttgccgtgctggagcgttcaatgttccacatccaaaacgcatatcgtatcccgtctgcgtgtccgtggatgggtttgtcgcacaaaccttcaaacaccgctttccgcggtttcggcggtccgcagggtatgatggcggcagaaacaatgatgcgccatgtggcccgcacactgaaccgggactatgtcgagctgatcgagctgaacatgtaccgggaaggcgatacaacgcactacaaccagcagatcgagggctgtaatgttggtaagtgctggagtgaggttttgcaatcggccgattttgccaaacgccgggaagcggtcgaaaagttcaacgaagaacaccgttggcgcaaacgcggcattcacgtcgtaccgacaatgttcggcatcgctttcaccgtgctgcacctgaaccaaagcggcgccctgattcacgtgtaccaggatggcacggtgctgctaacccatggcggtaccgagatgggccagggactgcacacgaaaatgattcaggttgctgccacggcgctaggaattcctttcgatcgcatccacatttccgagacgtctaccgataaggttccgaacacttcggctacggcggccagtgctgggtcggatctaaacggcactgcggtgctgaatgcttgcctcaccatccgcgagcgattggaacccatccgcaaagagttccccgacaaggactggaacttctgggtcagtaaggcgtacttcagccgagtgtcactgtcggccactggattctatgcgacgcccgatctgggctacgattttggcaccaattcgggcaaagcgttcaactactacacttacggtgcggcttgctcggaggtagagatcgactgtctgactggagaccatcaggtcatccgaaccgacgtcgtaatggacttgggctccagcattaatcctgccatcgatatcggccaaatcgaaggtggattcatgcaaggctacgggctattcacgctggaagaaatggtctactcgccccagggtcaggtgttttcccgcggtcctggcatgtacaaattgcccggttttgccgacatccctggggagttcaacgtttcactgctcactggggcgcccaatccgcgcgcaatttactcatcgaaggccgttggtgaaccgccacttttccttgcctcgtccatattcttcgcaatccgcgatgctattgccgcggctcgaaaggaggaaaaactgtccgacgattttacattagtttcaccggccacttcgtcgcgcatccgcacagcttgtcaggataaatttgtagaacgctttacgaagcagcaaagcaatggagcagaagcagctcgcgtcgttccatggaatgtaatgccttaa

SEQ ID NO: 6968 - protein, 1329 aa, Anopheles gambiae str. PEST
LVFFVNGKKVTDDGPDPECTLLVYLREKLRLCGTKLGCAEGGCGACTVMVSKVDRKTGSLHHLAVNACLTPVCAVHGMAVTTVEGIGSTRTRLHPVQERIAKAHGSQCGFCTPGIVMSMYSLLRSSPVPSMKELEVAFQGNLCRCTGYRPILEGYKTFTKEFGCAMGDKCCRNGNGNGCGQNGNGELDTELFQPNEFVPYDPSQEPIFPPELKLSDKLDSESLVFRTSRAAWYRPTTLNDLLALKKAHPETKIVVGNTEVGVEVKFKHFEYPVLSHPNKGVDDDRATSGLKIGSAVTLMEMEIALRKEIETGPETETRLYQAIVDMLHWFAGKQIRNVASVGGNIMTGSPISDLNPIFTAAAIELEVASLDGGFRKVRMGDGFFTGYRKNVIQPQEALVSLFIPRTTKDQYFIAHKQAKRRDDDIAIVNGAFNVRFRPGTDIVDEIHLAFGGMAPTTVLAKKTATALVGTRWDAQLVERCNDLLVEELPLSPSAPGGMIVYRRSLTLSLFFKAYLAIAQSLDKQSIPHRTPIGEREKSGANTFHTLVPKSTQLFEKVSGDQPATDPIRRPQVHASAFKQVTGEAIYCDDIPKFANELYLAFVYSTKAHAKILSIDASEALKQEGVHRFFSADDLTEEQNKAGPVFHDEFVFVKDVVTTQGQIIGAIVADNQTIAQRAARQVKVTYEELQPVIVTLEDAIRLESFYPGFPRIIAKGDVEKALSEADVIIEGDCRMGGQEHFYLETQACLAVPKDSDEIEVISSTQHPTEIQHHVAQTLGIPASKVVSRVKRLGGGFGGKESRAAIVAIPVALAAHRMGRPVRCMLDRDEDMAVSGTRHPFYFHYKVGVSKDGKLLAGDFRAYNNAGHSMDLSFAVLERSMFHIQNAYRIPSACPWMGLSHKPSNTAFRGFGGPQGMMAAETMMRHVARTLNRDYVELIELNMYREGDTTHYNQQIEGCNVGKCWSEVLQSADFAKRREAVEKFNEEHRWRKRGIHVVPTMFGIAFTVLHLNQSGALIHVYQDGTVLLTHGGTEMGQGLHTKMIQVAATALGIPFDRIHISETSTDKVPNTSATAASAGSDLNGTAVLNACLTIRERLEPIRKEFPDKDWNFWVSKAYFSRVSLSATGFYATPDLGYDFGTNSGKAFNYYTYGAACSEVEIDCLTGDHQVIRTDVVMDLGSSINPAIDIGQIEGGFMQGYGLFTLEEMVYSPQGQVFSRGPGMYKLPGFADIPGEFNVSLLTGAPNPRAIYSSKAVGEPPLFLASSIFFAIRDAIAAARKEEKLSDDFTLVSPATSSRIRTACQDKFVERFTKQQSNGAEAARVVPWNVMP

SEQ ID NO: 6969 - DNA, 4107 bp, Gibberella zeae PH-1
  CDS (1)..(4107)
atggcgcctagcgctgtatcgcctacgagggagtccaaccctgaacctctggcaaccctaacatccaaattcgacgacactctacgattttaccttaatggaaccaaggttgtcctggatgagatagatccagaagttacagtcttggaatacctaagagggatcggcctcacaggaacaaaacttggctgtggcgagggtggttgcggagcttgcacaatcgtggtcagccagtataaccctactaccaagcagatttaccatgccagtgtaaatgcctgcttggcgcccctggtcagtttggacggtaaacatgtcgttaccgttgaaggcatcggcaattcccagaaaccccaccctactcaggagcgtatcgccaagtccaatggcagccaatgtggcttttgtactcctggtattgtgatgagcttgtatgccttactacgtaacaacgactctccttccaaagatgacattgaagaggcgttcgacggcaacttgtgtcgatgtaccggctataggtccatcctggatgcggctcaaacctttagtgttgataagcccggtagcaagttcaagaaagcaggtggcagtggatgttgcatggaaaacggtaacggaccacctagcggtggctgctgtatggacaaggcaaacttggacgacacacctatcaaacgattcacacccccgggatttattgagtaccaacccgacacggagctcatcttcccgcctgctttgaagagacacgaactacggcctttggccttcggtaacaagaggcgtagatggtatcgacctgtcactaccgaacaactcttgcagatcaagagtgctcatccccaggccaaaatcattggtggaagtacggaaactcaaatcgaaaccaagttcaaggcgctggagtatcctgtttccgtctacgtcggtgatatcgccgagttgcggcagtacagtttcaaggatgaccaccttgaggttggcggtaatgttgtcctgactgatctggaaagcatctgtgaacatgctattccgcattacggacgagagcgcgcccaggtcttcgaggctatgctcaagcagcttaagttctttgctggtcgacaaatccgaaatgttggtactccagcaggaaaccttgttacggcttcaccaatctcggatcttaaccctgttttatgggcggcgaacgctgtgttggtggcaaagtcatcgactaaggagatagagatccccgtctcccaattctttaccggctaccgaaagacagcacttgctcaggatgcgattattgcttcaatacgcattcccgtcgcccaaggcaagggtgaattctttagggcatacaagcaggccaagcgaaaagacgacgacattgccattgttaccggtgcactgagagttcgtctggacgatgaaggtattgtccaagaagcaaacctcatctacggtggcatggctgctatgactgtagccgccaaaacggctggagaatacttggtcggacgacgtttcgccgacctggaaacgttggagggaacaatgagtgcactcggtcgagactttgacctacaattcagtgttccaggtggtatggcgtcttatcgaaagtctttggcattcggattcttctatcgattctatcatgacgtcctgacgataaccgatggaagttctgagcaagttgacaaggaagctattgacgaaatcgagcgagatatttcgaatggcgaggtagatcaccatgctgcggcagcttacgaaaaggaagtaactggaaagtccaaccctcatctggcagctctcaaacagacgactggcgaagcgcaatacaccgacgatatgcccgcgttaaagaatgagcttcatgcctgctatgttctttcgaaacgagcacatgccaagcttctctctgtcgattactcggctgctcttgatatacctggagtagttgatgttgttgacaaagacgatatgccctcaccagaagccaacaagtttggcgctcctcactttgacgaggtattcttcgcagaaggtgaggtattgacagtgggccaaccaattgctctggttctagcaacatctcctcaaagggctcaggaggcagcgcgggcagtcaaggtcgaatacgaagatcttccatcggtactttctatagaagatgctatcgccgctgacagctatcataacttctaccgagagatcaagaaaggagatgcggagaaagccttccaggaatgtgaccatgttttcaccggaacagtgagaatgggtggccaagaacacttttatctcgagacaaatgcttgtttggttgttcctaagcctgaggacggagaaatcgagatcttcgccagtacacagaacgccaacgaaacgcaagtttttgcttcaagagtgtgcgatgtgcaatcgaacaaggttgtcgtccgcgtgaagcgactgggcggtggttttggtggaaaagaatcgcgatcagtggtactcagctcagcattggcacttgcagcaaagaagaccaagagaccggtccggtacatgctaactcgagaggaagacatggttatcagtggccaacgacatcctttccttggccggtacaaggttggtgtgaacaaggacggtaaactccaagctctggattgcgatgtcttcaacaatgcaggatggactttcgacctcagcgcagccgtatgcgaacgagccatgacccacattgacgggtgctacgacatacccaatgtacacattcgcgggcgcttgtgcaagacgaacacaatgtccaatacggccttccgtggatttggtggccctcagggcatgttcatcgcagagtcgtatatggaagaagtggctgatcggctgggaatgcctgtcgagacactgcgacaaatcaacttgtatgagagtgatggagtgactcatattggacagggcttgggagattggcatgtgccgctcatgtacaagcaggtgcaagatgaggctatgtacaccgcacgccgacactttatcacacagttcaacgagaccaacaagtggcggaagaggggcttggcactgattccaaccaagtttggtatctctttcaccgctttgtttctgaaccaggccggagcattggtacacatctaccatgatggatctgttctggtagcccatggtggtacagagatgggacaaggcttgtacaccaagctcactcaaattgctgcacaagcattgggtgtgccactggacaatgtcttcatctcggaaacgtcgacaaatacggtggctaacgcatctgcaacagcggcgtcagcttcgtcagatctgaacggatatgccatctttaatgcatgcgaaatgttgaacgagcgattggcaccgtatcgaaagaagctgggtcccgacgcaacgatgaaagacctcgcccacgccgcttactttgaccgcgttaacctctcggcgcagggtttctacaagacccctgaaattggttatgactggactactggcaagggcaagatgttcttctacttcactcaaggagttgctgcagccgaggttgaggtcgatttactgactggaacctggacatgtatccgggcagacatcaagatggatgttggccagtccatcaatccagcaatcgactacggccagatccagggtgctttcatccaaggcctcggcctcttcacgatggaggaatcgctctggttaagaaacggcccaatggcaggtcatctcttcacgcggggacctggagcatacaagatccctggtttcagagatattccccagacattcaatgtgtcgcttctcaaggacgtggagtggaaagaattgcgcacgattcagaggagtcgtggtgtaggtgaaccacccttctttatgggaagctctgtcttctttgccatccgagatgcactcaaagcagctcgggcacagtcaggagtcaaagccaaggttggcgagaacgactctgagggactcctcaggcttgagagtccagcaacgcccgagaggatcagactggcttgtgaggacgagatcatgcgcaaggcaagggttgtgcccaaagaaggagaaaagagcttctttgtggcgatctga

SEQ ID NO: 6970 - protein, 1368 aa, Gibberella zeae PH-1
MAPSAVSPTRESNPEPLATLTSKFDDTLRFYLNGTKVVLDEIDPEVTVLEYLRGIGLTGTKLGCGEGGCGACTIVVSQYNPTTKQIYHASVNACLAPLVSLDGKHVVTVEGIGNSQKPHPTQERIAKSNGSQCGFCTPGIVMSLYALLRNNDSPSKDDIEEAFDGNLCRCTGYRSILDAAQTFSVDKPGSKFKKAGGSGCCMENGNGPPSGGCCMDKANLDDTPIKRFTPPGFIEYQPDTELIFPPALKRHELRPLAFGNKRRRWYRPVTTEQLLQIKSAHPQAKIIGGSTETQIETKFKALEYPVSVYVGDIAELRQYSFKDDHLEVGGNVVLTDLESICEHAIPHYGRERAQVFEAMLKQLKFFAGRQIRNVGTPAGNLVTASPISDLNPVLWAANAVLVAKSSTKEIEIPVSQFFTGYRKTALAQDAIIASIRIPVAQGKGEFFRAYKQAKRKDDDIAIVTGALRVRLDDEGIVQEANLIYGGMAAMTVAAKTAGEYLVGRRFADLETLEGTMSALGRDFDLQFSVPGGMASYRKSLAFGFFYRFYHDVLTITDGSSEQVDKEAIDEIERDISNGEVDHHAAAAYEKEVTGKSNPHLAALKQTTGEAQYTDDMPALKNELHACYVLSKRAHAKLLSVDYSAALDIPGVVDVVDKDDMPSPEANKFGAPHFDEVFFAEGEVLTVGQPIALVLATSPQRAQEAARAVKVEYEDLPSVLSIEDAIAADSYHNFYREIKKGDAEKAFQECDHVFTGTVRMGGQEHFYLETNACLVVPKPEDGEIEIFASTQNANETQVFASRVCDVQSNKVVVRVKRLGGGFGGKESRSVVLSSALALAAKKTKRPVRYMLTREEDMVISGQRHPFLGRYKVGVNKDGKLQALDCDVFNNAGWTFDLSAAVCERAMTHIDGCYDIPNVHIRGRLCKTNTMSNTAFRGFGGPQGMFIAESYMEEVADRLGMPVETLRQINLYESDGVTHIGQGLGDWHVPLMYKQVQDEAMYTARRHFITQFNETNKWRKRGLALIPTKFGISFTALFLNQAGALVHIYHDGSVLVAHGGTEMGQGLYTKLTQIAAQALGVPLDNVFISETSTNTVANASATAASASSDLNGYAIFNACEMLNERLAPYRKKLGPDATMKDLAHAAYFDRVNLSAQGFYKTPEIGYDWTTGKGKMFFYFTQGVAAAEVEVDLLTGTWTCIRADIKMDVGQSINPAIDYGQIQGAFIQGLGLFTMEESLWLRNGPMAGHLFTRGPGAYKIPGFRDIPQTFNVSLLKDVEWKELRTIQRSRGVGEPPFFMGSSVFFAIRDALKAARAQSGVKAKVGENDSEGLLRLESPATPERIRLACEDEIMRKARVVPKEGEKSFFVAI

SEQ ID NO: 6971 - DNA, 4383 bp, Ustilago maydis 521
  CDS (1)..(4383)
atgccagtacccgcaccaacgactacggtcgttgatggcttcaaactgcctagccaattcacccaaaccgcctccaaactcgtcttcaccgtcaacaacatccgcttccagctttccccagccaaaggtgatgatcttgaccttacgctcctcgaattcattagaagcaaaggcttcaccggaaccaaactcggatgcggtgaaggcggctgtggtgcctgtactgtcgttgttggcaagtacgacacccatcttgccacctcgtcatcttcctcgtcctccaaagctccatacagatacaagtcggtcaatgcatgcttgctcccactcgtcgcagtgcatggctgccacgtcctcacagtagaaggcatcggctcgtcgtccaaccctcatccgatccaagagcgcatcggaaagctgtttggctcgcaatgcggtttctgcactcctggtatcgtcatgtcgctctatgctaccgttcgaaacggctatggccaccttaccgaacaagacatcgagcattcactcgatggctgtctctgccgctgcacaggttatcgtcccattcttgatgctgccaagtcctttgctaccgtcaaaagcaccaaaatcggctcgagctcctcctcaagcaacgtctacagcgatgactcggacgacgcagagcctacaacgcctcccgaggccgatctcatcacaagaacaccctgtgccaagggcgccgactgctgcatggtcaacggcaagtccaaaggctgcacacccagcacaacttccactgccccaggcatctccaccaccgcacatgcgattcagaaggtgcttgaccctacccaattcaaaccctacgatgcggcctccgagctcatcttcccttcctacctcgccaaggacacgtttgactcgcaagacctcgtctttatcgagcagcccccacagttggacgatctcgagagcgagagtgagagcgagaccgttgcagcaaaatccgactcgacacgacaggtatggcttcgaccgggctctctccaatcgctcattgactgcatgaagctctacggtctcgatgctggcggaaaaattcgcagtggtaacaccgaaactggtatcgaggtcaagttcaagcatctcaagtacagtgtctcgatctttgtctcggaccacatcaaggaccttgccttctatcgctcggatgagcgtggtatcaccgtcggcgctaatctgagtctgaccgacctcgtccgccagctcaaggccgaacgtccctcctcagcctatgctcagcaggtcaagcgttccatcctcgacaacctcgcctactttgcctcgaaccagatccgaaatgtggcaaccctggcgggtaacattgccacggcgtcacccatctcagatctcaaccctgtctgggtggctaccggtgccgagctcttctatgtcgacactacttcgtctcaagagaagagcgtcaacatgcgcagtttctttctgggctaccgcaagactgctttgcctgcaggcgccgtcatcaccaagctctttgttccttggtccgatgacgctggcagcgtggttcaggccttcaagcagtcgaagcgcaaggatgatgacattgccatcgtcaatgcctgtcttcgagtctctgttcgcgaggacaaaattattgatgcgacactggcatttggcggtatgggcccaactaccatgcagagtgtagaagtgcaaaggtttctgcagggcaggcagtttagcgccccagagaccctagccgaagcattgcagattttggcaaagcaggacttcccactttcgtatggtgtgcctggtggcatgcccattttccgcaagacgcttgcactcggtttcctgacccgcttctggggtcttgcggcgcctcgtctcggtctgccgaagctggcaacggctctcgagttgctgccggacctcgaggagcttgcgaccagcactgtagaacgacctaccactactggacagcaagatctcgagaacgtcgccatcaaacagcctgtcggcgactcgattccacatctctcggccatgaagcaggtgacgggtgaagccgtctacattgacgatctgcctcccgtcgccaacgagcttcatgccggctttgtcctgtctcagcgtgcccatgccgtactgaagaaggttgatgcgagcgaggcgcttcagatgcccggtgtcgtcgactttatcacctacaaggacattcccgaaggtggtagcaacatctggaacccgccgtccatggatgagacgttctttgccgaagataaagtctacactgtgggtcagattatcggtctcattgtcgccgataccaaacgccatgcccaagctgcagcacacaaggtcaagatcgagtaccaagacttgccgcacatcttgacgatcgaagaggcgattgcggccggaagcttcttcaagcctcgtcccgtcatccatcacggagactcttcggaagaaagctggtcgcagtacgatcatgtactcgaaggcgagacacgtatgggaggccaagagcatttctacctcgagacgaacgcatgtctggtgattccaggcaaagaagattccgagatcgaggtgatttcttcgacgcagaacccctcggagacgcaaatcttttgcgcctcgattctgggtatcccgaacaaccgtgtggtgacgcgtgtcaagcgaatgggtggaggctttggtggaaaggaatcgcgtacgatcgcatttgcagcaccgctcacgttggcagccaagaaactcggacgtcccgtgcgtgttatgctggaccgtgacgaagacatgctcaccaccggtcagcgacatcctttcctgtgcaagtggaaactcggcttcaactcttccggaaagctcgagcgtctggacgccaaggtgtacaacaatggtggctggagtcaagacctttcgcaggcagtgctcgagcgtgccatgttccacatcgacaactgctacaacatccctcatatccacgtcgagggattcatctgcaagaccaacaccatgtccaatacggcgtttagaggatttggtggtcctcaaggcatgtttttcaccgaagactttgtcagcaaagcggcagcggtgattgggatgcgacccgagacaatgcgcgaaatgaatctgtacaaggagaacgacaagacgcacttccggcaaaagctgatcgattggaacgtgcccacgctttgggaacagttgaaatcgtctggtgacttggaggcgaggagtagagcggtggacgagttcaactcgacgcaccgatacaagaagagaggtattgctatgatcccgaccaagttcggtatttcattcaccgcgattttcctgaatcaggcgtacggtgtggtgcacgtgtatcatcacgatggcagtgtcctcttttctcacggtggaaccgagatgggtcaaggcttgcatactaagatggcgcaggtggtggctacggagctcgagattcccgtctcaatggtacatctgaccgagaccaacacgtcacaggcgtccaacacgtcggctaccgctgcatcggcttcgtctgatctcaacggaatggcgctcaaggatgcgtgtgtgcagattaacgagtccatcgctccattccgcgcggatgctgctgccaaaggcttggcaggcgtggaggcgtggaaggatgctattcacgccgcctactttaatcgcgtacagctgtctgcgattggtcattaccgcacaccgggaatcgggtacaattggaccaacggcacaggtacgccgttctactactttactcagggcgtggcgatctcggaggtggaattggacacgatcacgggcgatcaccgtatcgtgcgtgcggacgtccacatggatattggtcgatcgatcaacccttcgatcgacgtgggtcagatcgaaggggctttcacgcaaggatttggtctcttcacaatggaggaaacgctgtatttgaacaacggacagcttgcgacgcgtgggccgggtaactacaagatcccggcgttcctggatacgcctacggacatgcgcgtgtcgttcctcaaggtccaagatgcgaatgacgccaaggtggccaagcataataagcacctaggtacaattcagagtagtaagggcatcggcgaaccaccgttgttcttgggcagctcggtgttctttgcgctgcgtcatgcgattggagcggctagagcgcagtatggtggagatggaagcaaggatggtttccatctggtggcacccgcgacggctgagaggatcagggttgcgatcaacgatcctcttgtcaggttggcgcacgagtctacgccgaggacggatgcggaaaagccgttcttcgtcagcatttcatag

SEQ ID NO: 6972 - protein, 1460 aa, Ustilago maydis 521
MPVPAPTTTVVDGFKLPSQFTQTASKLVFTVNNIRFQLSPAKGDDLDLTLLEFIRSKGFTGTKLGCGEGGCGACTVVVGKYDTHLATSSSSSSSKAPYRYKSVNACLLPLVAVHGCHVLTVEGIGSSSNPHPIQERIGKLFGSQCGFCTPGIVMSLYATVRNGYGHLTEQDIEHSLDGCLCRCTGYRPILDAAKSFATVKSTKIGSSSSSSNVYSDDSDDAEPTTPPEADLITRTPCAKGADCCMVNGKSKGCTPSTTSTAPGISTTAHAIQKVLDPTQFKPYDAASELIFPSYLAKDTFDSQDLVFIEQPPQLDDLESESESETVAAKSDSTRQVWLRPGSLQSLIDCMKLYGLDAGGKIRSGNTETGIEVKFKHLKYSVSIFVSDHIKDLAFYRSDERGITVGANLSLTDLVRQLKAERPSSAYAQQVKRSILDNLAYFASNQIRNVATLAGNIATASPISDLNPVWVATGAELFYVDTTSSQEKSVNMRSFFLGYRKTALPAGAVITKLFVPWSDDAGSVVQAFKQSKRKDDDIAIVNACLRVSVREDKIIDATLAFGGMGPTTMQSVEVQRFLQGRQFSAPETLAEALQILAKQDFPLSYGVPGGMPIFRKTLALGFLTRFWGLAAPRLGLPKLATALELLPDLEELATSTVERPTTTGQQDLENVAIKQPVGDSIPHLSAMKQVTGEAVYIDDLPPVANELHAGFVLSQRAHAVLKKVDASEALQMPGVVDFITYKDIPEGGSNIWNPPSMDETFFAEDKVYTVGQIIGLIVADTKRHAQAAAHKVKIEYQDLPHILTIEEAIAAGSFFKPRPVIHHGDSSEESWSQYDHVLEGETRMGGQEHFYLETNACLVIPGKEDSEIEVISSTQNPSETQIFCASILGIPNNRVVTRVKRMGGGFGGKESRTIAFAAPLTLAAKKLGRPVRVMLDRDEDMLTTGQRHPFLCKWKLGFNSSGKLERLDAKVYNNGGWSQDLSQAVLERAMFHIDNCYNIPHIHVEGFICKTNTMSNTAFRGFGGPQGMFFTEDFVSKAAAVIGMRPETMREMNLYKENDKTHFRQKLIDWNVPTLWEQLKSSGDLEARSRAVDEFNSTHRYKKRGIAMIPTKFGISFTAIFLNQAYGVVHVYHHDGSVLFSHGGTEMGQGLHTKMAQVVATELEIPVSMVHLTETNTSQASNTSATAASASSDLNGMALKDACVQINESIAPFRADAAAKGLAGVEAWKDAIHAAYFNRVQLSAIGHYRTPGIGYNWTNGTGTPFYYFTQGVAISEVELDTITGDHRIVRADVHMDIGRSINPSIDVGQIEGAFTQGFGLFTMEETLYLNNGQLATRGPGNYKIPAFLDTPTDMRVSFLKVQDANDAKVAKHNKHLGTIQSSKGIGEPPLFLGSSVFFALRHAIGAARAQYGGDGSKDGFHLVAPATAERIRVAINDPLVRLAHESTPRTDAEKPFFVSIS

SEQ ID NO: 6973 - DNA, 2715 bp, Bradyrhizobium sp. ORS278
  CDS (1)..(2715): transl_table=11
atgagcgtgatcgtcgatggcaaggcggtcgatgccgcgccccgcccggggcagtgcctgcgcacgttcctgcgcgacaccggccatttcggcgtcaagaagggctgcgacgccggcgattgcggcgcctgcaccgtgctgctcgacggcgagccggtgcacagctgcctgatcccggcgttccgcgccgacggcaaggcggtcacgaccatcgaaggcctcgcgagtgacgacggcctgcaccccatgcagcaggcgtttctcgacgcgcaggcgtttcaatgcggcttctgcaccgccggcatgatcgtcacctgcgcctcgctgaaccaggcgcagaagaaggatctcggcgcggcgctcaagggcaatctgtgccgctgcaccggctatcgcgcgatcgaggacgcgctgctcggccgttctcatgtcgaggacgtggcggccggcgaagccttcggccgcagcctgccagcacccgcgggccccgaattggtgcgcggccaggcgcgctacacgttcgatacggcgatcgagggcctgcttcatgtcaagctcgtccgctcgccgcatgcccatgcgcgcatcaggagcatcgacaagacggcggcgctcgccgtgcccggcgtgcatgcggtgctgacgcatgaggacgcgccggccgtgctgttctcgaccgcgcgccacgagcaggcctggatggatccggccgacatccgcgtgctcgacgacaccgtccgcttcatcggccagaaggtcgccgctgtcgtcgccgagagcgaagccgcggccgaggaagcctgccggagcctcgtcgtcgactacgagatcctgcctgccgtggtcgatccggccgaggcgatcgccgaaggcgcgccggtcattcatgccggccgcggcagcgagcatcgcatcgccaacgtcagccgcaacatcgtcgccgagacccatggcgagttcggcgacgtcgccgccgccctcgccaccgccgccgtgacctatgaaggcacgttcacgacgcagcgcgttcagcacgcggcgctcgagacgcatggcggcctcgcctggctggatgatgacggcgtgctcacggtccgctcgagcacgcaggtgccgttcctgacgcggcgcgcgctcgccgagatcttcgacctcgcgtccgacaaggtgcgcgtgttctgcgagcgcgtcggcggcggcttcggcggcaagcaggagatgttcgtcgaggacatcctggcgctcgcggcgctgaagacgaagcggccggtgaagctcgaattcacccgcgaggagcagttcatcgccacctcgacgcggcatccgatgcgcgtcaccgtcaaggccggcgccgacaaggacggcagactgacggcgctgcagctcgacgtgctctccaacaccggcgcctatggcaaccacgccggtcccgtgctgttccatgcctgcggcgagtcgatctcggtctacaattgcccgaacaagaaggtcgacgcggtcgcagcctacaccaacacggtgcccgcgggcgccttccgcggctacggcctgccgcagaccaccttcgccgtggaggcggcgatcgacgagctcgcgagccagctcggcatcgatccgttcgagatacgccgccgcaacatcgtcaggcccggcgatccgatgctggcgccgccgggcgcggagcacagcgacgtgctgtacggctcctacgggcttgaccagtgcctcgatcttgtcgagcgcgcgatggccgagccgacgccgacgccggatctgccggccgaatggcgcaccggcgacggcatcgcgctgacgatgatcgacaccgtgccgcccgacggccatttcgccgatgcgaccatcaccttgcgcgacgatggcggcttcacgctgacggtcggcaccgccgagttcggcaacggcaccagcaccgtccacctccagatcgccgcgaccgtgctggggaccaccgtcgaccgcatcaccctcaaacagtccgacaccgcgcatggcggacacgacaccggcgcctacggctcgaccggcaccttcgtcgccggccgcgcgactcaggccgcggccgaggcgctctccgataggctcaagcgctttgcggcagatcgctggaacgtggatgcaggcgcgtgccggatcgccgatgatgcgatcagttgcggcgcgcagcggctctccttcgccagcatcgccagcgtcagcgcagcaccgctgacggcgaccggcagctcgcagggcacaccgcgctcggtcgcgttcaacgtgcagggctttcgcgtcgccgtgaacacgcacaccggcgtggtcaggatcctcaagagcgtgcaggccgcggatgccggccgcgtcgccaatccgatgcagtgccgtggccagatcgaaggcggcgtcgcgcaatcgctcggcgccgcgctgtacgaggaggtcgtgatcgacgaggacggccgggtgatcaatccgcgcttccgcgactatcatctgccgtcctatgccgacgtgccgcgcaccgaggttctgttcgcggagaccaccgacgccatcggcccgctgggggcgaagtcgatgagcgagagcccctataatccggtggccgccgcgcttggcaatgcactgcgcgccgcgaccggcatccgcttcacggcggtgccgttcaagccggaccggctgtttccacagctgcaggagaggttcggggcgtga

SEQ ID NO: 6974 - protein, 904 aa, Bradyrhizobium sp. ORS278
MSVIVDGKAVDAAPRPGQCLRTFLRDTGHFGVKKGCDAGDCGACTVLLDGEPVHSCLIPAFRADGKAVTTIEGLASDDGLHPMQQAFLDAQAFQCGFCTAGMIVTCASLNQAQKKDLGAALKGNLCRCTGYRAIEDALLGRSHVEDVAAGEAFGRSLPAPAGPELVRGQARYTFDTAIEGLLHVKLVRSPHAHARIRSIDKTAALAVPGVHAVLTHEDAPAVLFSTARHEQAWMDPADIRVLDDTVRFIGQKVAAVVAESEAAAEEACRSLVVDYEILPAVVDPAEAIAEGAPVIHAGRGSEHRIANVSRNIVAETHGEFGDVAAALATAAVTYEGTFTTQRVQHAALETHGGLAWLDDDGVLTVRSSTQVPFLTRRALAEIFDLASDKVRVFCERVGGGFGGKQEMFVEDILALAALKTKRPVKLEFTREEQFIATSTRHPMRVTVKAGADKDGRLTALQLDVLSNTGAYGNHAGPVLFHACGESISVYNCPNKKVDAVAAYTNTVPAGAFRGYGLPQTTFAVEAAIDELASQLGIDPFEIRRRNIVRPGDPMLAPPGAEHSDVLYGSYGLDQCLDLVERAMAEPTPTPDLPAEWRTGDGIALTMIDTVPPDGHFADATITLRDDGGFTLTVGTAEFGNGTSTVHLQIAATVLGTTVDRITLKQSDTAHGGHDTGAYGSTGTFVAGRATQAAAEALSDRLKRFAADRWNVDAGACRIADDAISCGAQRLSFASIASVSAAPLTATGSSQGTPRSVAFNVQGFRVAVNTHTGVVRILKSVQAADAGRVANPMQCRGQIEGGVAQSLGAALYEEVVIDEDGRVINPRFRDYHLPSYADVPRTEVLFAETTDAIGPLGAKSMSESPYNPVAAALGNALRAATGIRFTAVPFKPDRLFPQLQERFGA

SEQ ID NO: 6975 - DNA, 2751 bp, Kineococcus radiotolerans SRS30216
  CDS (1)..(2751): transl_table=11
gtgaagctcaccgtggacggggtggccgccgaggtggagccgcggccggggcagtgcctgcggaccctgctgcgcgagaacgccgggacgacggtgaagaagggctgcgacaccggggactgcggggcctgcacggtgctcgtggacggttccccggtgcactcgtgcctgtaccccgcgctgcgcgcgggcgaccgggaggtcaccaccgccgcgggcctggccccggcggggagcctgcacccggtgcagcagcgcttcgtggacgcggccgggttccagtgcgggttctgcacgccggggatggtcgtcaccgccgcggcgctggacgaggagcagcgcgccgacctcgacgagcacctcaagggcaacctgtgccgctgcaccgggtaccgcgcggtccgcgaggcggcgggcggacagaccctgcccgcgctcgcccgcagcggggggatcggcgaggccgtcgcggcgccggccgcgcaccgcgtcgtcaccggcaccgagccgtacaccctcgacctcgccgagggcgacgttccggcggggttgctgcacgccgcggtcctgcgcagcccgcacgcgcacgcccgcgtcaccgccatcgacacccgcgccgccgccgcgctgcccggcgtgcacctcgtgctgacccaccacgacgcaccgccggtgctgttctccaccggtcgccaccagaaccgcctcgacgaccccgacgacaccctcgtcctcgaccccgtcctgcgccaccacggccagcgggtcgcggtggccgtcgccgagtcagtggcgctcgccgaggaggcgctggggctgatcgccgtggagtacgaggtgctgcccgccgtcctggacccgcaccgggccaccgctcccggtgcgccgctgctgcacgccgacaaggacgccgacagccgcatcgcggaccccgcgcgcaacctggtcgccgagctgcacagcgaggtcggcgacgtcgaggaggccctggcctccgcccacgccgtcgtcgaggggacctggcgcacccagcgcgtcgcccacgtcgcgctggagacccacgccgcggtcggctggctggacgaggagggacggctggtggtgcgcagcagcacccaggtgccgttcctcgtgcgcgacgagctcgcccgggtcctcggcctggaccgcgcgcgggtgcgggtgctggccgcccgcgtcggcgggggtttcggcggcaagcaggagatgctcaccgaggacctcgtcgccctcgcggtgctgcgcaccggccggcccgtgcagtacgagacgacccgccgcgaggcgctcacggcgttgccgacgcggcacccgatggacgtgcgggtgcgtctgggcgccacggcggacggcaccctgacggcgctggcggtggacctgctctccgacgccggcgcctacggcaaccactccccgggggtgatgttccactccgtgcacgagtcggtggcgacgtaccggtgcgcgaacaagcgcgtcgacgcccgcgcggtctacacgaactccgtcccctccggcgccttccgggggtacggcctgggccaggtcgtcttcgccctcgaatcggcgctggacgacctggcccgcgaactcgggatcgacccgttcacggtgcgccgcaggaacgtcgtcgtccccggcgaccggttcgtcgccacctccgaccccgccgtcaccggcgaggacgacggtctgcgcttcggcagctacggcctggaccagtgcctggacctggtggagcgggaactcccgcgcggcggtgaccccgtccccgacgggcccggctggcgcaccgggtccgggatcgcgctgtcgatgatcgccaccgtgcccccgcgcgggcacttcgcggaggcctccgcccgcctgctggccgacgggacgtgggagctgaacgtcggaaccgcggagttcggcaacggcacgacgaccgtccacacccagatcggcgtgcacgccctgagcaccaccgccgaccggctgcggttgcggcaggccgacaccgacgtcaccggccacgacaccggggcgttcggctcggccggttccgtcgtcgccggcaaggcgctgctcatcgcctgcgagcgcctcgcggggcaggtgcgggcgctgggcgccgacctgctcggcgcggacccggcgacggtcgtgttggaaccggagggggtgcggtgcgggccgcgctccgtcccgctgagcgacgtccacgcccacgcggtgcgcaccgcgggcgccgcgccgcgggccgacggggccgacgacgccgcactgcgttccgtcgcgttcaacgtccagggtttccgcgtcgccgtggacaccagcaccggcgaggtgcggatcctgcggtcggtgcacgccgtcgacgcgggggtcgtcctcaaccccgtgcagttgcgcgggcaggtcgagggcggggtcgcgcaggccatcgggtcggccctgttcgaggaggtgcaccgcgccgacgacggcagccccctcacggtgtcgttgcgggagtaccacgccccgcgggccgccgacctggggacgacggaggttctgttcgccgacaccgtcgacgcggtgggcccgctgggggcgaagtcgatgagcgaagcgccctacaaccccgtcgctcccgctctggccaacgcggtgcgcgacgccgtcggggtgcggctgcggaggttgccgatgcgcccggaccgcgtctggcgcgcgctggccgaggcggccgaccgtgcgtga

SEQ ID NO: 6976 - protein, 916 aa, Kineococcus radiotolerans SRS30216
MKLTVDGVAAEVEPRPGQCLRTLLRENAGTTVKKGCDTGDCGACTVLVDGSPVHSCLYPALRAGDREVTTAAGLAPAGSLHPVQQRFVDAAGFQCGFCTPGMVVTAAALDEEQRADLDEHLKGNLCRCTGYRAVREAAGGQTLPALARSGGIGEAVAAPAAHRVVTGTEPYTLDLAEGDVPAGLLHAAVLRSPHAHARVTAIDTRAAAALPGVHLVLTHHDAPPVLFSTGRHQNRLDDPDDTLVLDPVLRHHGQRVAVAVAESVALAEEALGLIAVEYEVLPAVLDPHRATAPGAPLLHADKDADSRIADPARNLVAELHSEVGDVEEALASAHAVVEGTWRTQRVAHVALETHAAVGWLDEEGRLVVRSSTQVPFLVRDELARVLGLDRARVRVLAARVGGGFGGKQEMLTEDLVALAVLRTGRPVQYETTRREALTALPTRHPMDVRVRLGATADGTLTALAVDLLSDAGAYGNHSPGVMFHSVHESVATYRCANKRVDARAVYTNSVPSGAFRGYGLGQVVFALESALDDLARELGIDPFTVRRRNVVVPGDRFVATSDPAVTGEDDGLRFGSYGLDQCLDLVERELPRGGDPVPDGPGWRTGSGIALSMIATVPPRGHFAEASARLLADGTWELNVGTAEFGNGTTTVHTQIGVHALSTTADRLRLRQADTDVTGHDTGAFGSAGSVVAGKALLIACERLAGQVRALGADLLGADPATVVLEPEGVRCGPRSVPLSDVHAHAVRTAGAAPRADGADDAALRSVAFNVQGFRVAVDTSTGEVRILRSVHAVDAGVVLNPVQLRGQVEGGVAQAIGSALFEEVHRADDGSPLTVSLREYHAPRAADLGTTEVLFADTVDAVGPLGAKSMSEAPYNPVAPALANAVRDAVGVRLRRLPMRPDRVWRALAEAADRA

SEQ ID NO: 6977 - DNA, 2736 bp, Xanthobacter autotrophicus Py2
  CDS (1)..(2736): transl_table=11
gtgacctacagcatcgacgggcggaccgtttccgccgagccgcgtcccggccagtgcctgcgcaccttcctgcgcgagagcggcgcgctgggggttaagaagggctgcgacgcgggggattgcggcgcctgcaccgtgtggctcgacgggcgagcggtgcattcctgcctcatgcccgccttccgggccaaggggcatcaggtcaccaccgtgcagggcctcgcctccggcaatgctctgcatccggtgcagcaggcgtttctggaggcgcaggcgttccagtgcggcttctgcgccgccggcatgatcatgacggtggccgccctcgatgaggaccagcgggccgacctgccgcgcgcgctgaagggcaacctctgccgctgcaccggctatcgctccatcgcggatgcggtccacggcgtcggcgccatcgagcaggacgtggcgggggcggcctgcggcgccagcctgcccaatccgttcagcgccggcatcgtcaccggtcatgcgcgctacaccatggatgtggacacagccgacccggcgctccacggcctgctgcatctcaaggtgctgcgctcgccccatgcccatgcgcgcatcctgcgcatcgacacggcgaaggcgctcgccatccccggcgtggtggcggtgttcacccatgaggacgtgccgaagaagctcttcagcaccgccacccacgaggaccatctggtcgatcccgacgacaccctcatcctcgacgatgtggcccgcttcgtcggccagcgcatcgccgccgtggtggcggacaccgagggagccgccgaggccggctgccgggcgctggaggtggattacgagatccttcccgccgtgttcgatccgctccaagccatggcgccggacgcgccgctgctgcatcccggcaatgacgggctcgccggtggcgcgcggggcaatgtcttcctctgcctcaagggcgaggtgggcagcgtcgccgagggcttcgcggccgccgccgtggtccatgatgagacctattccacctcccgcgtgcagcatgcgcatctggaaacccacggctccatcgcctggcgggacggcgacgggcgcatccatgtgcgcacctccacccaggcgccgttcatcacccacaagaagctctgctatctcttcggcatcttcccccacgacctgcatgtgttcaccgagcgggtgggcggcggcttcggcggcaagcaggagatgctgtcggaagacctgtgcgtgctggcgacgctgaagctcggccggccggtgaagtgggaattcacccggccggaggaattcctcggcgccaccacccgccaccagatgaccacgcgggtgaagatgggcgccacggcagacggcatgctgacggcgctggaggtgcatgtggtgtccaacaccggcgcctatggcggccatggcggggagacgctggcggcggcgctggggagcccgctcgccgcctatcgctgcccggccaagaaggccgagggccacgcggtctataccaatgtcatccccggcggcggctttcgcggttatggcgcctcgcagacctcgttcgccatcgaatcggcgctggatgacctcgccgccaagctcggcatcgaccccttcgccatccgccgcaggaacatgatccggccggacgatgtgatccagtcggtgtgggccgagccgagcgacgtggcctttggcagctacggcctcgaccagtgcctcgacctcgtggaggcggaactcgccagcggcaagggcgatcaggcacccgaaggcgactgggccgagggcaccggcgtggcgctggccgtgctggaggccggcccgcccaccgagcatcgctccggcggcgagatgcggctcctggcggacggcacctatcacctcgccgtgggctccaccgagatgggcaacggctcggtcaccgcccatcgccagatcgcggcagcggtgctgggcacgcgagcggaggccatcgccatcatcaatgcggataccgaccgcgcgccctacgacaccggcaccttcgccagcaccggcacggtggtggccgggcaggcggtggagctgacggcgcgggcgctggcggccgagatcctctcctacgcggcgcggcgcaccaatacggcgccggaggactggcggctgaccgccgacgcggtggaaagcgcaacccagcgcatttcgctcgccgaactctgccggctcgctgccgccgagggccatcacctggaggccaagcgcaaggcctatctctcgccgcgtaccatcggcttcaacgtgcagggggtgcggcttgccgtgcaccgggtgacgggggaggtccgcgtcctccacagcgtgcatgcggcggacatcggccgcctcatcaacccgctgcaatgccggggtcagatcgagggcgcggtggccatggggctgggctgggcgctcaccgagcatatggtgcacgacgctcagggcaacatcctgaacgcggcgctgcgcaactatcacatccccgccttcgccgacatgccgcgcaccacggtgctgttcgccgacacccacgacagcatcggtccgctgggcgccaaggcgcagggcgaatgcgccatcaacgcggtggcgccggcggtggccaacgcgctcgccaacgccaccggcgtgcgcttcgcccatctgcccttcaccccggaccgcatcttcgaccggctcggccgggcggcgggggcgccctcatga

SEQ ID NO: 6978 - protein, 911 aa, Xanthobacter autotrophicus Py2
MTYSIDGRTVSAEPRPGQCLRTFLRESGALGVKKGCDAGDCGACTVWLDGRAVHSCLMPAFRAKGHQVTTVQGLASGNALHPVQQAFLEAQAFQCGFCAAGMIMTVAALDEDQRADLPRALKGNLCRCTGYRSIADAVHGVGAIEQDVAGAACGASLPNPFSAGIVTGHARYTMDVDTADPALHGLLHLKVLRSPHAHARILRIDTAKALAIPGVVAVFTHEDVPKKLFSTATHEDHLVDPDDTLILDDVARFVGQRIAAVVADTEGAAEAGCRALEVDYEILPAVFDPLQAMAPDAPLLHPGNDGLAGGARGNVFLCLKGEVGSVAEGFAAAAVVHDETYSTSRVQHAHLETHGSIAWRDGDGRIHVRTSTQAPFITHKKLCYLFGIFPHDLHVFTERVGGGFGGKQEMLSEDLCVLATLKLGRPVKWEFTRPEEFLGATTRHQMTTRVKMGATADGMLTALEVHVVSNTGAYGGHGGETLAAALGSPLAAYRCPAKKAEGHAVYTNVIPGGGFRGYGASQTSFAIESALDDLAAKLGIDPFAIRRRNMIRPDDVIQSVWAEPSDVAFGSYGLDQCLDLVEAELASGKGDQAPEGDWAEGTGVALAVLEAGPPTEHRSGGEMRLLADGTYHLAVGSTEMGNGSVTAHRQIAAAVLGTRAEAIAIINADTDRAPYDTGTFASTGTVVAGQAVELTARALAAEILSYAARRTNTAPEDWRLTADAVESATQRISLAELCRLAAAEGHHLEAKRKAYLSPRTIGFNVQGVRLAVHRVTGEVRVLHSVHAADIGRLINPLQCRGQIEGAVAMGLGWALTEHMVHDAQGNILNAALRNYHIPAFADMPRTTVLFADTHDSIGPLGAKAQGECAINAVAPAVANALANATGVRFAHLPFTPDRIFDRLGRAAGAPS

SEQ ID NO: 6979 - DNA, 2721 bp, Desulfovibrio vulgaris subsp. vulgaris str. Hildenborough
  CDS (1)..(2721): transl_table=11
atgatcaaacgcatggtcacgatcaacggagcaccccggatggcaatcacccgccccgacacgacactggcaacctacctgcgcgagagcctgggcctcaccagtgtgaaggtgggctgcgggcaaggtcattgcggcagttgcaacgtcatcgtcgacggcaagctcgtccgctcatgcagctacaagatgagccgtctcaccgagggtgccaccatcaccacgctcgagggcatcggcaccccggacaacctgcatccgcttcaggtggcatggatggcccatggtgcggcgcaatgcggcttctgttcgccggggttcatcgtctcggccaaggctcttatcgacaccaaccccaagcccagccgcgacgatgtccgcgactggttccagaaacaccgtaatgcctgccgctgcaccggttacaaacctctggtggacgccgtcatggacgcagccgccgtcgtgcggggcgaaatgaaggtggacgacctgctgtaccgcatccctgccgatggtcgcatctggggcaccaaatacccccgcccgtccgccctcgccaaggttacgggcacgctcgacttcggggccgaccttggcatcaagatgccggaggagaccttgcgttgcgcgcttgttcaggccgaagcctcccacgcgaagatactcggcatcgacaccagcgaagccgagaagatgcccggtgtcttcaaggtcgtcacgcacaaggacatcaagggcaagaaccgcatcaccggccttatcaccttcccgtccaacaagggcgacgggtgggaccgtcccatcctctgcgatgagaaggtgttccagtacggggacgccatcgccatcgtctgcgccgacaccgaagagcacgccaaggcggcagccgcggcagttaaagtagaccttgaagtactacccgcctacatgagcgcgccagcagccatggccgacgacgccatggaaatccaccccggcacacccaacgtctatttcgagcagcacctcgtcaagggcccggaaacgaagcccatcttcgacaaggcggatgtcgtggtcgaggacgacttctatgtgggccgccagccgcacatgcccatcgaacccgacgtgggcttcgccttcttcaatgaagatggcaagctgtgcatccactccaagtccatcggccttcacctgcatctgtacatgatcgccccaggtctcggcatcgaacccgacaacatcatcatggtgcagaaccccacgggcggcaccttcggctacaagttcagccccaccatggaggcactcgtcggtgctgcggccatggcgaccgggcgaccggtgttcctcaactactcgtggtaccagcaacagacatacacgggcaaacgctcgcccttcttcatcaacctgcgctatgcggccacccgtgagggcaaactgctggccatggaaagcgactggtcggtcgaccacggcccgtattcggaattcggcgacctgctcacgctgcgcggggcgcagttcatcggtgccggctacgacatcccgagcatacgcggtctgggccgcacggtgtgcaccaaccatgcatgggggtcggccttccgcggctatggttccccacagagcgagttcgcctctgaagtgctgatggacgaactcgccgagaagctgggcatcgacccgcttgaactgcgttaccgcaacgtctaccgcgaaggtgccaccactcccaccggacaggtccccgaagtcttgagcctgcccgagttgctggacaccgcccgcccgcgctaccttgccgccaaggagaaggccgcgcgtgaatccacggcggaggtgaaaaagggcgtgggcatctcggtgggcgtatacggctgcggtctcgacgggccggacacggccgagatcgccgtcgaactcaacgaagatggcacggtgaccatcttcgccacgtggcacgaccacggacagggtgcggacatgggtacgctgggtaccgcccacgaagccctgcgccccctcggcatcgcccccgagaacatcaggcttgtcctcaacgatacggcggtctgccccaatgcaggccctgccggaggcagccgttcgcaggtcgttgtcggacgcgccatcaaggcgggttgcgaactccttctgggcgggatgcggaaagccgacggaaccttccgcacctatgccgagatgcgtgatgagaagatagccacccggtacagcggcaagtggtccgccccttgcaccgactgcaacgcagagggtcagggcagccccttcgccgtgtacatgtacggcgtgttccttgccgaggtctcggtggaactggccaccggcaagaccacagtggacaagatgaccctggtggccgacatcggcaagatcgtgaacaggctgactgtcgacgggcagttgtatggcggcatcgcgcagggcatagggctcgccctttcggaggacttcgaggacatcaagaagcactcgaccatgccgggagccgggttcccctacatcaagcagattccggacgagatcgacctcgtctacgtcgaagtgccccgtcccgaaggccccttcggcgcgggcggtgtcggcgaactgccactcacctgcccccatgcggccatcatcaacgccatccacaacgcctgcggggtgagggtgacgcggctgcccgcgctgcccgagaaggtgctcgcaggtctgcagggcaaatga

SEQ ID NO: 6980 - protein, 906 aa, Desulfovibrio vulgaris subsp. vulgaris str. Hildenborough
MIKRMVTINGAPRMAITRPDTTLATYLRESLGLTSVKVGCGQGHCGSCNVIVDGKLVRSCSYKMSRLTEGATITTLEGIGTPDNLHPLQVAWMAHGAAQCGFCSPGFIVSAKALIDTNPKPSRDDVRDWFQKHRNACRCTGYKPLVDAVMDAAAVVRGEMKVDDLLYRIPADGRIWGTKYPRPSALAKVTGTLDFGADLGIKMPEETLRCALVQAEASHAKILGIDTSEAEKMPGVFKVVTHKDIKGKNRITGLITFPSNKGDGWDRPILCDEKVFQYGDAIAIVCADTEEHAKAAAAAVKVDLEVLPAYMSAPAAMADDAMEIHPGTPNVYFEQHLVKGPETKPIFDKADVVVEDDFYVGRQPHMPIEPDVGFAFFNEDGKLCIHSKSIGLHLHLYMIAPGLGIEPDNIIMVQNPTGGTFGYKFSPTMEALVGAAAMATGRPVFLNYSWYQQQTYTGKRSPFFINLRYAATREGKLLAMESDWSVDHGPYSEFGDLLTLRGAQFIGAGYDIPSIRGLGRTVCTNHAWGSAFRGYGSPQSEFASEVLMDELAEKLGIDPLELRYRNVYREGATTPTGQVPEVLSLPELLDTARPRYLAAKEKAARESTAEVKKGVGISVGVYGCGLDGPDTAEIAVELNEDGTVTIFATWHDHGQGADMGTLGTAHEALRPLGIAPENIRLVLNDTAVCPNAGPAGGSRSQVVVGRAIKAGCELLLGGMRKADGTFRTYAEMRDEKIATRYSGKWSAPCTDCNAEGQGSPFAVYMYGVFLAEVSVELATGKTTVDKMTLVADIGKIVNRLTVDGQLYGGIAQGIGLALSEDFEDIKKHSTMPGAGFPYIKQIPDEIDLVYVEVPRPEGPFGAGGVGELPLTCPHAAIINAIHNACGVRVTRLPALPEKVLAGLQGK

SEQ ID NO: 6981 - DNA, 2748 bp, Silicibacter pomeroyi DSS-3
  CDS (1)..(2748): transl_table=11
gtgatggaccgtcccttgtccacgacaacggatttcaccctgaacggcgcgctcacaagcgccagcccgcaaccgggtgagcgcctgtcgcggatgctgcgcgagcgttgcggcgcgcgcgaggtcaaggtgggctgcgacgcgggcgattgcggcgcctgtaccgtgctggtcgacggcgccccggtctgcgcctgcctgacgcccgcgcatcaggtggcaggccgccgggtggacaccctcagggggctgtcgaacgatccggtggcagagcgcctttccgacagtttcctcgcccatggcgcggcgcaatgcggcatctgcacgccgggcatgatggtggccacgaccgctctgctgcgcgaaaccccggagccgaccgagacgcaggtgctggatgcgcttggcggcgtgctgtgccgctgcaccggttatcgcaagatcatccaggcggtgatgcgggcgggcgcgcctctgctcgccgcccctgcgggggacgggcattccggcacggccatcccccggctcgacggcgcgggcaaggtggcggggaccgaggcttatggcgacgatgtcgcccccgccggaacgctggaaatcctgctggtcggcgcgccctacccccgcgcgggtttcacactgggcgatattgagagctggcgcagcgctcacgcgggcgtggtctcggtattgactgccgctgacctaccgggccgcaaccggttcggcgtgatgccggggttcgaggatcagcccgtgtttgccgaaacggaaacccggtttcgcggcgaacccgtcgccgccatcgtcgccccgcccgaggtggccgcgacgctcgacctcgccctcttcccggtgacatggacccggctcgacgcggtggaaaacatcgcggacgcaaccgcccccggcgcgccccagctgcaccccgaccgcgcgggcaatgtcatggtcaccggttttgtcgcctgcggcgatgccgaggcggcgctggccgcaagcggcgtggtggtcgaggcgcgctatgccaccccctttgtcgaacacgcctatatcgagcccgaggcgggctatgcctatctcgacggcgacaaggtggtggtgcatgcctgcacccaggccccggtgctggaccgcgacggcttgcagatggtgctgggccttggccctgatcgcatccgcatcatccccaccggcgtcggcggcggtttcggcgccaagcttgatatgtcggtgcagccctatctggcgattgccgcgctgaagacgggtcagccggtgcggctggcctatagccgggtgcagtcgatgcagatgagcaccaagcgccacccctccgagctgcacctgcgcatcggcgccagcaccgacgggcggctcaaagggttctccctgcaaggccgcttcaacaccggcgcctatgccagctgggggccgaccgtggccaaccgggtaccggtgcacggctccggcccctattttatccgcgattaccgggccgaggcgcagggcgtccacacccattgcccgccctcgggcgcgttccgcggctttggcgtgccgcaggccgccattgcgcaggaaaccctgttcgacgagctggccgagaaactggggctggatccgctggagtttcgcctgatcaacgcgctggcaaccggccagccgaccgtctgcggccaggtctttacccagggcgtcggcatccgggcctgtttgcaggccctgaaacccgactggacccgcgaacgcgccgcggccgaggcgttcaacgccgggaacaccgtcctgaaacacggtgtcggcatcgccgcgggctggtatggctgcggcaacacttcgctgcccaacccctcgaccatcaaatgcggtatccgcgccgacggcacactcgtgctgcatcagggcgcgatggatatcggccagggcgccaataccgtcatcacccagctatttgccaccgcgcttggcatcccgacccaccggattgaactgatcggccccgataccgacctgacgcccgacgcgggcaagacctcggcctcgcgccagacctttgtcaccggcaatgcggcaaggctggcaggggcggcgctgcgcgccgcgatcctgacccgcgtcaatgcggggcccgaggcgaccctgacgctcgaccagggccggatccatgtcaccgacacggaccgcgcccatgtgatcgacctcaccgacctacccgctgacgccgacggctatgtgctgggcgctaccgagacctatgacccgcccaccaagccgctggacaagaacggccagggcgtgccttacgcccagttcggctatgccgcccatctggcggtggtcgagatcgacacgcggctgggcacaatccgcccgctccgcttcaccgccgcccatgacgtgggccatgcggtcaaccccgctctggtcgagggccaggtcgagggcggcatcgcccagggtctcggcatggcactgatggaggaatacatccccggccgcaccgataacctgcatgactacctgatccccaccatcggcgacgtgccgcccatcgagacgctgatcatcgaggacccggacgagcacggcccctatggcgccaagggcctgggcgaacacgccctgatccccaccgcgcctgcgctcctcaacgcgatacgccacgccaccggcgttgccatccgccagaccccggtcacccccgcccgcctgcgcgccgcgctgaaggaggccggacatgactga

SEQ ID NO: 6982 - protein, 915 aa, Silicibacter pomeroyi DSS-3
MMDRPLSTTTDFTLNGALTSASPQPGERLSRMLRERCGAREVKVGCDAGDCGACTVLVDGAPVCACLTPAHQVAGRRVDTLRGLSNDPVAERLSDSFLAHGAAQCGICTPGMMVATTALLRETPEPTETQVLDALGGVLCRCTGYRKIIQAVMRAGAPLLAAPAGDGHSGTAIPRLDGAGKVAGTEAYGDDVAPAGTLEILLVGAPYPRAGFTLGDIESWRSAHAGVVSVLTAADLPGRNRFGVMPGFEDQPVFAETETRFRGEPVAAIVAPPEVAATLDLALFPVTWTRLDAVENIADATAPGAPQLHPDRAGNVMVTGFVACGDAEAALAASGVVVEARYATPFVEHAYIEPEAGYAYLDGDKVVVHACTQAPVLDRDGLQMVLGLGPDRIRIIPTGVGGGFGAKLDMSVQPYLAIAALKTGQPVRLAYSRVQSMQMSTKRHPSELHLRIGASTDGRLKGFSLQGRFNTGAYASWGPTVANRVPVHGSGPYFIRDYRAEAQGVHTHCPPSGAFRGFGVPQAAIAQETLFDELAEKLGLDPLEFRLINALATGQPTVCGQVFTQGVGIRACLQALKPDWTRERAAAEAFNAGNTVLKHGVGIAAGWYGCGNTSLPNPSTIKCGIRADGTLVLHQGAMDIGQGANTVITQLFATALGIPTHRIELIGPDTDLTPDAGKTSASRQTFVTGNAARLAGAALRAAILTRVNAGPEATLTLDQGRIHVTDTDRAHVIDLTDLPADADGYVLGATETYDPPTKPLDKNGQGVPYAQFGYAAHLAVVEIDTRLGTIRPLRFTAAHDVGHAVNPALVEGQVEGGIAQGLGMALMEEYIPGRTDNLHDYLIPTIGDVPPIETLIIEDPDEHGPYGAKGLGEHALIPTAPALLNAIRHATGVAIRQTPVTPARLRAALKEAGHD

SEQ ID NO: 6983 - DNA, 2724 bp, Desulfovibrio desulfuricans G20
  CDS (1)..(2724): transl_table=11
atgatcaaacgttcgctcatgatcaacggagcgccccggatggccattgccaagccggacacaacgcttgcaacgtacctgcgcgaaagcctggggcttaccagtgtcaagatcggttgcggaaccggtcagtgcggcagctgcagcgtcattgtcgacggcaaggttgtccgctcgtgcagctacaagatgagccgccttgccgacggcgcggtcatcaccacgctggaaggcataggcactcccgaccacctgcaccccctgcaggtggcatggctggcccacggcgccgcacagtgcggtttctgctcgccgggattcatcgtttccgccaaggctctgcttgatcagaacacctcgcccacccgcgaggatgtacgcgactggttccagaaacatcgcaacgcctgccgctgcaccggatacaagccgctggtggacgccgtgatggatgccgcagctgtgctgcgcggcgacatgaaagtcaacgagctgctgttcaaaattcccgaagacggacgcatctggggcaccaaatacccccgtccttccggcattgccaaggttaccggcacgctggactacggcgccgatctgggcataaaaatgcccgaaggcaccctgcgctgcgctctggtgcaggccgaagtctcgcacgcacgcattctcggcatcgacacctccgaagcggaaaccatgcccggcgtcgccaaggttgtgacccacaaagacatcaagggcaaaaaccgcatcaccggtctcatcacctttcccaccaacaaaggtgacggctgggaccgccccatcctctgcgatgacaaggtataccagtacggcgacgcgatagccatcgtatgcgccgacaccgaagaacacgccaaggctgctgccgccaaggtcaaggtggatctggaagtcctgcccgcctacatgagcgctccggaagccatggccgaagacgccatggaaattcatcccggcacccccaacgtgtactttgaacagaaaatcgccaagggcgaggaaacagcatcctactttgaaaaagccgatgtggtggccgaaggcgacttctatgtgggccgtcagccccatatgcccatcgagcccgacgtgggttttgccttcttcaacgaagacggcaagctgtgcatccattccaagtccatcggcctgcacctgcacctgtatatgatcgctcccggtctgggcattgaacccgaaaacgtcatcatggtgcagaaccccgcaggcggcaccttcggctacaagttcagccccaccatggaagcgctggtcggcgcggcatgcatggccaccggcaagcccgtataccttaactacacatggtaccagcaacagacctacaccggcaaacgctcgcctttcttcatgaatgtgcgttttgctgccgacaagcagggcaagctgcttgccatggaaagcgactggtcggtggaccacggtccctattccgaattcggcgacctgctgaccctgcgcggcgcacagttcatcggtgccggctacgacattcccaacatccgcggcgaaggccgcaccgtctgcaccaaccacgcatggggttcggcattccgcggctacggttcgccccagagtgagttcgcctctgaagtgcttatggacatgctggccgaaaaactgggcatggatccgctggaactgcgctacaaaaacgcataccgccccggagccaccacgcccaccggccagaatcccgaagtattcagcctgcccgacatgcttgacaccgcgcggcccaagtacaaggccgcactggaaaaagcagccaaaaacagcaccgccgaagtaaaacgcggtgtgggtatatcgctgggcgtttacggctgcggtcttgacggccccgacaccgccgaagtcgatgcagaactgcatcccgacggcaccgtcagcatctacaccacatggcacgaccacggacagggtgccgacatcggcgcgctgaccaccgcccacgaggcgctgcgcccgctgggcatcgctcctgaaaacatcaagctggtgctcaacgataccgaattctgccccaacggcggccccgcaggcggcagccgctcgcaggttgtggtgggacgcggcataaaagcggcatgtgagctgctgctcggcggcatgcgcaagagcgacggcacctaccgcacctatcaggaaatggtcgatgaaaagatagccaccaagtacaacggtaaatggacagccccctgcaccgactgcgacaccaacggtcagggcaacccctttgccgtgtacatgtacggcatcttcatggccgaagtggccgtggaagtggccaccggcaagaccaccgtggaaaaaatgaccatgatcgccgacgtgggcaaaatcgtgaacaagctggccgtggacggacagatgtacggcggtgttgctcaggccatcggtctggccctcactgaagacttcgaagacatcaaaaagcactccaccatgaagggtgcgggcttcccctacatcaagcaggtgcccgatgaaatcgaactgatctaccacgaatcggaccggcctgaagggcccttcggcgcagcgggtgtgggcgaactgccgctcacctgcccccatgcagccgtgatcaacgccatatacaacgcatgcggcgtacgcatcacccgactgccggccctgccggaaaaggtgcttgcaggcctgcaggccaaggcatag

SEQ ID NO: 6984 - protein, 907 aa, Desulfovibrio desulfuricans G20
MIKRSLMINGAPRMAIAKPDTTLATYLRESLGLTSVKIGCGTGQCGSCSVIVDGKVVRSCSYKMSRLADGAVITTLEGIGTPDHLHPLQVAWLAHGAAQCGFCSPGFIVSAKALLDQNTSPTREDVRDWFQKHRNACRCTGYKPLVDAVMDAAAVLRGDMKVNELLFKIPEDGRIWGTKYPRPSGIAKVTGTLDYGADLGIKMPEGTLRCALVQAEVSHARILGIDTSEAETMPGVAKVVTHKDIKGKNRITGLITFPTNKGDGWDRPILCDDKVYQYGDAIAIVCADTEEHAKAAAAKVKVDLEVLPAYMSAPEAMAEDAMEIHPGTPNVYFEQKIAKGEETASYFEKADVVAEGDFYVGRQPHMPIEPDVGFAFFNEDGKLCIHSKSIGLHLHLYMIAPGLGIEPENVIMVQNPAGGTFGYKFSPTMEALVGAACMATGKPVYLNYTWYQQQTYTGKRSPFFMNVRFAADKQGKLLAMESDWSVDHGPYSEFGDLLTLRGAQFIGAGYDIPNIRGEGRTVCTNHAWGSAFRGYGSPQSEFASEVLMDMLAEKLGMDPLELRYKNAYRPGATTPTGQNPEVFSLPDMLDTARPKYKAALEKAAKNSTAEVKRGVGISLGVYGCGLDGPDTAEVDAELHPDGTVSIYTTWHDHGQGADIGALTTAHEALRPLGIAPENIKLVLNDTEFCPNGGPAGGSRSQVVVGRGIKAACELLLGGMRKSDGTYRTYQEMVDEKIATKYNGKWTAPCTDCDTNGQGNPFAVYMYGIFMAEVAVEVATGKTTVEKMTMIADVGKIVNKLAVDGQMYGGVAQAIGLALTEDFEDIKKHSTMKGAGFPYIKQVPDEIELIYHESDRPEGPFGAAGVGELPLTCPHAAVINAIYNACGVRITRLPALPEKVLAGLQAKA

SEQ ID NO: 6985 - DNA, 2712 bp, Rhodococcus sp. RHA1
  CDS (1)..(2712): transl_table=11
atgaagttgacggtcgacggacagtcggtggatgccgacccccggcccggtcagtgcctgcgcaccttcctgcgggaacagcagcggttcgcggtcaagaagggctgcgacgccggcgattgcggcgcctgttccgtactgctcgacggcgtcccggtgcactcgtgtgtggtgccggcgcaccgcgccgagaaccgcgaggtgaccactgcggccggtctcggcagtcccgaccgactccaccccgtgcagcagcagttcgtcgacgcggcgggcttccagtgcgggttctgtacacccgggattgtcgtgaccgcgtccgcgctcgactccggtcaacgcgccgacctgccgcgctcactgaagggaaatctgtgccgctgcaccggctatcgcgccattcgcgacgctgtcggcggcgtgtgcaccaccgaatcggaccgtgccggtgagtcgttcggccggtccattcccgcgcccgccgccgcccgggtggtgtgcggcgccgagccctacacactcgacctggccgtcgagggtctgacgcacatccagatactcggcagcccgcatgcgcacgcccgcatcacccgactcgacacgtccgccgcggagaggctgcccggcgtccacgcggtgctcacccaccgcgacagtcccgacgtcgccttctccacggcccgccacgagttccgcaccgacgaccccgacgacacctacgtgttcgacacgatcctccggttccgggggcaacgggtcgcggccgtcgtggccgactccgtcgacatcgcccggcgtgcagtggaactgatcgacgtggagtacgaagtactggaagcggtcttcgatcccgacctggcacgccgtcccggtgcccccctgctgcacggtgacaagggcgccgattcccggatcgcggacccggcccggaacctggtggcggaagtccacggcgaagtcggcgacctcgctgccgggctcgcggcggcgcgggacacgggtgccgtggtggagggcacgtggcagacgcaacgcgtgcagcacgcgcatctcgaaacccactcggccatcggctggctcgactccgacgggcgtctcaccctccgcagcagcacccaggtgcccttcctcgtccgcgacgaactcgcccacctgttctcgcgcgaccgctcacaggtccgggtgttcaccgcccgcatcgggggcggcttcggcgccaaacaggaaatgctggtcgaggatctcgtcgccctcgccgttctgcgtaccggcagaccggtccagtacgagttcacccgctccgaccagttcacgatcgccccgtgccggcatcccatgcgggtctcggtgaaggtcggcgccgacggcgacggaaagctgacggcgctcgccgtcgacgtgctctcggacgccggtgcgtacggcaatcattcggtgggcgtgatgttccacggctgcagcgaatccgttgccctgtaccggtcgccgaacaagcgggtggacgcccaggccgtctacaccaacaacctgccgtccggggcgttccgcggctacggtctgggccaggtcatcttcgcggtggaatccgcgctcgatcagctggcgacgcagctgggcatcgatccgttcgaactgcgccgccgcaacgtggtcgttccgggtgacgatttcgtcgacgccgaggtggagcacggcgacctcacatacggcagttacggactcgatcaatgcctcgacctggcggaggccgcgctgcgccgcggcaacgacgtgcgcccgccggacggcccgcagtggcgggtcggtgagggcatggcggcgtcgatgatcgcgaccattccgccgcgggggcacttcgcggacgtgtcctgcaccctcgtcgaaggtggccggtacgaactgcgggtgggcaccgcggagttcggcaacggcaccaccaccgtccacgcccagctcgccgcgtccgcgttgggcaccaccgccgaccggatcagcgtgctgcagtccgacaccgacgtcgccgcgcacgacaccggcgcgttcggttcggcaggcacggtggtcgccgggaaggcggtccatcttgcgggaacccggttacgggagcagctgttcgaggttgctcgccgcgtcgcgggtgcgaccgaggacgccgactgcgcgctgacacccgaggccgtcgaggtggctgggcgggtcgtcgaactcgacaagctggtgcccgagggaccgatccgcgccgagggcaggcacgatggcaccccccgctcggtggtgttcaacgtgcacgcgttccgggtggccgtcgacaccgtcaccggggaggtccgcatcctgcagtccatccaggcggcggatgcgggtacggtcctcaacccgcagcagtgccgcgggcaggtcgagggcggcgtcgcgcaggcgatcggcagcgcactgtacgaggagatcctgctcgacggcgccgggacggtgctcaacccgcagctccggaattatcacctcccgcagctcgtggacgtgccggacaccgaggtctacttcgcggacacctacgacgaactgggcccgcacggcgccaagtcgatgagcgagtccccgtacaacccggtggcccctgccctggccaatgcgatcgcggacgccaccggcgcccggctccgtcggatcccgatgacccccgccgccgtctggcgtgcgctcccgcgcccgtga

SEQ ID NO: 6986 - protein, 903 aa, Rhodococcus sp. RHA1
MKLTVDGQSVDADPRPGQCLRTFLREQQRFAVKKGCDAGDCGACSVLLDGVPVHSCVVPAHRAENREVTTAAGLGSPDRLHPVQQQFVDAAGFQCGFCTPGIVVTASALDSGQRADLPRSLKGNLCRCTGYRAIRDAVGGVCTTESDRAGESFGRSIPAPAAARVVCGAEPYTLDLAVEGLTHIQILGSPHAHARITRLDTSAAERLPGVHAVLTHRDSPDVAFSTARHEFRTDDPDDTYVFDTILRFRGQRVAAVVADSVDIARRAVELIDVEYEVLEAVFDPDLARRPGAPLLHGDKGADSRIADPARNLVAEVHGEVGDLAAGLAAARDTGAVVEGTWQTQRVQHAHLETHSAIGWLDSDGRLTLRSSTQVPFLVRDELAHLFSRDRSQVRVFTARIGGGFGAKQEMLVEDLVALAVLRTGRPVQYEFTRSDQFTIAPCRHPMRVSVKVGADGDGKLTALAVDVLSDAGAYGNHSVGVMFHGCSESVALYRSPNKRVDAQAVYTNNLPSGAFRGYGLGQVIFAVESALDQLATQLGIDPFELRRRNVVVPGDDFVDAEVEHGDLTYGSYGLDQCLDLAEAALRRGNDVRPPDGPQWRVGEGMAASMIATIPPRGHFADVSCTLVEGGRYELRVGTAEFGNGTTTVHAQLAASALGTTADRISVLQSDTDVAAHDTGAFGSAGTVVAGKAVHLAGTRLREQLFEVARRVAGATEDADCALTPEAVEVAGRVVELDKLVPEGPIRAEGRHDGTPRSVVFNVHAFRVAVDTVTGEVRILQSIQAADAGTVLNPQQCRGQVEGGVAQAIGSALYEEILLDGAGTVLNPQLRNYHLPQLVDVPDTEVYFADTYDELGPHGAKSMSESPYNPVAPALANAIADATGARLRRIPMTPAAVWRALPRP

SEQ ID NO: 6987 - DNA, 2718 bp, Rhodococcus sp. RHA1
  CDS (1)..(2718): transl_table=11
atgacgtacatcgtgaacggcagggcgttcgacgaggaaccgaatccagggcagtgtctgcgcacgttcgtgcggtcgctcggtcatcacggcgtgaagaaaggttgcgatgcaggcgattgcggagcctgcacggtgtggctcgacggcgatcccgtgcacagttgcatcacgcccgcgttccgcgcggaggggcgggaggtgaccaccatcgagggcctcggttcgccggacgacctgcatccgctgcagcggcagttccgtgacgcccccgggttccagtgcggattctgcaccgcgggcatgatcatgacgtcggcgacgttcaccgacgcccagaaggaagacctgccacgcgcgctgaagggcaatctctgccgctgcaccggctatcgggccatcgaggatgccgtgaacggtgtcgccgcggtggaggtcgccgagccgggccgcgcggtcggggccagcgtcggggcacccgcggccaccgatgtggtgaccggtcgagccgagttcaccatggacaccgagatcgagggcatgctgcacctcaaggtgctgcattctccgcatgcgcacgcccgcatcgtgtcgatcgacacgacggcggcgctcgccgtccccggggtgcaccgtgtgtacacgtgggaggacgtgcctcggaagcggttcacgaccgccatccacaccgatcatctcgtcgaccccgacgacacgtacatcctcgacgacacggtccgcttcgccggtcagcgggtggtagcggtgctggccgacacggtcggcgccgcggaggagggctgccgcgaggtggtcgtcgaatacgacgtgttgcctgcggtgttcgacccggaggaggcgatggccgacggcgcaccgcagttgcacggttcggacgacccgttcgtccgcgatcccgtgcacaacatcctgctcgagctccacggggaggtgggcgacatcgaggcggggttcgccgaggccgacgtgatccacgagggcacctacttcaccccgcgcgtgcagcacgctcatctcgagacgcacgggtcgatcgcctggatggaggacggccgcctgcacgtgcgcacgagttcgcagtcgccgtcgatcgccaaggtcaagttggctcacctgttcgacctgcgccccgaccagctgcgcgtgttctgcaagcgtgtcggtggcgctttcggcggcaagcaggaggtgttctcggaggatctcgtcgcgctcgcgaccctcgacacgggcaggccggtctgcttcgagttcacccgggaggaagaattcacgacggcgtcgccgcggcatccgatgaagctgaccatcacgctcggcgcccggtcggacggcacgctcaccgcgttccaggtgcgcaacgtgtcgaacacgggggcgtacgggaatcacgggggtgagacgttgttcgcggccggtgccgccatctcggcgtaccggtgtctcaacaagaagttcgatgcgtatgccgtctacacgaacagcgtgcccagcggagcgctgcggggctacgggatgacccagcccgctttcgcggtggagtccgcgatgcacgagctggcggtcgccctcgatatcgacccgctcgagttgcggcgccgcaacatcgtccgccccggtgactcactcgtggcgatcgacgacgtccccgacgacgtcgggttcggggaggacggactcgggcagtgcatcgacctcgtcgacgacgcattgcggcggaccgcgaacgggcaggtgctgggcgtcgactggctcgtcggcgagggcaccgcgagttctctgcacgagaccgcgcccccgaccgaacacatctccgaggcgtgggcgacgctcggcgacgattgtgtgtacgaactcgccgtcggcaccgtcgaattcggtgaggggacgtcgactgcgcacgtgcagatcgcggccacccatctcggcaccacacccgcacggatccgtctcgtgcagtccgacaccgaccgtacgggtttcgacacgggagccttcgccagcgccggcctcttcgtcgcgggcaacgccgtgtcgaacgcctccgtcgccctgcgcgaccgcatcctggcgttcgccgccgtgcacaccggagtcgatgtgaccgagtgctcgatggacgacgacggggtgctctgcgggggcacccgagtgccgttgaccgacctcgtcgccgcggcccgtcgccggggcatccggttcaccgaggcgcgcaaggcgtacgggtcgccgcgcagcgtcgtctccaacacccacggtttccgcatcgccgtccaccgggtcacgggcgagatccgaatcctctacagcgttcaggccgcggacgtcggggtcgtcatcaacccggtgcaggtgcgcggccagatcgagggcggcgtcgcccagggaatcggcttcgcgctgaccgagaacttccacgtcgacgacaacggcgtgatgatcaaccccagcctgcgcaactaccgcatccccacctacgccgacattccccgcaccgaagtgctgctggtcgagtcgaatgactccgtcgggccgatgcgggcgaagggaatggcggagtgctgcatcaacccggtggcgcccgcgctggccaacgccctggaaaacgcgaccggtgtgcgttttcgcgagttgccgctcacccccgagcggatctaccaccgaatcggcgagaaccgatcggttccgacgacctga

SEQ ID NO: 6988 - protein, 905 aa, Rhodococcus sp. RHA1
MTYIVNGRAFDEEPNPGQCLRTFVRSLGHHGVKKGCDAGDCGACTVWLDGDPVHSCITPAFRAEGREVTTIEGLGSPDDLHPLQRQFRDAPGFQCGFCTAGMIMTSATFTDAQKEDLPRALKGNLCRCTGYRAIEDAVNGVAAVEVAEPGRAVGASVGAPAATDVVTGRAEFTMDTEIEGMLHLKVLHSPHAHARIVSIDTTAALAVPGVHRVYTWEDVPRKRFTTAIHTDHLVDPDDTYILDDTVRFAGQRVVAVLADTVGAAEEGCREVVVEYDVLPAVFDPEEAMADGAPQLHGSDDPFVRDPVHNILLELHGEVGDIEAGFAEADVIHEGTYFTPRVQHAHLETHGSIAWMEDGRLHVRTSSQSPSIAKVKLAHLFDLRPDQLRVFCKRVGGAFGGKQEVFSEDLVALATLDTGRPVCFEFTREEEFTTASPRHPMKLTITLGARSDGTLTAFQVRNVSNTGAYGNHGGETLFAAGAAISAYRCLNKKFDAYAVYTNSVPSGALRGYGMTQPAFAVESAMHELAVALDIDPLELRRRNIVRPGDSLVAIDDVPDDVGFGEDGLGQCIDLVDDALRRTANGQVLGVDWLVGEGTASSLHETAPPTEHISEAWATLGDDCVYELAVGTVEFGEGTSTAHVQIAATHLGTTPARIRLVQSDTDRTGFDTGAFASAGLFVAGNAVSNASVALRDRILAFAAVHTGVDVTECSMDDDGVLCGGTRVPLTDLVAAARRRGIRFTEARKAYGSPRSVVSNTHGFRIAVHRVTGEIRILYSVQAADVGVVINPVQVRGQIEGGVAQGIGFALTENFHVDDNGVMINPSLRNYRIPTYADIPRTEVLLVESNDSVGPMRAKGMAECCINPVAPALANALENATGVRFRELPLTPERIYHRIGENRSVPTT

SEQ ID NO: 6989 - DNA, 2682 bp, Mycobacterium smegmatis str. MC2 155
  CDS (1)..(2682): transl_table=11
atgagcgtccgcgtcaacggcaaacccgtctccggtgccccacagcccgggcagtgtctgcgcaccttcctgcgcgaccacggccacttcgaggtcaagaaggggtgcgacgccggggactgcggcgcgtgctcggtgctgatcgacgacgttgctgtccattcctgtgtatatccggcgttccgcgctgacggtcgcgacgtgaaaaccgttgcgggcctcggcacatccgaagatctgcatccgatgcagcgccggttcgtcgaagcggcgggattccagtgcggcttctgcacggccggcatgatcaccaccgcgtcgacgttcaccgaagaacagcgcgccaacctggccgagcacctcaagggcaacctgtgccgctgcaccggctaccggtccatcaccgatgcgctcgacggcgtcagcaacgtcgagaaatccggtggcacaacagcttcagttggggcaccggcggccgtgcgggtggcgaccggcaccgagccgtacaccatggaccacacaccggaaggcctgctgcaccttgcggtgctgggcagtccggtggcgcacgcgcgcatcgtcgcgatcgacaccagcgccgccgaggccgtacccggcgtgcgcctggtgctgacctacctcgacgcgccgcgcgtcgcgttctccaccgcgcgccacgagatccgtgaggacgatccggacgacacctacgtgctggacagcaccgtgcggttcgtcggccagcgggtcgccgcagtggtcgccgacagcgtcgccgccgccgaaacggcctgccgtgcaatcgccgtggagtacgagcagctgccggcagtgttcgatccggacgaggcgcgctcccccggcgcgccgctgctgcatgccgacaagggtcccgacgcccgcatcgccgacccgtcgcgcaacatcgtcgccgaactgcacggcggcatcggcgatgtgcagcaggccgtggccgccgcgcacaccgtggtccgcgggaggtatcacacgcagcgggtgcagcacgtgcatctggaaacccacggctgcaccgggtgggtcgacgaggacgggcggctgaccatccgcaccagcacccaggtgccgttcctggtacgtgatgaactgtgccgcatcttccggttggaccgcgacgtggtgcgagtgttcgccacgcgtgtgggcggcggtttcggcgccaagcaggagatgctggtcgaggatctggtcgcgttggcggtgctgcggctgggccgccctgtccgctatgagttcagcaggtccgacgagttcaccatggcgccgtgccgccacccgttccgggtcgatgtcaccgtggcggccgacgaggacggcacgttgacggcgctggccgtcgacgtcctcaccgatgccggcgcatacggcaatcacagccccggtgtgatgttccacggttgcgccgaatcggttgcggtgtaccggtgtgcgaacaaacgcatcgacgcgcagtcggtgtacaccaacaatctgccgtcgggcgcgttccggggctacggcctggggcaggtgatcttcgcgatcgagtcggccctcgacgaactcgcgcaacgcctgggcatcgatccgttcgagttgcggcgccgcaacgtggtccgccccggtgaccggctgatcgacgcacacgagcccgaggatctgttgttcggcagctacgggctggaccagtgcctcgacctgacacagaatgcgctcgccgcgggtaacggtgccgtcgcgccccagggctggcaggtcggtgagggcatggcggtcgcgatgatcgcgacgctcccgccgcggggccatttcgccgacgccacggtgacactgaaggatgacggacgctacgagttgtcggtggggacagccgaattcggcaacggcaccaccaccgtgcacgcccaactggtcgcgacgctgatgaacaccaccgtcgaccgggtgagcatccgccagtccgacaccgatgccggtggttacgacaccggggcgttcggatcggcgggcatcgtcgtggccgggcgcgcggtgcatcaagcgtgcgtcgcgctgcgcgccacgatcgaacgcgccgcggccgagctgaccggagtggacgcggtgtcgtgcgtcgtgggtccgcatggtgtgcagtgccgcgaccggttcgtgccgttcaccgagctggcgctgccgttgacggcgaccgggcatcacgacggcacgccccgctcggtggcgttcaacgtgcagggtttccgggtggcggtcaaccccgagaccggcgaggtgcggatcctgcagtcggtgcaggcggccgacgccggtgtggtgctcaaccccgagcagtgccgcggtcaggtggaaggcggtgtggcacaggcgatcggttcggcgctgtacgaggagatgcgggtcggcgccgacggcagggtgctcacccagaccctgcgcaactaccacatcccccagctcgccgatatcccgcagaccaaggtgtatttcgccgacacctacgacgagctcggtccgctcggcgccaagtcgatgagcgaatcaccgtacaaccccgtcgcccccgcgctcgccaacgcgatcgcgcgggccgtcggggttcgtccgcgcgagctgccgatgacgcccgcgcggatctggcgggcgctgcagcaagggcgtgcgtga

SEQ ID NO: 6990 - protein, 893 aa, Mycobacterium smegmatis str. MC2 155
MSVRVNGKPVSGAPQPGQCLRTFLRDHGHFEVKKGCDAGDCGACSVLIDDVAVHSCVYPAFRADGRDVKTVAGLGTSEDLHPMQRRFVEAAGFQCGFCTAGMITTASTFTEEQRANLAEHLKGNLCRCTGYRSITDALDGVSNVEKSGGTTASVGAPAAVRVATGTEPYTMDHTPEGLLHLAVLGSPVAHARIVAIDTSAAEAVPGVRLVLTYLDAPRVAFSTARHEIREDDPDDTYVLDSTVRFVGQRVAAVVADSVAAAETACRAIAVEYEQLPAVFDPDEARSPGAPLLHADKGPDARIADPSRNIVAELHGGIGDVQQAVAAAHTVVRGRYHTQRVQHVHLETHGCTGWVDEDGRLTIRTSTQVPFLVRDELCRIFRLDRDVVRVFATRVGGGFGAKQEMLVEDLVALAVLRLGRPVRYEFSRSDEFTMAPCRHPFRVDVTVAADEDGTLTALAVDVLTDAGAYGNHSPGVMFHGCAESVAVYRCANKRIDAQSVYTNNLPSGAFRGYGLGQVIFAIESALDELAQRLGIDPFELRRRNVVRPGDRLIDAHEPEDLLFGSYGLDQCLDLTQNALAAGNGAVAPQGWQVGEGMAVAMIATLPPRGHFADATVTLKDDGRYELSVGTAEFGNGTTTVHAQLVATLMNTTVDRVSIRQSDTDAGGYDTGAFGSAGIVVAGRAVHQACVALRATIERAAAELTGVDAVSCVVGPHGVQCRDRFVPFTELALPLTATGHHDGTPRSVAFNVQGFRVAVNPETGEVRILQSVQAADAGVVLNPEQCRGQVEGGVAQAIGSALYEEMRVGADGRVLTQTLRNYHIPQLADIPQTKVYFADTYDELGPLGAKSMSESPYNPVAPALANAIARAVGVRPRELPMTPARIWRALQQGRA

SEQ ID NO: 6991 - DNA, 2919 bp, Nocardioides sp. JS614
  CDS (1)..(2919): transl_table=11
atgagcaccatgatcgacctcgagctccacctcaacggcgctccgcgcaccgtgacctgcgcgccgggcgactcgctgctgagcgtgctgcggcggctgggctgcttcagcgtgcggttcggctccgagaccggcgagaccggcgccgccgcggtcctggtggacgggcggctgctggccgccgacgtgctgctcgccgcccaggccgccggccacgaggtgacgaccgtggagtcactgaacgtcgccaccggcgagctgcaccccatccaggccgcgttcgtggagtccggcgcgctgcagtccggctactccgccggggccatggtgctcgccacccaggccctgctcgcgcgcgaccccgacccctcggagtgggagatccgcgacgcgttctccgggatcctcgaccgggagacgggctacgtgaaggtcgtcgacgccgtgcagcgcgcggccgcgctgctccgtggcgagaagccggagccgatggcgcccgtcgtcgtcgggcggctcaccgacggcgacggtgggaccgtcccggacgctcccgctgccatgccgcgcctcgtgcccgcggcggacgtcccctccatgcaggtggtcgggacgcccgcgcccaaggtcgacgcgctcaagctggtcaaggggaatccggccttcgtcgacgacatcgagctgcgcgggatgctctacgccaaggtgctgcgcagcccgcacgcgcacgcccggatcgtcgccatcgacgactccgaggcccgcgcgctcccaggcgtgcacgccgtgctgcacaccttcaacacggcccgcgtgaagtacgcctccggcggccagagctggccgaacccgcgcccctgggaccaggtgagcttcgacgacaaggtgcgccacgtcggtgaccgcgtggccgcggtggccgcggagaccgtggcgatcgccgaggaggcctgccggcggatcaaggtgacgtacgacgtcctgccggcggtcttcgacgaggtcgaggcgatcggccccggcgctcccgtcatccacgacgagaccgacacggaggggatcgccgacgcggcccgcaacatcccccgccgggtcaacgggcagacggtcaccgacgacgagctggcggccgcgttcgccgacgccgagcacgtcttcgagcagaccttccacgtccagcagcagcagcagaccccgatcgagccgcacatcaccatcggctggctcgacgcggacgagcggctgacgctgcgcagctccacccaggtcccgttccacacccgccggatggtcgcccctctgctcggcctgccggtcaagcagatccgggtgatcaagccgcggctcggcggtggcttcggcggcaagcaggagatgctgctcgaggacgtggtcgggcacctggtgctcgcgacccgccgaccggtccggctggagctgacccgggaggaggagttcgtctcctcgcggatccgtcacgcccagacgatcaccttccgctccgccgtcgacgccgacggccgactgctcgccctggaccaccacgtggtcggtaacaccggcccgtacgcgacgcatgggttcacggtgcagtccgtctccggccagcgcggcctgtcgcagtacaactgccccgccaagcggtacacggccgacgtcgcctacacgaaccggccggtggccggggcgttccgcggctacggcgcgccccaggcgctgttcgcgctggagtcccacatggacgacatcgcccgcagcctcggcctcgacccgatcgagctccgtcggcggaactgggtgcgcaccggcgaccccctcgacatcctgcccacgctgggcgagcggggcgccgcggagatccagggcgaggtgccccgggtgaccagctgcgcgaccgacgagtgcgtggcgcaggccaggcgcgcgatcggctgggagcggcgcaacgaccccgcgtggaagcagcccgcggaccggccgagcatccgcagggggatcggcttcgcgctgtgcatgcaggccaccgcgatccccaacctcgacatgggtggtgcctcgatcaagatgaacgacgacggctcgttcaacctgctggtcggtgcgacggacctcggcacgggcgccgacacggtgctggcccagatcgccgccgaggtgctcggggtcgaggccagtgacgtggtcgtgtacgccgccgacaccgacctgacgccgttcgacgtcggggcctacgccgactccacgacgtacatctccgggatggcggtcaagaaggccgccgaggccgtgcgcgagcggatcgtgctgcgcgcggcccggctgctcgagctggccggccccgccaaggtcgagctgcggaacaagcaggcctgggcgcccgacgggcgctgcgtgacgctccaggacgtggccctccatgcgctgcacatcgaggaccaggaacagatcatggcgacggcctcgcacgtctcgggtgagtcgccgccgcccttcgccgcccagacggccgagatcgaggtggacgtggagaccggccaggtgaccgtcacgaagctggtgatggccgtcgacgccggggtcgtcatcaacccgaccacggcgagcggccaggtcgagggcgcgatggtgcaggcgctgggctacgcgctcaccgaggacctcgtcctcgacgacgacggccgtgcggtgaacgcccggttcgggccgtactggatcttccggcccgacgacacgcccccgatggaggtgttcctggtgcagaccatggagccgagcgggccgttcggcgccaagtcggtcggcgagatcgccatcgacggggtggcacccgccgtgcgcaacgcgatcctcgacgcgaccggggccaccgtcaacgagctgccgctcacccccgaacgggtctggcgggcgctgcacgcctga

SEQ ID NO: 6992 - protein, 972 aa, Nocardioides sp. JS614
MSTMIDLELHLNGAPRTVTCAPGDSLLSVLRRLGCFSVRFGSETGETGAAAVLVDGRLLAADVLLAAQAAGHEVTTVESLNVATGELHPIQAAFVESGALQSGYSAGAMVLATQALLARDPDPSEWEIRDAFSGILDRETGYVKVVDAVQRAAALLRGEKPEPMAPVVVGRLTDGDGGTVPDAPAAMPRLVPAADVPSMQVVGTPAPKVDALKLVKGNPAFVDDIELRGMLYAKVLRSPHAHARIVAIDDSEARALPGVHAVLHTFNTARVKYASGGQSWPNPRPWDQVSFDDKVRHVGDRVAAVAAETVAIAEEACRRIKVTYDVLPAVFDEVEAIGPGAPVIHDETDTEGIADAARNIPRRVNGQTVTDDELAAAFADAEHVFEQTFHVQQQQQTPIEPHITIGWLDADERLTLRSSTQVPFHTRRMVAPLLGLPVKQIRVIKPRLGGGFGGKQEMLLEDVVGHLVLATRRPVRLELTREEEFVSSRIRHAQTITFRSAVDADGRLLALDHHVVGNTGPYATHGFTVQSVSGQRGLSQYNCPAKRYTADVAYTNRPVAGAFRGYGAPQALFALESHMDDIARSLGLDPIELRRRNWVRTGDPLDILPTLGERGAAEIQGEVPRVTSCATDECVAQARRAIGWERRNDPAWKQPADRPSIRRGIGFALCMQATAIPNLDMGGASIKMNDDGSFNLLVGATDLGTGADTVLAQIAAEVLGVEASDVVVYAADTDLTPFDVGAYADSTTYISGMAVKKAAEAVRERIVLRAARLLELAGPAKVELRNKQAWAPDGRCVTLQDVALHALHIEDQEQIMATASHVSGESPPPFAAQTAEIEVDVETGQVTVTKLVMAVDAGVVINPTTASGQVEGAMVQALGYALTEDLVLDDDGRAVNARFGPYWIFRPDDTPPMEVFLVQTMEPSGPFGAKSVGEIAIDGVAPAVRNAILDATGATVNELPLTPERVWRALHA

SEQ ID NO: 6993 - DNA, 2748 bp, Sulfitobacter sp. EE-36
  CDS (1)..(2748): transl_table=11
atggataaaccgaccacgacagaagtgacctctttcaccctgaacggcagcattgcgcaggttgaaccgctgcccggtgaacgcttgtcttacgcgctgcgcgagcggctggaccgcaaggatgtaaagatcggctgcaacgcgggcgattgcggggcctgcactgtgctggtcgatggcgcgccggtctgcgcctgcctgatgcccgtgcagcaggcggtggggcggcaggtggagacgctggcggggctggtgaaaaccgaccacgacgcgcaggcgttgatgcaaagctttcagcaccatcaggccgcgcaatgcgggatttgcacaccggggatgatggtctctgccgtggcgttgttgcgcgaggtgccgcagccgagcgcggcgcaggtgcaggatgcccttggcggcgtgctgtgtcgctgtaccggctatcgcaagatcatcgacgcggtggtcggggcccatgctgccgacgggctgactgtcgcctctaccgcgcttggccagcctgcgcggcggctggacgggcaggccaaggtcgacgggtcagaggcgtttggcgatgacgttgccccagccggtgctttggtcgcgcgggtcatccgcgcgccccatgcctcggccggatttaccttcggcgatcttgaggcatggcgcagcgcgcagcccggtatccattgcatcctgaccgcagatgacgtgcccggcctcaacgcctttggcgtgatcccgggcttcatcgaccagccggttttcgctgtgaaccacatccggttccggggggaggcggttgcttgcgtcgtgggagaggcggaggcgatgatcgcccttgatctggaaagcttccctgtccgttgggtgccacaaactgcgcttgccgataccgatgccgcgaccgccccagacgcgccacagctgttcgaggatcgcaaaggcaacatcatgtgcggcggcttcgtgcaatgcggcgatgtggaggccgcgctcgacgccgccgacgtcactttcgaggcgcaatataccaccagttttgtcgaacatggctatatcgagcctgaggcaggctttgcccaagtgatcgacgggcgcatccatgtacacgcctgcacccaggcaccgggtatggaccgcgaagcactggccgcgatccttgaccgtcccatggccgacatccgcattgtgccgacggcggtcgggggcggtttcggatcaaagatcgacctgtcgttgcagcccttcatcgcgcttgccgcgctcaagacggcgcggcccgtgcgcatgacctatgcgcgcgccgaaacgatgcaatcgaccaccaaacgccaccccgcgcagatcacgatcaaggtcggggccaaggcggacgggacgctgtcggggctgcggttcgacggggatttcaacaccggtgcttatgcaagctggggtccgacggtcgccaatcgcgtgccggtacatgcctctggtccctaccacatccctgattatcgcgcacgcagccgtgccgtgcatacccattgcccccccgcaggtgccttccgcggcttcggcgtgccgcaatcggccatcgcacaggaaaccgcctttgacctgctggccgaaaagctggggcttgatccgctggagttccgtttgaagaacgcgctggcggacggggtgcccacggtctgcgggcaagtgttcgatcagggcgtcggcatcgccccctgcctagaggcgctgcgccccgcgtgggaggaagcgaaagccgaatgcgcccgtttcaatacaaggaatgacacggtgaaacgcggtgtcgggattgcgggggcgtggtacggctgcggcaatacctcgctgccgaacccgtcgaccattctggcgggcgtgcggccggatggcacggttgtgctgcaccaaggtgcaatggacatcgggcagggggccaatacggtgatcccgcaaatctttgcccaagcgcttgggctgtctgtcgaggggatcaagatcctagggggtgacaccgatatcacgccggacgcgggcaaaacctctgcctcgcggcagacctttgtgtcgggcaatgccgcagtgaggaccggagaggcgctgcgggcgcagatcctgcgacaggtcaacgcgggccccgccgcgcagatcggctgccaagacgggcagctcacggtgaccgacggcgggcgcacgcagcgccttgatctgacgcggctgccggtcgatgcgcagggctatgtgctgcaggcgcaagaaagctatgatccgccggtcaaaccgctggatgaaaacggacagggcgtgccctatgcgcagttcggctatgccgcgcatctggtggtggtcgaggtggatatcgcccttggcctgtgccgcccgctgcgctttgtcgccgcccatgacgtgggccgcgcgatcaacccgttgctggtcgaggggcaggtacagggcggcattgcccaagggctcggtatggcgctgatggaggaatatatccccgggcgcaccgagaacctgcatgattatctggtgccgaccatcggcgacgttcccccgatcgagacgctgatcctggaggtggccgacgcccacggcccctacggcgcgaaaggtctgggcgaacatgtgctgatccccaccgcccccgcgatcctcaatgcaatctaccatgccaccggtgcgcgcgtgacgcagacaccggccacgccgacgcgcctgcgcgccgcccttaaggaggccggacatgcctga

SEQ ID NO: 6994 - protein, 915 aa, Sulfitobacter sp. EE-36
MDKPTTTEVTSFTLNGSIAQVEPLPGERLSYALRERLDRKDVKIGCNAGDCGACTVLVDGAPVCACLMPVQQAVGRQVETLAGLVKTDHDAQALMQSFQHHQAAQCGICTPGMMVSAVALLREVPQPSAAQVQDALGGVLCRCTGYRKIIDAVVGAHAADGLTVASTALGQPARRLDGQAKVDGSEAFGDDVAPAGALVARVIRAPHASAGFTFGDLEAWRSAQPGIHCILTADDVPGLNAFGVIPGFIDQPVFAVNHIRFRGEAVACVVGEAEAMIALDLESFPVRWVPQTALADTDAATAPDAPQLFEDRKGNIMCGGFVQCGDVEAALDAADVTFEAQYTTSFVEHGYIEPEAGFAQVIDGRIHVHACTQAPGMDREALAAILDRPMADIRIVPTAVGGGFGSKIDLSLQPFIALAALKTARPVRMTYARAETMQSTTKRHPAQITIKVGAKADGTLSGLRFDGDFNTGAYASWGPTVANRVPVHASGPYHIPDYRARSRAVHTHCPPAGAFRGFGVPQSAIAQETAFDLLAEKLGLDPLEFRLKNALADGVPTVCGQVFDQGVGIAPCLEALRPAWEEAKAECARFNTRNDTVKRGVGIAGAWYGCGNTSLPNPSTILAGVRPDGTVVLHQGAMDIGQGANTVIPQIFAQALGLSVEGIKILGGDTDITPDAGKTSASRQTFVSGNAAVRTGEALRAQILRQVNAGPAAQIGCQDGQLTVTDGGRTQRLDLTRLPVDAQGYVLQAQESYDPPVKPLDENGQGVPYAQFGYAAHLVVVEVDIALGLCRPLRFVAAHDVGRAINPLLVEGQVQGGIAQGLGMALMEEYIPGRTENLHDYLVPTIGDVPPIETLILEVADAHGPYGAKGLGEHVLIPTAPAILNAIYHATGARVTQTPATPTRLRAALKEAGHA

SEQ ID NO: 6995 - DNA, 2742 bp, Roseovarius nubinhibens ISM
  CDS (1)..(2742): transl_table=11
atgactgatccgatcagcaaggtgaaactggggttcaccctcaatggcgcggcggtcgagatcgcgccggaggcgggcgagcgcctgtcgcagagcctgcgcgagaggcttggccggcgcgacgtcaagatcggctgtgacgcgggcgattgcggggcctgttcggtgctcatcgagggcgagaaccattgcgcctgtctggtggcggcgcatcaggtgcaggggctgcgggtcgagacgctcgccggtctggtcgagcgcgagccgatcacccaagggctgatggagcggttccaggatcatggcgcggcgcaatgcgggatctgcacgccggggatgatggtgtcggcgacggcgctgttgcgcgaagagcccgcgccgagcgacacccagatcgaggatgcgctgggcggggttctgtgccgctgtaccggctatcgcaagatcatcgacgcggtggccggacgcgcgccgcggctcgatgggcgggccgaggtcggcggcgcgatccggcggctcgatgggctggccaaggtgcgcggcgaagagcggttcggcgatgatgtggcaccgcaaggcacgctcgagctggtggtgatccgctcgccgcatgcgcgggccgggtttgaatttggcgatctggaggcctgggccgccgcgacgccgggggtggtcacggtgctcaccgctgcggatattcccggcgagaattgtttcggggtgatcccgccctttgccgatcagccggtctttgccgaaggtgaggcacggtttcggggcgaggcagtggcggcggtggtgctgacacccgaggcgcggcgcgactttgcgcagggcgatttcccggtgacctggcaggagcgcccggcggtgatgggcgtggccgaggcgcgggaagagggggcgccgcagcttcatgaggggcgcgcgggcaatctgatgatcaccggttttgtcgcgcggggcgatgccgaggcggcgcttggtcgtgccgaggtcgtggtcgagggccggttcgagagcgggtttgtggaacatgcctatatcgagccggaggcggggtttgcccagatggcgggcgacaaggtggaaatccacgcctgtacgcaagcgccggtgatggatctcgaggcgctggagatcattctcgggatggatcgcagccgcattcgcatcgtgccgacgggcgttggcggcggctttggctccaagctcgatatctcggtgcagcccttcctcgcgctggcggcgctgaagaccgggcagccggtgcgcatcgcctatagccgcacggaatcgatgcaatcgaccaccaagcgccacccgtcgcagattcatctgcggatcggggcggatggcgaggggcggctctgtggctttgcctttgacggggatttcaacaccggggcctatgcgtcctgggggccgactgtggccaaccgggtgccggtccatgcctcggggccctatcagcttggcgattatcgggccgaggcgcggggcattcacacccattgcccgccctcgggggcgtttcgtggctttggcgtgccgcaggcggcgattgcgcaagagagcctgtttgacgaattggcgggcaagcttggtctcgatccgctggagtttcgcattcagaacgcgctgcgcgatggggtgccgacggtctgcgggcaggtgttcgggcagggcgtcggcatcggtgcctgtctcgaggcgctgcgcccggcctgggccgagctgcgcgccgaggcggaggcgttcaacctcgaccaagccgggcctttgcggcgtggcgtcggtgtggcggcgggctggtacggctgtggcaatacctcgctgccgaacccatcgaccattcgcgccgggctgcgcccggatgggcaggtggtgctgcatcagggcgcgatggatatcgggcaaggcgcgaatacggtcatctcgcaggtctttgccagcgccttgggcctcgcggcggatcgccttgtgctgatcggggcggatacggatgtgacgccggatgcgggcaagacctcggcctcgcgtcagacctttgtgtcgggcaatgcggccaagctctgtggcgcggcgctgcgcggcgagatcctgcgcgcgatgaacgcgggcgagggcgcggtgctgcggtttgaggcgggggcggttctggccgaagagaacggacggcagcagcggctcgacctcgcggcgctgccgatggatgatctgggctatgtgatgcgggccgaagagacctatgacccgccgaccaagccgctcgacgagaacgggcagggcgagccctatgcccagttcggctatgccgcgcatctggcgatggtcgaggtggacacgcggctcggcactgtgcgggcgcggaaattcgtggcggcgcatgatgtcgggcgggcgatcaacccgatgctggtcgagggccagatcgagggcggcattgcgcaggggctcggcatggcgctgatggaggaatacctgccggggcggacggaaaacctgcatgattatctgatcccgaccattggggacattcccccggtgcaatcgctcatcatcgaagtgccggatgcgcatgggccctatggggccaaggggcttggcgaacatgtgctgatcccgacggcgcctgcgatcctcaatgcgattgcccatgccaccggggtccggatgcggtcggtgccggtgacgccgtcgaaactggcggctgcgttgaaaggggacaagaatggctga

SEQ ID NO: 6996 - protein, 913 aa, Roseovarius nubinhibens ISM
MTDPISKVKLGFTLNGAAVEIAPEAGERLSQSLRERLGRRDVKIGCDAGDCGACSVLIEGENHCACLVAAHQVQGLRVETLAGLVEREPITQGLMERFQDHGAAQCGICTPGMMVSATALLREEPAPSDTQIEDALGGVLCRCTGYRKIIDAVAGRAPRLDGRAEVGGAIRRLDGLAKVRGEERFGDDVAPQGTLELVVIRSPHARAGFEFGDLEAWAAATPGVVTVLTAADIPGENCFGVIPPFADQPVFAEGEARFRGEAVAAVVLTPEARRDFAQGDFPVTWQERPAVMGVAEAREEGAPQLHEGRAGNLMITGFVARGDAEAALGRAEVVVEGRFESGFVEHAYIEPEAGFAQMAGDKVEIHACTQAPVMDLEALEIILGMDRSRIRIVPTGVGGGFGSKLDISVQPFLALAALKTGQPVRIAYSRTESMQSTTKRHPSQIHLRIGADGEGRLCGFAFDGDFNTGAYASWGPTVANRVPVHASGPYQLGDYRAEARGIHTHCPPSGAFRGFGVPQAAIAQESLFDELAGKLGLDPLEFRIQNALRDGVPTVCGQVFGQGVGIGACLEALRPAWAELRAEAEAFNLDQAGPLRRGVGVAAGWYGCGNTSLPNPSTIRAGLRPDGQVVLHQGAMDIGQGANTVISQVFASALGLAADRLVLIGADTDVTPDAGKTSASRQTFVSGNAAKLCGAALRGEILRAMNAGEGAVLRFEAGAVLAEENGRQQRLDLAALPMDDLGYVMRAEETYDPPTKPLDENGQGEPYAQFGYAAHLAMVEVDTRLGTVRARKFVAAHDVGRAINPMLVEGQIEGGIAQGLGMALMEEYLPGRTENLHDYLIPTIGDIPPVQSLIIEVPDAHGPYGAKGLGEHVLIPTAPAILNAIAHATGVRMRSVPVTPSKLAAALKGDKNG

SEQ ID NO: 6997 - DNA, 2871 bp, Escherichia coli B
  CDS (1)..(2871): transl_table=11
atgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaatcatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgccctgatatctactataccccggggggtcagagcgcaccggaaccgtcaccgcttgaccgccgtatgttcggcaaaaaaatgcgtcacgtcggcgatcgcgttgctgcggtggtcgctgaaagtgaagaaattgcgctcgaagcattgaaactcatcgaggttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgctagtattcatggtcatattggcgatatggacaaaggctttgccgatgccgatgtgatcattgagcgaacctataactcaacgcaggcgcagcagtgcccgactgaaacacatatctgctttacccggatggacggcgatcgtctggttatccacgcctccacccaggtaccatggcacttacgccgccaggtcgcgcgcctcgtgggcatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgtgcactggaagagatcctgcgtcagggtcgcgagatgatccaatggtcgtcaccgaaaccgcaaaatggtgactggcacatcggtcgcggcgtcgccattatcatgcagaaatcgggtatcccggatatcgatcaggctaactgcatgatcaaactggaatcggacggcacctttatcgttcattctggcggtgcggatattggtactggtctggatactgtggtgacgaaactggcagcagaagtgctgcattgcccaccgcaggacgtgcatgttatctccggtgataccgatcatgcgttgtttgataaaggcgcatatgcctcgtccggtacttgcttctcaggtaacgcggcgcgtttggcagcggaaaatctgcgggagaaaattctgttccacggcgcgcaaatgttgggtgaggcagtggcagatgttcaactggcaacgccgggcgtcgtgcgcggcaagaaaggcgaagtcagcttcggggatattgctcataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaacccggaattagcattgggacaaatctacggtgctaccctgcgagctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccgttcggggcgaaatcgatctcggaaatcggtgtaaatggcgcagctccggcgattgctaccgcaattcacgatgcctgcggcatctggttacgcgaatggcatttcacaccggagaaaatactcaccgcgctggaaaaaatataa

SEQ ID NO: 6998 - protein, 956 aa, Escherichia coli B
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIAAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEEIALEALKLIEVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVGMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRVHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEAVADVQLATPGVVRGKKGEVSFGDIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACGIWLREWHFTPEKILTALEKI

SEQ ID NO: 6999 - DNA, 2796 bp, Streptomyces cinnamonensis
  CDS (1)..(2796): transl_table=11
ttgaggcggagcactgacatggaccttcccatcaggctcaatggccggctcgtatccgagcccccggccccagggcagtgcctgcgcacatatctgcgtgagcgcggctgcttcggggtgaagaaggggtgcgacagcggggactgcggcgcctgcaccgtgcatgtggacggcatggccgtacacagctgcctctatccggctgtgcgtgcttcggggcgggtggtgacgacggtggagggtctgaccgagggaggcccgctgcaccccgtgcagcaggccttcgccgccacccaggccttccagtgcggttactgcgccccggggttcgtcatgaccactgccgccagggatgacaaccagaccaccggactctccgaaaccctcaagggcaacctgtgtcgctgcacgggctaccggcgtatcgaggaagccatccagtcaacgcagcaaggccaacccgcggacgagtcggccaccaccgcggcgggagacgcctctgccgccggattgaccgacactgaaggcgtcgtcacaggcagggcccgcttcactctcgaccacccggaccctgtggggttgttgcacgtcaagctggtgcgctccccgcaccagcacgccctcatcaccgccatcgattccgccgatgccctcgccgtgccgggcgtccacaccgtcctgacccaccacgacgctcccacgatccgcttctccaccgcgctgcacgagtacgccgacgaagacccggccgacacccgcgtcctggacgatgtcgtgcgccatgtcggccagcgtgtggccgcggtggtggccggcagcgaagccgcagccgacgagggctgccgccgtgtgcgcgtcacctatcggatcctgcccgctgtcaccgacacggaccacgcgctgtcgcccgacgccccccacgtacaccccggcggcaacatcgtcgacgaactgcacaccgccaccggcgacttcgatgccgcactggccgaggcggaccattcctacgaggggactttccgcacgcaccgggtacagcattgcgcgctggaaacccacgccacccgcgcctgggaagacagcacggggcggctccatgtccacaccaccacccaggccccccacctgacccgtcggcttctgggcgctgttttcggcctgccgctggagcgcgtgcaggtcacggccgcgcggctgggcggcgcgttcggcggaaagcaggagatgctcaccgaggacatcgccgtcctcgccactctgcgcacaggacggccggtccagttggagtacacccgggccgaggagttcacggccacgacccgtcaccccttcaagatccgggtgaggatcgctgcccatcgggacggcacactcaccgccctgggactgcacgtcctgtgcgataccggcgcctacggcaaccacggccccgccgtcctgcgccgcgcctgcaccgaaaccctcagcctctaccactgtgcgaacatcgtggttgacggctgggcgctgtacacgcacagcgtgccggcgggcgctttccgcggctacggcatcggccaggtcgccttcgccgtcgagtccgccctcgacgaactcgcccgcaccgccggcctcgatcctctggccctgcgacgcaaggcttacctgcgctccggacagtccgcaccggctgtggcggccgacggcacgccgcccgtcgccgaccacggcatcaccggctgcctcgacatcatcgaagccgcccgcgcccgacacaaggccgcatcccccgcgcttccggacccgtcctggctggtgggggaaggcatggccgtcaccgtcacccacaccctcccttccgacggccacgtcgcccaggccactgccaccctgcgcgcggacggcacctacgacctgtgcaccggcgcgccggagttcggcagccaggcaacgaccgtgcaccggcggattgccgccgccgcactggccaccaccgtcgaccggatccatgtccggcagggcgacaccgacctgctctcccacgacaccgggggcttcgtctccaccggctccaccctcgccgcccgcgccgtccacgaggcttgccaccgcctgcacacggccgtactcgaagccgcagccgcccacaccgccaccgccccgggaaactgccgcctccgccaggacgctgtcgactgcgacggccgccttctgcccctgcccgtgctgtaccgcaccttgtgcgaggccggccacgaactcaccgccacggcctcccattgcgccgacagcggggcccccggcctggcctccaacgcccagtggattcgcctggccgtcgccccggacaccggcctggtcaccctcctgcactccgtccacgccagcgatgccgggaccgtcctggatgcccggcaactgcgcggccagatcgaaggcgccatcgcccagggcatcggcaccacgctgatggaagaactgcgaaccgaccggcacggccgcgtcatcacacaggaactgcgcacctatccgatcccccatgccgccgatgtcccccacactgacgtccacttcgtgcccgcgtcctcccccggcgaactccaggcggccaaacccgcgagcgaagccgccttcaaccccgtcgcccccgccctggccaacgccctgcgcgacgccaccggcatccgctgcacgaacctcccgctgcgcgccgacaccatctgggcgcaactgaacgcacacgcgccgcacctacgcggagagcgcaccgcaccagaccacccctcaccagcgtcagaaacgcctgccggtggctga

SEQ ID NO: 7000 - protein, 931 aa, Streptomyces cinnamonensis
MRRSTDMDLPIRLNGRLVSEPPAPGQCLRTYLRERGCFGVKKGCDSGDCGACTVHVDGMAVHSCLYPAVRASGRVVTTVEGLTEGGPLHPVQQAFAATQAFQCGYCAPGFVMTTAARDDNQTTGLSETLKGNLCRCTGYRRIEEAIQSTQQGQPADESATTAAGDASAAGLTDTEGVVTGRARFTLDHPDPVGLLHVKLVRSPHQHALITAIDSADALAVPGVHTVLTHHDAPTIRFSTALHEYADEDPADTRVLDDVVRHVGQRVAAVVAGSEAAADEGCRRVRVTYRILPAVTDTDHALSPDAPHVHPGGNIVDELHTATGDFDAALAEADHSYEGTFRTHRVQHCALETHATRAWEDSTGRLHVHTTTQAPHLTRRLLGAVFGLPLERVQVTAARLGGAFGGKQEMLTEDIAVLATLRTGRPVQLEYTRAEEFTATTRHPFKIRVRIAAHRDGTLTALGLHVLCDTGAYGNHGPAVLRRACTETLSLYHCANIVVDGWALYTHSVPAGAFRGYGIGQVAFAVESALDELARTAGLDPLALRRKAYLRSGQSAPAVAADGTPPVADHGITGCLDIIEAARARHKAASPALPDPSWLVGEGMAVTVTHTLPSDGHVAQATATLRADGTYDLCTGAPEFGSQATTVHRRIAAAALATTVDRIHVRQGDTDLLSHDTGGFVSTGSTLAARAVHEACHRLHTAVLEAAAAHTATAPGNCRLRQDAVDCDGRLLPLPVLYRTLCEAGHELTATASHCADSGAPGLASNAQWIRLAVAPDTGLVTLLHSVHASDAGTVLDARQLRGQIEGAIAQGIGTTLMEELRTDRHGRVITQELRTYPIPHAADVPHTDVHFVPASSPGELQAAKPASEAAFNPVAPALANALRDATGIRCTNLPLRADTIWAQLNAHAPHLRGERTAPDHPSPASETPAGG

SEQ ID NO: 7001 - DNA, 3771 bp, Oryza sativa subsp
  CDS (1)..(3771)
atggggtcagaggcggcggcggcgaggccggtggtggtgacggtgaacggggagaggtacgaggcggtgggggtcgacccgtcgacgacgctgctcgagttcctccgcacgcggacccccgtccggggccccaagctcggctgcggcgaaggtggatgcggcgcatgcgtggtcgtcgtttccaagtacgacgccgtcgccgacgaggtgaccgagttctcggcgagctcctgcctgacgctgctcggcagcctgcaccactgcgcggtcaccaccagcgagggcatcggcaactccagggatggcttccacgccgtgcagcggcggctctccggcttccacgcctcgcagtgcggcttctgcaccccgggcatgtgcatgtccatctactccgcgctcgccaaggccgacaggtgctcgtcccgtccctcgccgccgccggggttctccaagctcaccgccgctgaggccgagaaggccgtctccggcaacctgtgccgctgcaccggctacaggcccatcgtcgacgcgtgcaagagcttcgccgccgacgtcgacctcgaggaccttggcctcaacgccttctggaagaaaggcgccgacgacgagcgcgctgacgtcggcaagctgcctgcatactctggtggcgccgccgtctgtacgttcccggagttcctcaagtcggagataaggtcatccatgggtcaagcgaatggtggcgctccggcggtggcggtcaccggagacggctggttccaccccaagagcgtcgaggagttccacaggttgtttgactctaacctgttcgacgaaaggtctgtgaagattgtggcatcgaacaccggctccggagtgtacaaggatcaagacctccatgacaagtacatcaacatctcgcagattccggaactctcagccatcaatagaagcagcaagggcgtcgagatcggagctgtcgtgtctatctccaaagccattgagatattgtcggatggaggcgcagtgttcagaaagattgccgatcacctgagcaaagtggcctcgtcgttcgtccagaacacggcgaccattggaggcaacatcatcatggcgcagaggctgtctttcccgtcggacatcgcaacggttcttctcgctgcaggatcaactgtcaccatccaggtggccgccaagaggatgtgcatcactctggaggagttcttgaagcagcctccatgtgattccaggacgttgttggtcagcatctctatcccggattggggttcagatgatggcatcacctttgagtcgtttcgtgcggctcctcgtccacttggcaatgctgtgtcatatgttaattctgcattcttggcaagaagttcagtggatggatcatcagggagccatctcattgaggatgtttgcttggcatttggcgccttcggggccgaacacgccatcagagctagggaggttgaggagttcttgaagggaaaattggttagtgcaccagtgatacttgaagcagttcggcttcttaaaggtgttgtttcaccagctgaaggcacaacacatcctgaatacagagtcagcttggccgtcagttatctgttcagattcctgacttcccttgctaatggcttggatgagcctgaaaatgcttatgttcccaatggttcatgtactaatggaaccgcaaacggtagcgctaattcctctccggagaagcactcaaatgttgacagctcttatttgccaataaaatcaaggcaagagatggttttctctgatgaatacaaacctgttggaaagccgatcgagaaaaccggagcagagctccaagcttctggagaggcagtgtatgttgatgacatccctgctccgaaggattgcctctatggagcatttatctatagcacacaccctcacgctcacataaaagatataaacttcagatcatctttggcttcacagaaggtcatcacagttatcactgcaaaggacattcctaccggtggagaaaatattggatcatgcttcccaatgcttggagatgaagcgcttttcgttgatcctgtttctgaatttgccggccagaatattggtgttgtgattgctgaaacacaaaagtatgcctatatggcggcaaagcaagctgtgatcgaatatagtaccgaaaatcttcagccaccaattctgacaatagaagatgctgtccagcataacagctacttcccagttcccccatttttagctcctacgccaattggtgacttcaaccaagctatgtctgaagctgatcacaagatcatagatggggaggtgaaacttgaatcccagtactatttctacatggagacacagacggccttagctatccctgatgaagataactgtataaccctctatgtgtcagcccaactacctgagcttactcaaaatattgttgcgaggtgccttggcattccatatcacaatgtccgtatcatcacgagaagagttggaggaggttttggtggaaaggcaatgaaaacaatgcatgttgccgctgcatgtgctgtcgccgcattcaagctgcggcgtccgattcgaatgtacctcgatcgcaagacagacatgatcatggcgggagggcggcatccgatgaaggtaaagtactccgtcggtttcaagtccgacggcaagatcacgggtctgcactttgatcttggaatgaacggcggaatatcgccggattgcagcccggtgttgccagtcgccattgtcggggctctgaagaagtacaactggggcgctctctccttcgacatcaaggtctgcaagacgaacgtctcgtcgaagtcggcgatgcgggctccaggcgacgcgcagggctcgttcatcgccgaggccatcgtcgaacacatcgcgtccactctctcagtggacacgaacgccatcaggaggaagaacctccatgacttcgagagcctcaaggtgttttatgggaatagcgccggtgatccttcgacgtacagcctcgtcaccatcttcgacaagctggcctcgtcgccggagtaccagcagagggccgccatggtcgagcacttcaacgccggcaacaggtggaagaagcggggcatttcttgcgtgccgatcacctacgacgtgaggctccggccaactccggggaaggtgtccatcatgaacgacggctccatcgccgttgaggtcggcggcgtcgagatcgggcaggggctgtggacgaaagtgaagcagatgacagcgttcgcgctgggccagctctgcgatgatggcggcgagggcctcatcgacaaggtccgtgtcatccaggccgacaccctgagcatgatccagggaggcttcaccggtgggagcacgacctccgagactagctgcgaggctgttcggaagtcgtgcgccgccctcgtggagaggttgaagcccatcaaagagaaggctggcacgctaccatggaaatcccttattgcccaggcaagcatggcgagtgtgaagctgacagagcactcgtactggacgcctgaccccacgttcactagctacttgaactatggagctgcaattagtgaggtggaagtcgatgtgctgacgggagaaaccaccatcctgaggagcgacctcgtgtatgactgtgggcagagcctgaatcctgctgtggacttgggccaggtcagtcaatctactaaattaccatcaaaatatcagttgcatctgcaattctgcgcgttgcaaatcattgcaagaatgagatgtaaattatatgtgatctga

SEQ ID NO: 7002 - protein, 1256 aa, Oryza sativa subsp
MGSEAAAARPVVVTVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADRCSSRPSPPPGFSKLTAAEAEKAVSGNLCRCTGYRPIVDACKSFAADVDLEDLGLNAFWKKGADDERADVGKLPAYSGGAAVCTFPEFLKSEIRSSMGQANGGAPAVAVTGDGWFHPKSVEEFHRLFDSNLFDERSVKIVASNTGSGVYKDQDLHDKYINISQIPELSAINRSSKGVEIGAVVSISKAIEILSDGGAVFRKIADHLSKVASSFVQNTATIGGNIIMAQRLSFPSDIATVLLAAGSTVTIQVAAKRMCITLEEFLKQPPCDSRTLLVSISIPDWGSDDGITFESFRAAPRPLGNAVSYVNSAFLARSSVDGSSGSHLIEDVCLAFGAFGAEHAIRAREVEEFLKGKLVSAPVILEAVRLLKGVVSPAEGTTHPEYRVSLAVSYLFRFLTSLANGLDEPENAYVPNGSCTNGTANGSANSSPEKHSNVDSSYLPIKSRQEMVFSDEYKPVGKPIEKTGAELQASGEAVYVDDIPAPKDCLYGAFIYSTHPHAHIKDINFRSSLASQKVITVITAKDIPTGGENIGSCFPMLGDEALFVDPVSEFAGQNIGVVIAETQKYAYMAAKQAVIEYSTENLQPPILTIEDAVQHNSYFPVPPFLAPTPIGDFNQAMSEADHKIIDGEVKLESQYYFYMETQTALAIPDEDNCITLYVSAQLPELTQNIVARCLGIPYHNVRIITRRVGGGFGGKAMKTMHVAAACAVAAFKLRRPIRMYLDRKTDMIMAGGRHPMKVKYSVGFKSDGKITGLHFDLGMNGGISPDCSPVLPVAIVGALKKYNWGALSFDIKVCKTNVSSKSAMRAPGDAQGSFIAEAIVEHIASTLSVDTNAIRRKNLHDFESLKVFYGNSAGDPSTYSLVTIFDKLASSPEYQQRAAMVEHFNAGNRWKKRGISCVPITYDVRLRPTPGKVSIMNDGSIAVEVGGVEIGQGLWTKVKQMTAFALGQLCDDGGEGLIDKVRVIQADTLSMIQGGFTGGSTTSETSCEAVRKSCAALVERLKPIKEKAGTLPWKSLIAQASMASVKLTEHSYWTPDPTFTSYLNYGAAISEVEVDVLTGETTILRSDLVYDCGQSLNPAVDLGQVSQSTKLPSKYQLHLQFCALQIIARMRCKLYVI

SEQ ID NO: 7003 - DNA, 4245 bp, Oryza sativa subsp
  CDS (1)..(4245)
atggattcgccgccgccgccgcgggaggaggtggtggtattcgcggtcaacagcgagcgcttcgagctccgccgtgacgggggcgaccccggggagtccctcctcgagttcctccgctcccgcacccgcttcaccggcgccaagctcggctgcggcgaaggcaaggcaaccccccaacccaccgctcttcctcctcctcggctgctttgcttccgtgggtgcggggcgtgcgtggtggtggtctcggcgtacgacgcggaggccgacgaggtggcgcacgcggcggtcagctcgtgcctcacgctggcgcgcggcctccaccaccgcgcggtgaccaccaccgaggggctcgggagcagccggcgcggcctccacgcgctgcacgagcggctcgccggcttccacgcctcgcagtgcgggttctgcacgcccggcgtgtgcatgtccctcgccggcgcgctcgcggccgccgaggggaacgggaagaaggccgcctccgccgcggaggggttctcgaggctcacggcggccgaggcggagcgcgcggtggccgggaacctgtgccgctgcacggggtaccgaccgatcgccgacgcgtgcaagagcttcgccgccgacgtggacttggaggatttggggctcaactgcttctggaacaagggcgatgccactgccagtgtctccaagttgccgccttacaaggagaggagcatcgccgcgttcccggagttcttgaaggatgaaatcagatcttcattggggattgatcattccatttcgtcagcatctatggtggggagtgtgagctcttggtatcaacctaaaaatgtggaggagtattataagctgataggttctttgtcatcatcatctgataaaagtagaacaaaggtggttgtgggcaacacttcttctggtgtttacagggatgcagagctgtatgataggtacatagacttgagagccattccagaactgaattcggttagcaaggatgtcaagggtgttggcattggggctgcaatgtccatttctcaggtaatcgagattttacgaggagaaggcaacagctacaaggacgtggtgttttgcaagattgctgatcacatggagaaagtggcttctcagtttgtccggaacatggcgagcttgggtggaaatctgataatggctcagagggatgagtttgcctctgacattgcaacggttctgcttgctgctggttcatcactgtgcatccaggtatcatcagaaaggatgaatgtcacactggagcgattcctggacatggccccttgtgattgcaagacgttgctattaagaatttacattcctcactgcactccaagtggcatctcatcaagttctgaatctgtaaataagacaggagataaacctgcaagttccgtgctatttgagacataccgagcttccccacggcctattggaaatgctgtttcataccttaattctgcattcctggctaaattatcttcagatgaaacttcaggaaactgtatattggagaagctatgtttggcttttggtgcatatggaacacaacatgctgtcagggctacaaatgttgagagtctcttagtgggtaaacccatcactgcatcactcttactagaagcgtgcacggttctcaagaaaacaattgttccaggggaaggtacaagacatgctgcttacagatcaagcttagctgttgcctttctttttagttttctttatccaataaccaaaggaactttcaagcctgtagaggcggtccacctgaacggccatataatttctgataacaatggaaatatgaatcgtggacccgacacacatgttgatgtttcacctaaggagatcaataatgtgaaatctgatttacatggtaatgatcgcatacttgaatcatccaaacaggtcatcgagatcagtgaagactatctcccggttggcttaccagccaagaaagttggagcagaactacaagcctctggtgaggctatatatgtggatgacatcccttccccaaaagactgcctgcatggagcatttgtatatagcacaaaacctttagctcatgtgaagagcatagaactgaacccttctctcgagcagctaaaaactgtggcgattgttactgccaaggatattcctaaaggaggcagcaatgttggggccaacactatatttggacctgaacctctgtttggtgatccactcactcagtgggctggggaaccacttggtattgtggttgcagagacacaaaaaactgccaatatagctgccagtcgagcattggtcgactacagcatggaaaatttagatgctccaattttatcaattgaggaggctgtgagaagtagtagttattttgaaatcctaccatttcttcttccccaaaagattggtgatttctcaaaaggaatggaagaagctgaccagaaaatatattcaactgaggtgaaccttcactcgcagtattacttttacatggaaacacaaactgcgctagccatacctgaggaggataactgtatggtcgtgtatagctcaagccagtgcccggaggtagcacaagaaaccattgcaaaatgcctgggtttaccttgtcataatgtccgtgttattactagaagagttggtggtggctttggaggcaaagctgtcagatcgttaccagtggcaacagcttgtgcactttcagcatttaagttgcagcgtcctgtccgaatatatcttgatcgcaagactgacatgataatgactgggggccggcatcccatgaaaatacgctattctgtaggcttcaaatccgatgggaacatcacagcgctacatatagaattgttggtaaatgccggaataacccaggatgttagtccagtgattcctcacaatttcatagaggctctgaagaaatataattggggtgccttctcctatgatgcaagaatctgcaaaacaaacattgcaaccagatccgcaatgcggggtcctggagaagtgcagggttcttatgttgctgaagctattattgagcatgttgctgctgtgctctctactgatgttaatttggtcaggcagagaaatcttcacacagtggagagcctcagtttgtatcatagtgaatgcatggaagatgccttggggtatacacttccctctatctgcaatcagttgattacatcagcaaattaccagcaccaacttgaaatgattcggtccttcaacaaaagcaacagatggaaaaagcgggggctttctgtcgtgccgatagtgcataaattcgcatctcggccaacgcctggtaaagtgtctattcttaatgatggatccgttgctgttgaagttggaggcattgaacttggccaagggctttggacaaaagtgaagcagatggcagcgttcggtcttggacagctttggactgatagaaggcaagaactgttggagagagtgagaattattcaagcagatacactaagtgtgatacagggagggtggaccacagggagtacaacatcagaatctagctgcgaggcagttcatcgtgcctgcaatatcttggtcgacaggctgaaaccactcaaggagcaattgcaagaaaaacaaggaacagtttcatgggatgagcttatttcacaggcaaaaatggtaggtgtggacttatcagctaaagaactctacgttcccggggcttctggttcctatctaaactatggggcagctgctagtgaggtagagattgatcttctgacaggagcgaccacaattttgcgtagtgatcttatatatgattgtggacggagtttaaatcctgctgttgacttggggcaggttgaaggggcttttgtccagggaattggttatttcatgaacgaggagtacgtgacgaactcagatgggctgcttgtctcagacgggacttggacatacaagattcctacggtggacaccatcccaaaacagttcaacgttaagctactcaacagtggattccacaagaaacgtgtgctctcttcaaaagcttctggggagccacctttgctacttgctgcctcggtgcattgtgcaacaagggaagcaattagagcagcaagggaggagtatcactgttccaggtctggatcttcacctcccttctttgatcttgaagttcctgccatcatgcccacggtgaaggagctatgcggcttagacaacgtggagaagtatttggagagtatctgctcgaaataa

SEQ ID NO: 7004 - protein, 1414 aa, Oryza sativa subsp
MDSPPPPREEVVVFAVNSERFELRRDGGDPGESLLEFLRSRTRFTGAKLGCGEGKATPQPTALPPPRLLCFRGCGACVVVVSAYDAEADEVAHAAVSSCLTLARGLHHRAVTTTEGLGSSRRGLHALHERLAGFHASQCGFCTPGVCMSLAGALAAAEGNGKKAASAAEGFSRLTAAEAERAVAGNLCRCTGYRPIADACKSFAADVDLEDLGLNCFWNKGDATASVSKLPPYKERSIAAFPEFLKDEIRSSLGIDHSISSASMVGSVSSWYQPKNVEEYYKLIGSLSSSSDKSRTKVVVGNTSSGVYRDAELYDRYIDLRAIPELNSVSKDVKGVGIGAAMSISQVIEILRGEGNSYKDVVFCKIADHMEKVASQFVRNMASLGGNLIMAQRDEFASDIATVLLAAGSSLCIQVSSERMNVTLERFLDMAPCDCKTLLLRIYIPHCTPSGISSSSESVNKTGDKPASSVLFETYRASPRPIGNAVSYLNSAFLAKLSSDETSGNCILEKLCLAFGAYGTQHAVRATNVESLLVGKPITASLLLEACTVLKKTIVPGEGTRHAAYRSSLAVAFLFSFLYPITKGTFKPVEAVHLNGHIISDNNGNMNRGPDTHVDVSPKEINNVKSDLHGNDRILESSKQVIEISEDYLPVGLPAKKVGAELQASGEAIYVDDIPSPKDCLHGAFVYSTKPLAHVKSIELNPSLEQLKTVAIVTAKDIPKGGSNVGANTIFGPEPLFGDPLTQWAGEPLGIVVAETQKTANIAASRALVDYSMENLDAPILSIEEAVRSSSYFEILPFLLPQKIGDFSKGMEEADQKIYSTEVNLHSQYYFYMETQTALAIPEEDNCMVVYSSSQCPEVAQETIAKCLGLPCHNVRVITRRVGGGFGGKAVRSLPVATACALSAFKLQRPVRIYLDRKTDMIMTGGRHPMKIRYSVGFKSDGNITALHIELLVNAGITQDVSPVIPHNFIEALKKYNWGAFSYDARICKTNIATRSAMRGPGEVQGSYVAEAIIEHVAAVLSTDVNLVRQRNLHTVESLSLYHSECMEDALGYTLPSICNQLITSANYQHQLEMIRSFNKSNRWKKRGLSVVPIVHKFASRPTPGKVSILNDGSVAVEVGGIELGQGLWTKVKQMAAFGLGQLWTDRRQELLERVRIIQADTLSVIQGGWTTGSTTSESSCEAVHRACNILVDRLKPLKEQLQEKQGTVSWDELISQAKMVGVDLSAKELYVPGASGSYLNYGAAASEVEIDLLTGATTILRSDLIYDCGRSLNPAVDLGQVEGAFVQGIGYFMNEEYVTNSDGLLVSDGTWTYKIPTVDTIPKQFNVKLLNSGFHKKRVLSSKASGEPPLLLAASVHCATREAIRAAREEYHCSRSGSSPPFFDLEVPAIMPTVKELCGLDNVEKYLESICSK

SEQ ID NO: 7005 - DNA, 4056 bp, Oryza sativa subsp
  CDS (1)..(4056)
atgggggaggcggcggcggtggtggcggtgaacggggagaggtacgaggcggtgggggtggacccgtcgatgacgctgctcgagttcctccgcacgcggacgccattcagaggccccaagctcggctgcggcgaaggaggatgcggggcgtgcgcggtggtggtgtccaagtacgacgccgccgccgacgaggtgacgtcgttctcggcgagctcgtgcctgacgctgctgggcagcctccaccactgcgcggtgaccaccagcgagggcatcggcaactccagggatggcttccaccccgtgcagcgccgcctcgccggcttccacgcctcccagtgcggcttctgcaccccgggcatgtgcgtctccatcttctccgccctcgccaacgccgacagggcggcctccgccgcgccgccgccgccgccgacgccgccggggttctccaggctcaccgccgccgacgccgagcgggccgtctccggcaacctctgccgctgcaccggctaccggcccatcctcgacgcctgcaagagcttcgccgccgacgtcgacctcgaggatctgggtctcaactccttctggaagaaaggcgagcgcgctgacatcaccaagcttccggcctactcctgtactgccgatgttgccaccttcccggagttcctcaagtccgagattaggtcatccggtggtgctccggcggtggcggtcaccggcgacggctgctggttccatcccaggagcatcgaggagttccacaggttgtttgaatgcaacctgttcgacgaaatgtccgtgaagattgtggcgtcgaacaccggctccggggtgtacaaggatcaggacctccatgacaagtacatcaacatctcgcagattcctgagctctcggccatcaacagaagcagcgatggcatcgagatcggagcagccgtgtctatctccaaagccatcgagatactacggtcagatggtggagacgcggtggtgtttcgaaagattgctgatcacctgggcaaggtggcctcaccgttcgtccggaacacggccaccataggaggcaacatcatcatggcgcagaggatgtcgttcccgtcagacatcgcaactgttcttctcgctgcaggatcaactgtcaccatccagcaggtggcttccaagaggatgtgcctcactctggaggaattcttgaagcagcctccatgtgattccaggacattgctaatcagcatgtccatcccagattggtgttcatatgatggcatcacttttgagacatttcgtgcggctcctcgtccatttggcaatgctgtctcatatgtgaattctgcattcttggcaaggagttcgttggatgcagcatcaggaagccatcttattgaggatgttcgcttggcattcggcgcttttgggtctgaacatgccatcagagctagtaaggttgaggagttcttgaagggaaaattggttagtgcatctgtgatacttgaagcagtccggctgcttaaaggagttgtttcaccagcagaaggcaccacacatcctgaatacagagtcagtctagccgtcagttacctattcaggttcctgtcttcccttgctaatggcttggatgataagcctgaaaatgctaataatgttcccaatggttcatgtactactaatggaaacaccaacggtagcgctgagtcgacggttgacagctttgatttgccaataaaatcaagacaagagatggttttctctgatgaatacaaaccagtcggaaaaccaatcaagaaagtcggggcagagctccaagcttctggggaggcagtgtatgttgatgacatccctgctccaaaggattgcctctatggagcatttatctacagcacacaccctcacgctcacataaaaggtgtaaactttagatcatctttggcttcacagaaggttatcacagttatcactgcaaaggacatcccgaccggtggagaaaatgttggatcctgcttcccactgttaggagatgagcactttttgctgatccagttgctgaattcgctgattgcggaaacacaaaaatacgcctatatggcagcaaggcaagctgtgatcgaatataatactgaaaatcttcagccaccaattctaacagtagaagacgctgtccaacataacagctacttccaagttcccccatttttacaacctaagccaattggtgacttcaaccaagccatgtctgaagccgatcacaagatcatagatggggaggtgaaacttggatcccagtactatttctacatggagacacaaacggctttagctttccctgatgaagataactgtataaccgtctactgctcagcgcaaatgcctgaggttactcaagatattgttgcaaggtgcctcggcgttccatttcataatgtccgtattatcacgagaagagttggaggaggtttcggtggaaaggcaatgaaagcaacacatgttgcaactgcttgcgctgtggcagcattcaagctgcggcgcccagttcgaatgtacctcgatcgcaagacggacatgataatggcgggagggcggcatccgatgaaggccaagtactccgtcgggttcaagtccgacggcaagatcacggccctgcacctcgatctcaagatcaacgccgggatatcaccggaattcagcccggcgatcccgtacgccattgtcggggccctgaagaagtacaactggggcgctctcgcgttcgacatcaaggtctgcaagacgaacgtctcgtccaagtcggccatgcgtgctccgggcgacgcgcagggctcgttcatcgccgaggccatcgtcgagcacgttgcgtccacgctctccgtggccacgaacaccatcaggaggaagaacctccatgacttggagagcctcaaggtgttcttcggggacagcgccgccggcgaggcctcgacgtcgtcgtacagcctcgtcaccatcttcgacaggctggcctcgacgccggagtaccagcggagggccgccatggtggagcaattcaacggcagcagcaggtggaagaagcgtggcatttcttgcgtgccgatcacctactcggtgacgctccggccgtctccggggaaggtctccatcttgaacgacggctccatcgccgtcgaggtcggcggcgtcgagatcgggcagggcctgtggaccaaggtgaagcagatgaccgccttcgcgctgggccagctgtgcgatgacggcggcgagggcctcctcgacaatgtccgtgtcatccaggctgacaccctgagcatgatccagggaggatggaccgccgggagcacgacctccgagaccagctgcgaggctgttcggaagtcatgcgccgcgctcgtggagcggctcaagcccatcaaggagaaggctggcaccctaccatggaaatcctttattgcgcaggcaagcatggctagtgtaaaactgacggagcacgcgtactggacccctgacccgacgttcactagctacatgaactatggagctgccactagtgaggtggaagtcgatgtgctgacaggggcaaccaccatcctgaggagcgacctcgtgtatgactgtgggcagagcctgaatcctgctgtcgacttaggccaggtggaaggcgcgttcgtgcaaggtgtgggcttcttcacgaacgaggagtacgcgaccaacgccgatgggctggtcatccacgacggcacatggacgtacaagatccccaccgtagacaccatccccaagcagttcaacgtcgagctcatcaacaccgctcgccatcacagccgcgtcctctcctcaaaagcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctag

SEQ ID NO: 7006 - protein, 1351 aa, Oryza sativa subsp
MGEAAAVVAVNGERYEAVGVDPSMTLLEFLRTRTPFRGPKLGCGEGGCGACAVVVSKYDAAADEVTSFSASSCLTLLGSLHHCAVTTSEGIGNSRDGFHPVQRRLAGFHASQCGFCTPGMCVSIFSALANADRAASAAPPPPPTPPGFSRLTAADAERAVSGNLCRCTGYRPILDACKSFAADVDLEDLGLNSFWKKGERADITKLPAYSCTADVATFPEFLKSEIRSSGGAPAVAVTGDGCWFHPRSIEEFHRLFECNLFDEMSVKIVASNTGSGVYKDQDLHDKYINISQIPELSAINRSSDGIEIGAAVSISKAIEILRSDGGDAVVFRKIADHLGKVASPFVRNTATIGGNIIMAQRMSFPSDIATVLLAAGSTVTIQQVASKRMCLTLEEFLKQPPCDSRTLLISMSIPDWCSYDGITFETFRAAPRPFGNAVSYVNSAFLARSSLDAASGSHLIEDVRLAFGAFGSEHAIRASKVEEFLKGKLVSASVILEAVRLLKGVVSPAEGTTHPEYRVSLAVSYLFRFLSSLANGLDDKPENANNVPNGSCTTNGNTNGSAESTVDSFDLPIKSRQEMVFSDEYKPVGKPIKKVGAELQASGEAVYVDDIPAPKDCLYGAFIYSTHPHAHIKGVNFRSSLASQKVITVITAKDIPTGGENVGSCFPLLGDEHFLLIQLLNSLIAETQKYAYMAARQAVIEYNTENLQPPILTVEDAVQHNSYFQVPPFLQPKPIGDFNQAMSEADHKIIDGEVKLGSQYYFYMETQTALAFPDEDNCITVYCSAQMPEVTQDIVARCLGVPFHNVRIITRRVGGGFGGKAMKATHVATACAVAAFKLRRPVRMYLDRKTDMIMAGGRHPMKAKYSVGFKSDGKITALHLDLKINAGISPEFSPAIPYAIVGALKKYNWGALAFDIKVCKTNVSSKSAMRAPGDAQGSFIAEAIVEHVASTLSVATNTIRRKNLHDLESLKVFFGDSAAGEASTSSYSLVTIFDRLASTPEYQRRAAMVEQFNGSSRWKKRGISCVPITYSVTLRPSPGKVSILNDGSIAVEVGGVEIGQGLWTKVKQMTAFALGQLCDDGGEGLLDNVRVIQADTLSMIQGGWTAGSTTSETSCEAVRKSCAALVERLKPIKEKAGTLPWKSFIAQASMASVKLTEHAYWTPDPTFTSYMNYGAATSEVEVDVLTGATTILRSDLVYDCGQSLNPAVDLGQVEGAFVQGVGFFTNEEYATNADGLVIHDGTWTYKIPTVDTIPKQFNVELINTARHHSRVLSSKASGEPPLLLASSVHCAMREAIRAARREFAAVGGGTGGSDQVTSFQMDVPATMPAVKELCGLDVVERYLESFSATTA

SEQ ID NO: 7007 - DNA, 4071 bp, Oryza sativa subsp
  CDS (1)..(4071)
atggattcgccgccgccgccgcgggaggaggtggtggtgggtgcggggcgtgcgtggtggtggtctcggcgtacgacgcggaggccgacgaggtggcgcacgcggcggtcagctcgtgcctcacgctggcgcgcggccttcaacaacgcgccggtgaccaccacccgaggggctccgggagcagccggcgcggcctccacgcgctgcaccgagcggctcgccggcttccacgcctcgcagtgcgggttctgcacgcccggcgtgtgcatgtccctcgccggcgcgctcgcggccgccgaggggaacgggaagaaggccgcctccgccgcggaggggttctcgaggctcacggcggccgaggcggagcgcgcggtggccgggaacctgtgccgctgcacggggtaccgaccgatcgccgacgcgtgcaagagcttcgccgccgacgtggacttggaggatttggggctcaactgcttctggaacaagggcgatgccactgccagtgtctccaagttgccgccttacaaggagaggagcatcgccgcgttcccggagttcttgaaggatgaaatcagatcttcattggggattgatcattccatttcgtcagcatctatggtggggagtgtgagctcttggtatcaacctaaaaatgtggaggagtattataagctgataggttctttgtcatcatcatctgataaaagtagaacaaaggtggttgtgggcaacacttcttctggtgtttacagggatgcagagctgtatgataggtacatagacttgagagccattccagaactgaattcggttagcaaggatgtcaagggtgttggcattggggctgcaatgtccatttctcaggtaatcgagattttacgaggagaaggcaacagctacaaggacgtggtgttttgcaagattgctgatcacatggagaaagtggcttctcagtttgtccggaacatggcgagcttgggtggaaatctgataatggctcagagggatgagtttgcctctgacattgcaacggttctgcttgctgctggttcatcactgtgcatccaggtatcatcagaaaggatgaatgtcacactggagcgattcctggacatggccccttgtgattgcaagacgttgctattaagaatttacattcctcactgcactccaagtggcatctcatcaagttctgaatctgtaaataagacaggagataaacctgcaagttccgtgctatttgagacataccgagcttccccacggcctattggaaatgctgtttcataccttaattctgcattcctggctaaattatcttcagatgaaacttcaggaaactgtatattggagaagctatgtttggcttttggtgcatatggaacacaacatgctgtcagggctacaaatgttgagagtctcttagtgggtaaacccatcactgcatcactcttactagaagcgtgcacggttctcaagaaaacaattgttccaggggaaggtacaagacatgctgcttacagatcaagcttagctgttgcctttctttttagttttctttatccaataaccaaaggaactttcaagcctgtagaggcggtccacctgaacggccatataatttctgataacaatggaaatatgaatcgtggacccgacacacatgttgatgtttcacctaaggagatcaataatgtgaaatctgatttacatggtaatgatcgcatacttgaatcatccaaacaggtcatcgagatcagtgaagactatctcccggttggcttaccagccaagaaagttggagcagaactacaagcctctggtgaggctatatatgtggatgacatcccttccccaaaagactgcctgcatggagcatttgtatatagcacaaaacctttagctcatgtgaagagcatagaactgaacccttctctcgagcagctaaaaactgtggcgattgttactgccaaggatattcctaaaggaggcagcaatgttggggccaacactatatttggacctgaacctctgtttggtgatccactcactcagtgggctggggaaccacttggtattgtggttgcagagacacaaaaaactgccaatatagctgccagtcgagcattggtcgactacagcatggaaaatttagatgctccaattttatcaattgaggaggctgtgagaagtagtagttattttgaaatcctaccatttcttcttccccaaaagattggtgatttctcaaaaggaatggaagaagctgaccagaaaatatattcaactgaggtgaaccttcactcgcagtattacttttacatggaaacacaaactgcgctagccatacctgaggaggataactgtatggtcgtgtatagctcaagccagtgcccggaggtagcacaagaaaccattgcaaaatgcctgggtttaccttgtcataatgtccgtgttattactagaagagttggtggtggctttggaggcaaagctgtcagatcgttaccagtggcaacagcttgtgcactttcagcatttaagttgcagcgtcctgtccgaatatatcttgatcgcaagactgacatgataatgactgggggccggcatcccatgaaaatacgctattctgtaggcttcaaatccgatgggaacatcacagcgctacatatagaattgttggtaaatgccggaataacccaggatgttagtccagtgattcctcacaatttcatagaggctctgaagaaatataattggggtgccttctcctatgatgcaagaatctgcaaaacaaacattgcaaccagatccgcaatgcggggtcctggagaagtgcagggttcttatgttgctgaagctattattgagcatgttgctgctgtgctctctactgatgttaatttggtcaggcagagaaatcttcacacagtggagagcctcagtttgtatcatagtgaatgcatggaagatgccttggggtatacacttccctctatctgcaatcagttgattacatcagcaaattaccagcaccaacttgaaatgattcggtccttcaacaaaagcaacagatggaaaaagcgggggctttctgtcgtgccgatagtgcataaattcgcatctcggccaacgcctggtaaagtgtctattcttaatgatggatccgttgctgttgaagttggaggcattgaacttggccaagggctttggacaaaagtgaagcagatggcagcgttcggtcttggacagctttggactgatagaaggcaagaactgttggagagagtgagaattattcaagcagatacactaagtgtgatacagggagggtggaccacagggagtacaacatcagaatctagctgcgaggcagttcatcgtgcctgcaatatcttggtcgacaggctgaaaccactcaaggagcaattgcaagaaaaacaaggaacagtttcatgggatgagcttatttcacaggcaaaaatggtaggtgtggacttatcagctaaagaactctacgttcccggggcttctggttcctatctaaactatggggcagctgctagtgaggtagagattgatcttctgacaggagcgaccacaattttgcgtagtgatcttatatatgattgtggacggagtttaaatcctgctgttgacttggggcaggttgaaggggcttttgtccagggaattggttatttcatgaacgaggagtacgtgacgaactcagatgggctgcttgtctcagacgggacttggacatacaagattcctacggtggacaccatcccaaaacagttcaacgttaagctactcaacagtggattccacaagaaacgtgtgctctcttcaaaagcttctggggagccacctttgctacttgctgcctcggtgcattgtgcaacaagggaagcaattagagcagcaagggaggagtatcactgttccaggtctggatcttcacctcccttctttgatcttgaagttcctgccatcatgcccacggtgaaggagctatgcggcttagacaacgtggagaagtatttggagagtatctgctcgaaataa

SEQ ID NO: 7008 - protein, 1356 aa, Oryza sativa subsp
MDSPPPPREEVVVGAGRAWWWSRRTTRRPTRWRTRRSARASRWRAAFNNAPVTTTRGAPGAAGAASTRCTERLAGFHASQCGFCTPGVCMSLAGALAAAEGNGKKAASAAEGFSRLTAAEAERAVAGNLCRCTGYRPIADACKSFAADVDLEDLGLNCFWNKGDATASVSKLPPYKERSIAAFPEFLKDEIRSSLGIDHSISSASMVGSVSSWYQPKNVEEYYKLIGSLSSSSDKSRTKVVVGNTSSGVYRDAELYDRYIDLRAIPELNSVSKDVKGVGIGAAMSISQVIEILRGEGNSYKDVVFCKIADHMEKVASQFVRNMASLGGNLIMAQRDEFASDIATVLLAAGSSLCIQVSSERMNVTLERFLDMAPCDCKTLLLRIYIPHCTPSGISSSSESVNKTGDKPASSVLFETYRASPRPIGNAVSYLNSAFLAKLSSDETSGNCILEKLCLAFGAYGTQHAVRATNVESLLVGKPITASLLLEACTVLKKTIVPGEGTRHAAYRSSLAVAFLFSFLYPITKGTFKPVEAVHLNGHIISDNNGNMNRGPDTHVDVSPKEINNVKSDLHGNDRILESSKQVIEISEDYLPVGLPAKKVGAELQASGEAIYVDDIPSPKDCLHGAFVYSTKPLAHVKSIELNPSLEQLKTVAIVTAKDIPKGGSNVGANTIFGPEPLFGDPLTQWAGEPLGIVVAETQKTANIAASRALVDYSMENLDAPILSIEEAVRSSSYFEILPFLLPQKIGDFSKGMEEADQKIYSTEVNLHSQYYFYMETQTALAIPEEDNCMVVYSSSQCPEVAQETIAKCLGLPCHNVRVITRRVGGGFGGKAVRSLPVATACALSAFKLQRPVRIYLDRKTDMIMTGGRHPMKIRYSVGFKSDGNITALHIELLVNAGITQDVSPVIPHNFIEALKKYNWGAFSYDARICKTNIATRSAMRGPGEVQGSYVAEAIIEHVAAVLSTDVNLVRQRNLHTVESLSLYHSECMEDALGYTLPSICNQLITSANYQHQLEMIRSFNKSNRWKKRGLSVVPIVHKFASRPTPGKVSILNDGSVAVEVGGIELGQGLWTKVKQMAAFGLGQLWTDRRQELLERVRIIQADTLSVIQGGWTTGSTTSESSCEAVHRACNILVDRLKPLKEQLQEKQGTVSWDELISQAKMVGVDLSAKELYVPGASGSYLNYGAAASEVEIDLLTGATTILRSDLIYDCGRSLNPAVDLGQVEGAFVQGIGYFMNEEYVTNSDGLLVSDGTWTYKIPTVDTIPKQFNVKLLNSGFHKKRVLSSKASGEPPLLLAASVHCATREAIRAAREEYHCSRSGSSPPFFDLEVPAIMPTVKELCGLDNVEKYLESICSK

SEQ ID NO: 7009 - DNA, 3846 bp, Vitis vinifera
  CDS (1)..(3846)
atggggtcgttgaaaaatgaagaggaattggagggagttgaggaagggtcaaaggaagcaatcttgtatgttaatggggttcgcaaggtgttgcctgatgggttggctcatttgactcttctcgagtatcttagagacataggtctgacggggacaaagttgggctgtggcgaaggtggttgtggggcttgcactgtgatggtttcttattttgatgaaaattcgaagaaatgtgtgcattatgctgtcaatgcatgcttagcccctctgtattctgtcgaagggatgcatgtaattacagtggaggggattggaaaccgcagaaatggattgcatccaattcaggaatcattggccctctctcatgggtcacaatgcggattttgtactcctggtttcattatgtccatgtatgcgttattaaggtcaagtcagacaccacccagtgaagagcagatcgaagaaagccttgcaggaaatttgtgtagatgcacaggttacagaccgattattgatgcatttcgagtatttgccaaaactgatgattttatttgcccttcaactggtaagccctgttcatgtaaatcagggagttcaaatgataaggatgctgccaaatcaaatatgagttgtgttgatagcacatacaccgaaaaagagcttattttcccccctgagctgttattgaggaaattaactcctttgaatatgaatggatttggactaaaacatttgttggagttaaaagcaagatacccagatgcaaagttagtggtaggtaattccgaggtaggaattgaaatgaggttgaagagaatccagcatcaagttttgatctctgtcataaatatacctgaacttactatgttgagtgtgaaggatgatggcttggagataggtgctgcagttttggcagacccttgtaaggcctttattgaacagataaaatggtttgccgggacacagataaaaaatgttgcatcagttggtggaaatatttgtactgccagtccaatctcagatttgaatccgctctggatggctgcaggagcaaagttcagagtgataaattgtaaagggaatatcagaacagtcctggcagaaaatttcttcctgggttaccgtaaggtggatctggcgcatgatgaaattttactctcaatttttttaccatggactaggccttttgagtttgtgaaagaattcaagcaggctcatcgaagggatgacgatattgcaattgtaaatgctggaatgcgggtttatcttcaagaaaaggaagaaaagtgggtgatttggaaccgggaactattgcaggatgctttgaaaattttgcaaaagaacattttaatcaaggatgatgcaccaggtgggatggtggagtttcgaaaatctttaactctaagtttcttctttaaatttttcctatgggtttctcatcaaatggatgggcagagattcttcctggaaactgtaccaatatcacatctgtcagctgtacagccattccaccggccatcagactatgaagttgtaaaacatgggacagctgtggggtctcccgagattcatctttcatcgaaacttcaagttacaggggaggcagaatatgctgatgacatgccaatgcctccaaatggtctacatgctgctttagtattaagtagaaagcctcatgctcgtatcctttcaatagatgattcaggagcgaagtcttcacctgggtttgcaggaatattttttcataaagatgtgccaggtggtaatgctattggaccagttgttaacgatgaggaaatatttgcttcagaatttgtcacttttgtgggacaggtaataggagtagttgttgctgatacacaagaaaatgcaaaactagcggcaagaaaagttcatgttaaatatgaagagctcccagcgatcttatcaatagaggatgccctcaaagctaaaagtttccttcctaatacagagaggcatatagagaaaggggacgttgacctctgttttcaatcaggctgttgtgataagatcttagagggtgaagtccatgtaggaggccaggaacacttctatttggagacaaacagcagtttagtgtggacaacagatagcgggaatgaagttcacatgatatcatccactcaatgtccccagaagcatcagaaatatgtttctcatgttcttggtcttccaatgtcaaaagtagtttgcaaaaccaagcgaatcggtggtggatttggggggaaagagactaggtcagcttgctttgctgctgtggcttgtgttccatcatatctgttgaatcggccagtgaaactcacattagatagagacatagacatgatgatatctgggcagcgccatacctttcttggaaagtacaaggtcggatttacaaatgatgggaaggttcaggctttggatcttgaaatctacaacaatggtggaaactcgctggacctgtctggtgctgtccttgaacgtgctatgttccattcagataatgtttatgatataccaaatgtcaggatcaatggaaaggtttgcttaactaattttcctagtcacactgctttccgaggatttggtggtcctcagggtatgctcatcactgaaaattggattcaaagaattgccacagaacttaagaaaagcccagaagagataagggagattaattttcaaagtgaaggatgtgttacacactatggtcaacaactccaacacttcacactgccccgggtttggaatgaactgaagtcatcgtgtgagtttttaaaggctcggggcgaagttgaccagtttaatcttcaaaatcggtggaagaaacgtggagttgctatggttccaacaaagtttggcatttcctttacaacaaagtttatgaaccaggcaggtgctttagttcatgtctatacagatggcactgttttagtgacacatgggggtgttgagatggggcaaggtttacatacaaaagttgctcaagttgctgcttcttccttcaatattccactcagttctgtatttatatcagagacaagtaccgacaaggttcctaattcaacaccaacagcagcttctgcaagttctgatatgtatggagctgcagttttagatgcttgcgagcaaataaaagcacggatggagccgatagcttcaaaacgtaattttagctctttcgctgagctggttactgcatgctatttggagcgaatagacctttcggctcatggattttatattacacctgatattcattttgattggaagactggcaaagggagcccattcagttacttcacctatggagcttcatttgctgaggttgaaattgatacattgacaggagattttcacactagggtggcaaatgttttcttggatcttggacattcgataaatccagccattgatgttggacagattgaaggagcatttgtgcaaggtctgggttgggttgccttagaagagctaaaatggggagatgcagctcacaaatggattccacctggttgcctgtacacatgtgggcctggaagttacaaaattccttctatcaatgatgtccccttaaaatttgatgtttcacttctgaagggtgctccaaatccaaaggccatccattcatccaaggctgtgggtgagcctccattttttctggcttcctctgtcttcttcgccatcaaagatgcaattgtggccgcacgaagagaagtggggaacaaagactggtttcctcttgataatccagcaacacctgagcgggtccggatggcttgtctagatgaatttgccatgcaatttgtcagctctgatttccgcccaaagcttagtgtttaa

SEQ ID NO: 7010 - protein, 1281 aa, Vitis vinifera
MGSLKNEEELEGVEEGSKEAILYVNGVRKVLPDGLAHLTLLEYLRDIGLTGTKLGCGEGGCGACTVMVSYFDENSKKCVHYAVNACLAPLYSVEGMHVITVEGIGNRRNGLHPIQESLALSHGSQCGFCTPGFIMSMYALLRSSQTPPSEEQIEESLAGNLCRCTGYRPIIDAFRVFAKTDDFICPSTGKPCSCKSGSSNDKDAAKSNMSCVDSTYTEKELIFPPELLLRKLTPLNMNGFGLKHLLELKARYPDAKLVVGNSEVGIEMRLKRIQHQVLISVINIPELTMLSVKDDGLEIGAAVLADPCKAFIEQIKWFAGTQIKNVASVGGNICTASPISDLNPLWMAAGAKFRVINCKGNIRTVLAENFFLGYRKVDLAHDEILLSIFLPWTRPFEFVKEFKQAHRRDDDIAIVNAGMRVYLQEKEEKWVIWNRELLQDALKILQKNILIKDDAPGGMVEFRKSLTLSFFFKFFLWVSHQMDGQRFFLETVPISHLSAVQPFHRPSDYEVVKHGTAVGSPEIHLSSKLQVTGEAEYADDMPMPPNGLHAALVLSRKPHARILSIDDSGAKSSPGFAGIFFHKDVPGGNAIGPVVNDEEIFASEFVTFVGQVIGVVVADTQENAKLAARKVHVKYEELPAILSIEDALKAKSFLPNTERHIEKGDVDLCFQSGCCDKILEGEVHVGGQEHFYLETNSSLVWTTDSGNEVHMISSTQCPQKHQKYVSHVLGLPMSKVVCKTKRIGGGFGGKETRSACFAAVACVPSYLLNRPVKLTLDRDIDMMISGQRHTFLGKYKVGFTNDGKVQALDLEIYNNGGNSLDLSGAVLERAMFHSDNVYDIPNVRINGKVCLTNFPSHTAFRGFGGPQGMLITENWIQRIATELKKSPEEIREINFQSEGCVTHYGQQLQHFTLPRVWNELKSSCEFLKARGEVDQFNLQNRWKKRGVAMVPTKFGISFTTKFMNQAGALVHVYTDGTVLVTHGGVEMGQGLHTKVAQVAASSFNIPLSSVFISETSTDKVPNSTPTAASASSDMYGAAVLDACEQIKARMEPIASKRNFSSFAELVTACYLERIDLSAHGFYITPDIHFDWKTGKGSPFSYFTYGASFAEVEIDTLTGDFHTRVANVFLDLGHSINPAIDVGQIEGAFVQGLGWVALEELKWGDAAHKWIPPGCLYTCGPGSYKIPSINDVPLKFDVSLLKGAPNPKAIHSSKAVGEPPFFLASSVFFAIKDAIVAARREVGNKDWFPLDNPATPERVRMACLDEFAMQFVSSDFRPKLSV

SEQ ID NO: 7011 - DNA, 3807 bp, Vitis vinifera
  CDS (1)..(3807)
atggagcagtctgaaccaactgtcaacgactgtctggttttttctgttaatggggagaggtttgaggtctccaccatccacccttccactactttgcttgaattcttgcgttctcacactcctttcaaaggtgccaagctcagctgtggtgaaggtggctgtggtgcttgtgttgttcttctgtccaagtatgaccctgtgcttgaccaggtggatgattttgcagtgagttcatgtcttacactgctttgcagtataaatggatgttcaattactacaactgaaggccttgggaacataaaaaatgggttccacccaattcatgaaaggttctctggattccatgcttctcagtgtggcttttgtactcctggaatgtgcatgtcattcttctcggctcttcggccagagccccctctgggattctccaagcttaaaggctattgcaggaaatctctgtcgctttttgcagcagatgttgatatggaggatttggggtttaattctttttggagaaagggagatagtaatgaagtgaaaataagcagcttacccttgtataaccataatgataagatttactctagaagatactcctggaataatcctgttagccttgaggaacttcaaagcttattggaaagctatgacaaatatattgatctaagatatatccctgaactctcaatgattagaagggataataatgggataaaaattggagcaactgtaacaatttctaaagctattgaagctctaagggaatacagcaaaggagacatggtctataaaaaaattgctgaccatatggaaaaaattgcttcagggttcatccggaactcagctagtctaggtggaaatcttgtgatggcacaaaggaaccattttccatctgacattgctacagtacttcttgcagtaggttcaacagtaaatataatgaatggtctcaaaagtgaagagcttacattggaggaattccaaaagtatactcttaagtgtcaaaatcctattacaggcatttcttccggggccaagatgaagttactgtttgaaacgtatcgagctgcaccacgacccctaggaaatgcattgccctatttaaatgctgctttaatggctgaagtttttcattgtaaaacttctaatgggattattataagtagctgccagtttgcttttggtgcttatgggactaaacatccaataagagctgcaaaagttgaagaatttttaactggaaaaatgctaagtgttggtgttctatatgaagctattaaattagttagaggcattgtggtacctgatgatggcacttcaagtccagcttacagggcaagcttggctgtcagttttctttttgagttctttagccatttggttgagcctaatcctgaatctcatgatgcttctgaactaaaaagaattagcaaccagttagatcatggtaaaatcccaaccttgctatctcctgcaaagcaggtagtggaattgaatagacagtatcatccagttggtgagccaattgcaaaatctggagctgcactccaagcttctggtgaggctgtttatgtggatgacattccttctccaatgaattgcctacacggggctttcatttatagtacgaagccttacgctcgagtaaagggtatcaaatttaagcctaaatcactgccagatggagtcagttcacttatttctttcaaagatatcccaggggagaacataggctctaaaactatatttggtattgagcctttatttgctgatgattttactcgatgtgccggacagtatattgcttttgtggttgcagacacacagaaacatgcagatatggctgcaaaccttgcagtggttgattatgatgtgggaaatttggaactgcccattttatctgtagaagaggctgttaggagatctagcttttttgaggttccttctatcttgaacccaaaaaaggttggtgatttctcgagaggaatggctgaagctgatcacaagattctctctgctgagatcaaacttgggtcacagtactatttctatatggagacacaaactgcccttgcaattccagatgaagacaactgcattgtggtttacagttcaatacaatgccctgaatatgcacatagtactatttcgagatgtcttggtattcctgaacataatgttcgtgtgatcacaagaagggttggaggtggttttggtggaaaggccataagagcaatgcctgttgctacagcatgtgcacttgcagcatacaaattacgccgccctgtccggatatatatgaatcgcaaaactgatatgataatagcaggaggaagacatccaatgaaaataacctatagtgtaggattcaaatctgatggcaagattactgccttacaccttgatatattaatcaatgcgggaatagctgcagatataagcccaattatgcctcacaaccttctgggtgcccttaaaaagtatgattggggtgctttatcttttgatataaaagtttgcaaaacaaaccattcgactaaatcagcaatgcgtgctcctggggaggtacaagctacatttatttctgaagctgtaattgaacatgtagcatctactctttccatggatgtggactctgtgagaagcaaaaacctccatactttcaacagcctcaaatttttctatgagggcagtgcaggtgaacctgttgattacactttaccttcaatctgggataagttggctagttcttcaagacttaaacaaagaactgaaatgataaagcagtttaatatgtgtaataaatggcagaaaagaggtatttctcaagtaccgattgtgcatgaagtttcattgaggccaactccagggaaagtaagcattcttagtgatggatctgttgctgttgaagttggagggattgagctaggccaggggctgtggaccaaagtgaaacagatggctgcatttgctctcagctcaattcagtgtgatggaatgggagacttcttggagaaagtaagggtcatacaatcagatacattaagcttaatacaggggggttttactgctggaagcactacatcagagtccagctgtgaagctattagactctgctgcaatattttggttgaaagactaactcctaccaaggaaagattgcaggagcaaatgggttctgttgaatggggcacactgattcttcaggcacaaagtcaagctgtgaacttatcagcaagttcttactatgtccctgacttttcttccatgaaatacctaaactatggtgctgctgtaatgtcacaggtggaggtaaatcttctcactggagaaaccaccattttgcaatctgatattatatatgactgtgggcagagcctcaaccctgctgtggatttaggacagatagaaggagcttttgtccaagggattgggttttttatgctcgaggaatacacaactaattcagagggactggtggtcactgaaggcacatggacatacaagatcccaacaattgacaccatacccaagcagttcaatgttgagatactgaacagcggacatcatacaaaacgtgttctttcttctaaagcttctggtgagccaccattacttctagcagtttcagttcactgtgctacaagggcagctattagagaagcccgacaacagcttctttcctggactgggctatgcaagtctgatttgacattccagttggaggtcccggcaacaatgcctgttgtgaagaatttgtgcggactggagaatgtggagagctacttacaaagcttgctctcttaa

SEQ ID NO: 7012 - protein, 1268 aa, Vitis vinifera
MEQSEPTVNDCLVFSVNGERFEVSTIHPSTTLLEFLRSHTPFKGAKLSCGEGGCGACVVLLSKYDPVLDQVDDFAVSSCLTLLCSINGCSITTTEGLGNIKNGFHPIHERFSGFHASQCGFCTPGMCMSFFSALRPEPPLGFSKLKGYCRKSLSLFAADVDMEDLGFNSFWRKGDSNEVKISSLPLYNHNDKIYSRRYSWNNPVSLEELQSLLESYDKYIDLRYIPELSMIRRDNNGIKIGATVTISKAIEALREYSKGDMVYKKIADHMEKIASGFIRNSASLGGNLVMAQRNHFPSDIATVLLAVGSTVNIMNGLKSEELTLEEFQKYTLKCQNPITGISSGAKMKLLFETYRAAPRPLGNALPYLNAALMAEVFHCKTSNGIIISSCQFAFGAYGTKHPIRAAKVEEFLTGKMLSVGVLYEAIKLVRGIVVPDDGTSSPAYRASLAVSFLFEFFSHLVEPNPESHDASELKRISNQLDHGKIPTLLSPAKQVVELNRQYHPVGEPIAKSGAALQASGEAVYVDDIPSPMNCLHGAFIYSTKPYARVKGIKFKPKSLPDGVSSLISFKDIPGENIGSKTIFGIEPLFADDFTRCAGQYIAFVVADTQKHADMAANLAVVDYDVGNLELPILSVEEAVRRSSFFEVPSILNPKKVGDFSRGMAEADHKILSAEIKLGSQYYFYMETQTALAIPDEDNCIVVYSSIQCPEYAHSTISRCLGIPEHNVRVITRRVGGGFGGKAIRAMPVATACALAAYKLRRPVRIYMNRKTDMIIAGGRHPMKITYSVGFKSDGKITALHLDILINAGIAADISPIMPHNLLGALKKYDWGALSFDIKVCKTNHSTKSAMRAPGEVQATFISEAVIEHVASTLSMDVDSVRSKNLHTFNSLKFFYEGSAGEPVDYTLPSIWDKLASSSRLKQRTEMIKQFNMCNKWQKRGISQVPIVHEVSLRPTPGKVSILSDGSVAVEVGGIELGQGLWTKVKQMAAFALSSIQCDGMGDFLEKVRVIQSDTLSLIQGGFTAGSTTSESSCEAIRLCCNILVERLTPTKERLQEQMGSVEWGTLILQAQSQAVNLSASSYYVPDFSSMKYLNYGAAVMSQVEVNLLTGETTILQSDIIYDCGQSLNPAVDLGQIEGAFVQGIGFFMLEEYTTNSEGLVVTEGTWTYKIPTIDTIPKQFNVEILNSGHHTKRVLSSKASGEPPLLLAVSVHCATRAAIREARQQLLSWTGLCKSDLTFQLEVPATMPVVKNLCGLENVESYLQSLLS

SEQ ID NO: 7013 - DNA, 3894 bp, Vitis vinifera
  CDS (1)..(3894)
atggagcagtctgaatcaactgtaaacaactgtctggtttttgctgttaatggaaagaggtttgaggtctccaccatccacccttccactaccgtgcttgagttcttgcgttctcacactcctttcaaaggtcccaagctcagctgcggtgaaggtggttgtggtgcttgtgttgttctactgtccaagtataaccctgtgcatgaccaggtggatgattgtacggtgagttcatgtcttaccctgctttgtagtgtaaatggatgttcaattacaacaactgaaggccttgggaacacgaaagatggattccacccaattcatgaaaggttctctggattccatgcttctcagtgtggcttttgtactcctggaatgtgcatgtcactcttctcggctcttccccctaggggattctccaagctgaaagtttctgaagctgaaacggctattgcaggaaatctctgccgctgtactggataccggcccattgctgatgcctgtaaaagttttgcagcagatgttgatatggaggatttgggtaaagaagtgaaactaagcagcttacccctgtataaccataatgatgagatctgtacatttcctcagttcttgaaaaatgaaactagatattcctggtataatcctgttaccattgaggaacttcaaagcttattgggttttgttgaggatggaaatgggactcgggttaaattagtggttggtaacactggtatgggttattacaaggaagtggaaagctacgacaaatatattgatctaagacatatccctgaattctcaacgattagaagggataataccgggataagcattggagcaactataacaatatctaaagctattgaagctctaagggaatacaaccaaagagacatggtctataaaaaaattgctgaccatatggaaaaagttgcttcagggttcatccggaactcagctagtttaggtggaaatctggtgatggcacaaaggaatcatttcccctccgacattgctacagtacttcttgcagtaggttcaactgtaaatataatgaatagtctcaaaagcgaagagcttacattggaggagttcttaagaaggccagagttagattcgaaaagcgtcaaaatcccagattgggatcggattatgggcatttcttcagggaccgagatgaagttactgtttgaaacttatcgagctgcaccacggccgttaggaaatgcattgccctatttaaatgctgctttaatggctaaagtttctcgctgtacaacttctattggcattatttttgcttttggtgcttatgggacaaaacatccaataagagcgacaaaagttgaagaatttttaactggaaaagtgctaagtgttggtgttctatgtgaggctgttaaattacttagaggcattgtggtacctgatgatggcacttcaagtccagcttataggtcaagcttggctgtcagttttctttttgagttctttagccatttggttgatactttgctgtctcctgcaaagcagttagatcatggtaaaatctcaaccttgctatcttctgcaaagcaggaagtggaattgaacagacagtatcgtccagttggtgagccaattgcaaagtctggggctgccatccaagcttctggggaggctgtttatgtggatgacattccctctccaacaaattgcctacatggggctttcatttatggtacaaagcctttggctcgagtaaagggtatcaaacttaaccccaaatcagtggcagctggagtcagtgcacttatttcttttaaagatatcccaggggagaacataggctgtaaaactatgtttggtactgaacctttatttgcagatgattttacccgatgtgctggagagtatattgcttttgtggttgcagacacacagaaacatgcaaatatggctgcaaaccttgcagtgatcgattatgacatggaaaatctggaaccacccattttatcggtagaagaggctgttaggagatctagcttttttgaggttccttccatcattagcccaaaacaggttggtgatttctctagaggaatggctgaagcagatcacaagattctctctgctgagatcagacttgggtcacagtattatttctatatggagacacaaactgcccttgcagttcccgatgaagacaactgcattgtggtttacagttcaatacaatgccctgaaaatgcacatactacgatttcgagatgtcttggtattcctgaacacaatgtccgtgtgatcacaagaagggttggaggtggttttggtggaaaggccatgaaagcaattgctgtagctacagcatgtgcacttgcagcatacaaattacaacgccctgtccggatatatatgaatcgcaaaactgacatgaaaatagctggaggaagacatccaatgaaagtaacctacagtgtagggttcaaatcgaatggaaagattactgccttacacgttgatatattaatcaacgcaggaatgggtgtagatataagcccagctatgcctatgctcatggttggtgcccttaaaaaatatgattggggtgctttttcttttgatataaaggtttgcaaaacaaaccatttgtctaaatcagcaatgcgtgctcctggggaggtacaagctacatttatatctgaagctgtaattgaacatgtcgcatctactctttccatggatgtggactctgtgagaagcggaaacctccacactttcaacagcctcaattttttctttgagggctgtgctggtgaacctgtggagtacactttacctttaatctgggataagttggctacttcttcaagttttaaagaaaggactgatatggtaaagcagtttaatatgtgcaataaatggcagaaaaggggtatttctcgagtaccaattgtgcatgaaatttcattaaaagcaactccagggaaagtaagcattcttagcgatggatctgttgctgtggaagttggggggattgagttggggcagggactgtggacaaaggtgaaacagatgactgcatttgccctcagttcaattggatgtgatggaatgggagacttcttggagaaagtaagggtcatacaatcagataccctaagtttaatacagggggggttgactactgcaagcactacatcagagtgcagctgtgaagctattagactctgctgcaatatgttggttaaaagactgactcctatcaaggagagattgcaggagcaaatgggttctgttgaatggggcacattgattcttcaggcacaaagtcaagctgtgaacttatcagcaagttcttactatgtccctgacttttcttcctttcaatacctaaactatggtgcagcagtggaggtaaatcttctcactggacaaaccacaattttgcaatctgatattatatatgactgtggtcagagtctcaaccctgctgtggatttaggacagatagaaggagcttttgttcaaggaattgggttttttatgctcgaggagtacacaactaattcagatggactggtggtcaccgaaggcacatggacttacaagatcccaacaatcgacacaatacccaagcagttcaatgttgaggtactgaacagcggacatcataaaaatcgtgttctttcttctaaagcttctggtgaaccaccgttactcctagctgtttcagttcattgtgctacaagggcagctattagagaagcccggcaacagcttctttcctggactgggctaaccaagtgtgattcaacattccagttggaggtcccggcaacaatgcctgttgtgaaggagctctgtggactggagaatgtggagagttacttgcaaagcttgctctcttaa

SEQ ID NO: 7014 - protein, 1297 aa, Vitis vinifera
MEQSESTVNNCLVFAVNGKRFEVSTIHPSTTVLEFLRSHTPFKGPKLSCGEGGCGACVVLLSKYNPVHDQVDDCTVSSCLTLLCSVNGCSITTTEGLGNTKDGFHPIHERFSGFHASQCGFCTPGMCMSLFSALPPRGFSKLKVSEAETAIAGNLCRCTGYRPIADACKSFAADVDMEDLGKEVKLSSLPLYNHNDEICTFPQFLKNETRYSWYNPVTIEELQSLLGFVEDGNGTRVKLVVGNTGMGYYKEVESYDKYIDLRHIPEFSTIRRDNTGISIGATITISKAIEALREYNQRDMVYKKIADHMEKVASGFIRNSASLGGNLVMAQRNHFPSDIATVLLAVGSTVNIMNSLKSEELTLEEFLRRPELDSKSVKIPDWDRIMGISSGTEMKLLFETYRAAPRPLGNALPYLNAALMAKVSRCTTSIGIIFAFGAYGTKHPIRATKVEEFLTGKVLSVGVLCEAVKLLRGIVVPDDGTSSPAYRSSLAVSFLFEFFSHLVDTLLSPAKQLDHGKISTLLSSAKQEVELNRQYRPVGEPIAKSGAAIQASGEAVYVDDIPSPTNCLHGAFIYGTKPLARVKGIKLNPKSVAAGVSALISFKDIPGENIGCKTMFGTEPLFADDFTRCAGEYIAFVVADTQKHANMAANLAVIDYDMENLEPPILSVEEAVRRSSFFEVPSIISPKQVGDFSRGMAEADHKILSAEIRLGSQYYFYMETQTALAVPDEDNCIVVYSSIQCPENAHTTISRCLGIPEHNVRVITRRVGGGFGGKAMKAIAVATACALAAYKLQRPVRIYMNRKTDMKIAGGRHPMKVTYSVGFKSNGKITALHVDILINAGMGVDISPAMPMLMVGALKKYDWGAFSFDIKVCKTNHLSKSAMRAPGEVQATFISEAVIEHVASTLSMDVDSVRSGNLHTFNSLNFFFEGCAGEPVEYTLPLIWDKLATSSSFKERTDMVKQFNMCNKWQKRGISRVPIVHEISLKATPGKVSILSDGSVAVEVGGIELGQGLWTKVKQMTAFALSSIGCDGMGDFLEKVRVIQSDTLSLIQGGLTTASTTSECSCEAIRLCCNMLVKRLTPIKERLQEQMGSVEWGTLILQAQSQAVNLSASSYYVPDFSSFQYLNYGAAVEVNLLTGQTTILQSDIIYDCGQSLNPAVDLGQIEGAFVQGIGFFMLEEYTTNSDGLVVTEGTWTYKIPTIDTIPKQFNVEVLNSGHHKNRVLSSKASGEPPLLLAVSVHCATRAAIREARQQLLSWTGLTKCDSTFQLEVPATMPVVKELCGLENVESYLQSLLS

SEQ ID NO: 7015 - DNA, 4077 bp, Zea mays
  CDS (1)..(4077)
atggggaaggaggcaggggcagcggagtcgtcgacggtggtgctggccgtcaacggcaagcgctacgaggcggccggcgtggctccgtccacgtcgctgctggagttcctccgcacccagacgcccgtcagaggccccaagctcggctgcggcgaaggtggctgcggtgcatgcgtggtcctcgtctccaagtacgacccggccacggacgaggtgaccgagttctctgccagctcctgcctgacgctgctccacagcgtggaccgctgctcagtgaccaccagcgagggaatcggcaacaccagggatggctaccaccccgtgcagcagcgcctctccggcttccacgcctcgcagtgcggcttctgcacacccggcatgtgcatgtccatcttctccgcccttgtcaaggccgacaacaagtccgatcgcccggaccctcctgctggcttctccaagatcactacctcggaggcagagaaggctgtctcgggcaacctttgtcgttgcaccggatacagacccattgttgacacctgcaaaagctttgcctctgatgttgacctcgaggacctaggcctcaactgtttctggaagaagggcgaagaacctgcagaagtcagcaggctgccggggtacaacagcggtgccgtctgcacctttccagagtttctcaaatccgaaatcaagtctactatgaagcaggtgaacgatgtccccattgcagcctcaggtgatggctggtaccatcctaagagcattgaagagcttcacaggttgtttgattccagctggtttgatgacagttctgtgaagattgttgcttcaaacactgggtctggagtgtacaaggatcaggacctctacgacaagtacattgacatcaaaggaatcccagagctttcagtcatcaataaaaacgacaaagcaattgagcttggatcagttgtgtccatctctaaagctattgaagtgctgtcagatggaaatttggtcttcagaaagattgctgatcacctcaacaaagtggcttcaccgtttgttcggaacactgcaaccataggaggaaacataatgatggcacaaaggttgccatttgaatcggatgttgcaaccgtgctcctagctgcgggttcgacagtcacagtccaggtggcttccaaaaggctgtgcttcactctggaggaattcttggaacaacctccatgtgattctaggaccctgctgctgagcatatttatcccagaatggggttcagactatgtcacctttgagactttccgagccgccccacgaccatttggaaatgctgtctcttatgtaaactctgctttcttggcaaggacatcaggcagccttctaattgaggatatatgcttggcatttggtgcctacggagtcgatcatgccatcagagctaagaaggttgaagatttcttgaagggaaaatcgctgagctcatttgtgatacttgaagcaattaaactactcaaagataccgtttcaccatcagaaggcactacacatcatgaatacagggtcagcttggctgtcagtttcttgttcagtttcttatcttcccttgccaacagttcgagtgcaccatcaaatattgatactcccaatgggtcatatactcatgaaactggtagcaatgtggactcacctgagaggcatattaaggttgacagcaatgatttgccaattcgttcaagacaagaaatggttttcagcgatgagtacaagcctgttggcaagccgatcaagaaagtcggggcagagatccaagcatcaggggaggctgtgtacgttgatgatatccctgctcccaaggattgcctctatggagcatttatctacagcacacatcctcatgctcatgtgagaagtatcaacttcaaatcatccttggcttcacagaaggtcatcacagttataaccgcaaaggatattccaagcggtggagaaaatattggaagcagcttcctgatgcaaggagaagcactatttgcagatccaatcgctgaatttgctggtcaaaatattggtgtcgtgattgctgaaacacaaagatatgctaatatggctgcaaagcaagctgttgttgagtatagcacagaaaatctgcagccaccaattctgacaatagaagatgccatccaaagaaacagctacatccaaattcccccatttttagctccaaagccagttggtgactacaacaaagggatggctgaagcagaccacaagattctatcagcagaggtaaaacttgaatcccagtactacttctacatggaaactcaagcagcactagcgattcctgatgaagataactgcataacaatctattcctcgacacaaatgcctgagctcacacaaaatttgatagcaaggtgtcttggcattccatttcacaatgtccgtgtcatcagcagaagagtaggaggaggctttggtggaaaggcaatgaaagcaacgcatactgcatgtgcatgtgcccttgctgccttcaagctgcggcgtccagttaggatgtacctcgatcgcaagacggacatgataatggctggagggagacatccaatgaaggcgaagtactctgttgggttcaagtcagatggcaagatcacagccttgcacctagatcttggaatcaatgctggaatatcaccagatgtgagtccattgatgccacgtgctatcataggagctctcaaaaagtacaactggggcactcttgaatttgacaccaaggtctgcaagacaaatgtctcatcaaagtcagcaatgcgagctcctggagatgtgcagggctctttcatcgctgaagccatcatcgagcatgttgcctcagcactcgcactagacactaacaccgtcaggaggaagaaccttcatgattttgaaagccttgaagttttctatggagaaagtgcaggtgaagcttctacatacagcctggtttccatgtttgacaagctggccttgtctccagaataccagcacagggctgcaatgattgagcagttcaatagcagcaacaaatggaagaaacgcggcatttcttgtgtgccagccacttatgaggttaatcttcgaccaactccaggcaaggtgtcaatcatgaatgatggttccatcgctgtcgaggttggaggaattgagataggtcaaggattgtggactaaagtgaagcagatgacggcctttggactgggacagctgtgtcctgatggtggcgaatgccttctggacaaggttcgggttatccaggcagacacattaagcctgatccaaggaggtatgactgctgggagcaccacttctgaaactagctgtgaaacagttcggcaatcttgtgttgcactggttgagaagctgaaccctatcaaggagagtctcgaagctaagtccaacacagtggaatggagtgccttgattgctcaggcaagcatggcgagtgtgaacctatcagcacagccgtactggactcctgatccatctttcaagagctacttgaactacggagctggcaccagtgaggtggaagttgatatcctaacaggagcaaccacaattctgcgaagcgacctggtgtatgactgcgggcagagcctaaaccctgctgtagacttgggccagatcgagggctgctttgtccaaggaatagggttcttcacgaacgaggactacaagacgaattccgacgggttggtcatccacgacggcacatggacgtacaagatccccacggtggataatatcccgaaggagttcaatgttgagatgtttaacagcgcccctgacaagaagcgtgtcctatcttccaaagcgtcgggcgagccgccgctggttctcgcaacctcggtgcactgcgcgatgagggaggccatcagggcggcgaggaaggagttctcggtcagcaccagccccgcgaaatccgccgtcacattccagatggacgtgccggcgacgatgcctgtcgtcaaggagctctgcggcctcgacgtcgtggagaggtacctcgagaacgtgtctgccgccagtgccggcccaaacacagcgaaagcatag

SEQ ID NO: 7016 - protein, 1358 aa, Zea mays
MGKEAGAAESSTVVLAVNGKRYEAAGVAPSTSLLEFLRTQTPVRGPKLGCGEGGCGACVVLVSKYDPATDEVTEFSASSCLTLLHSVDRCSVTTSEGIGNTRDGYHPVQQRLSGFHASQCGFCTPGMCMSIFSALVKADNKSDRPDPPAGFSKITTSEAEKAVSGNLCRCTGYRPIVDTCKSFASDVDLEDLGLNCFWKKGEEPAEVSRLPGYNSGAVCTFPEFLKSEIKSTMKQVNDVPIAASGDGWYHPKSIEELHRLFDSSWFDDSSVKIVASNTGSGVYKDQDLYDKYIDIKGIPELSVINKNDKAIELGSVVSISKAIEVLSDGNLVFRKIADHLNKVASPFVRNTATIGGNIMMAQRLPFESDVATVLLAAGSTVTVQVASKRLCFTLEEFLEQPPCDSRTLLLSIFIPEWGSDYVTFETFRAAPRPFGNAVSYVNSAFLARTSGSLLIEDICLAFGAYGVDHAIRAKKVEDFLKGKSLSSFVILEAIKLLKDTVSPSEGTTHHEYRVSLAVSFLFSFLSSLANSSSAPSNIDTPNGSYTHETGSNVDSPERHIKVDSNDLPIRSRQEMVFSDEYKPVGKPIKKVGAEIQASGEAVYVDDIPAPKDCLYGAFIYSTHPHAHVRSINFKSSLASQKVITVITAKDIPSGGENIGSSFLMQGEALFADPIAEFAGQNIGVVIAETQRYANMAAKQAVVEYSTENLQPPILTIEDAIQRNSYIQIPPFLAPKPVGDYNKGMAEADHKILSAEVKLESQYYFYMETQAALAIPDEDNCITIYSSTQMPELTQNLIARCLGIPFHNVRVISRRVGGGFGGKAMKATHTACACALAAFKLRRPVRMYLDRKTDMIMAGGRHPMKAKYSVGFKSDGKITALHLDLGINAGISPDVSPLMPRAIIGALKKYNWGTLEFDTKVCKTNVSSKSAMRAPGDVQGSFIAEAIIEHVASALALDTNTVRRKNLHDFESLEVFYGESAGEASTYSLVSMFDKLALSPEYQHRAAMIEQFNSSNKWKKRGISCVPATYEVNLRPTPGKVSIMNDGSIAVEVGGIEIGQGLWTKVKQMTAFGLGQLCPDGGECLLDKVRVIQADTLSLIQGGMTAGSTTSETSCETVRQSCVALVEKLNPIKESLEAKSNTVEWSALIAQASMASVNLSAQPYWTPDPSFKSYLNYGAGTSEVEVDILTGATTILRSDLVYDCGQSLNPAVDLGQIEGCFVQGIGFFTNEDYKTNSDGLVIHDGTWTYKIPTVDNIPKEFNVEMFNSAPDKKRVLSSKASGEPPLVLATSVHCAMREAIRAARKEFSVSTSPAKSAVTFQMDVPATMPVVKELCGLDVVERYLENVSAASAGPNTAKA

SEQ ID NO: 7017 - DNA, 4050 bp, Zea mays
  CDS (1)..(4050)
atggagatggggaaggcggcggcggtggtgctggcggtgaacggcaagcggtacgaggccgccggcgtggacccgtcgacgacgctgctggagttcctgcgcacccacacgcccgtcagggggcccaagctcggctgcggcgaaggtggctgcggtgcatgcgttgtgcttgtctcgaagtacgacccagccaccgacgaggtgaccgagttctcagcgagctcctgcctgacgctgctccatagcgtggaccgctgctcggtgaccaccagcgagggcattggcaacaccaaggatggctaccaccctgtgcagcagcgcctctccggcttccacgcctcccagtgcggtttctgcacgcccggcatgtgcatgtccatcttctctgcgcttgtcaaagccgacaaggcggccaaccggccagccccaccggccggcttctccaagctcacttcctcggaggctgagaaggctgtctctggcaacctgtgccgctgcacagggtacaggcccatcgtcgacgcctgtaagagcttcgcagccgatgttgatcttgaggacctgggcctcaactgcttctggaagaagggtgatgagcctgcagatgtcagcaagctgccaggctacaacagtggtgacgtctgcactttccctgactttctcaaatctgagatgaagtcctcaattcagcaggctaacagcgctccagttcctgtttctgacgacggctggtaccgtcctaggagcattgacgagcttcacaggttgtttcaatctagctccttcgatgaaaattccgtgaagatagtggcttcaaacactgggtctggagtgtacaaggatcaggacctttatgacaagtacattgacatcaaaggaatcccagagctttcagtcatcaacagaaacgacaaaggaattgagcttggatcagttgtgtccatctctaaagctattgaggtgctgtcagatggaaatctcgtcttcagaaagattgctggtcacctgaacaaagtggcttcaccgtttgttcggaacactgcaaccataggtggaaacatagtcatggcacaaagattgccattcgcatcggacattgcaaccatactactagctgcaggttcaacagtcacaatccaggtggcttccaaaaggctgtgcttcactctggaggagttcttgcagcagcctccatgcgattctaggaccctgctgctgagcatatttatcccggaatggggctcaaatgatgtcacctttgagactttccgagcagcacctcgtccacttggcaatgctgtctcatatgtcaattcagctttcttggcaaggacttcattggatgcagcatcaaaggaccatctcatcgaggatatatgtctggcgttcggtgcttatggagctgatcatgctattagagctagaaaggttgaggattacctgaagggcaaaacagtgagctcgtctgtcatacttgaagctgttcggttgcttaaagggtctattaaaccatcagaaggctcaacacatcctgagtatagaattagcttggctgtcagtttcttgtttaccttcctatcctcccttgccaacagcttgaatgaatctgcaaaggttagtggtaccaacgagcactcaccagagaagcaactcaagttggacatcaatgatttgccaatacgatcaagacaagaaatatttttcactgatgcatataagccagttggcaaagcaattaagaaagctggggtagagatccaagcttcaggggaagctgtgtacgttgatgatatccctgctcccaaagattgcctctatggggcatttatttatagcacacaccctcatgcacatgtaaagtcaatcaactttaaaccatctttggcttcacagaagatcatcacagttatcactgcaaaggatattcccagcggtggacaaaatgttggttatagcttcccgatgattggagaagaagcactttttgcagatccagttgctgaatttgctggtcaaaatattggtgtcgtgattgctcaaacacagaagtatgcctacatggcggcaaagcaagccatcattgagtatagcacagaaaatctgcagccaccaattctgacaatagaagatgcaattgaacgaagcagcttcttccaaaccctcccatttgtagctcctaagccagttggtgattacgacaaagggatgtctgaagctgatcacaagattttatcggcagaggtaaaaattgaatcccaatactttttctacatggagccacaagtggcgctagctattcctgatgaagataactgcataaccatctatttttcgacacaattacctgagtccacacaaaatgtggttgcaaagtgcgttggcattccatttcacaatgtccgtgtaatcaccagaagggtcggaggaggctttggtggaaaagcattgaaatcaatgcatgttgcatgtgcatgtgcagttgctgcattgaagctacaacgtccagttcggatgtacctcgatcgcaagacagacatgataatggcaggcgggcggcatcctatgaaggtgaagtactctgttgggttcaagtcaaacggcaagatcacagccttacatcttgatcttgggatcaatggtggaatatctccagatatgagtccaatgattgcagcacctgtcataggttctctcaaaaagtacaactggggcaatcttgcatttgacaccaaggtctgcaaaacaaatgtctcatcaaaatcgtcaatgagagctcctggagatgcgcagggctctttcattgctgaagccatcatcgagcatgttgcctcggcactttcagccgacactaataccataaggagaaagaaccttcatgactttgagagccttgcagtgttctttggagatagtgcaggtgaagcttctacatacagccttgtcaccatgttcgataaattggcctcctctccagaataccagcaccgagctgaaatggtggaacaattcaaccgaagcaacaagtggaagaagcgtggcatttcttgtgtgcctgtaacatatgaggtgcagcttcggccaactccaggaaaggtgtctatcatgaatgatggttccattgctgttgaggttggaggggttgagctaggccaagggttgtggacaaaagtgaagcagatgacggcattcggactaggacagctgtgtcctggcggcggtgaaagccttctagacaaggtgcgggtcatccaggccgacacattgagcatgatccaaggaggggtcactggtgggagcaccacttctgaaactagctgtgaagcagttcgtaagtcgtgtgttgcactcgtcgagagcttgaagccaatcaaggagaatctggaggctaaaactggcacagtggaatggagtgccttgattgcacaggcaagtatggcgagcgttaacttatcggcacatgcatactggacccctgatccaactttcacaagctatttgaactacggagccggcactagcgaggtggaaattgatgtcctgacaggagcaacaacaattctaaggagtgaccttgtctacgattgcgggcaaagcttgaaccctgctgtcgatttggggcaggtggaaggtgcattcgtacaaggagtaggcttcttcacaaacgaggagtacgcaaccaactctgacgggttggtcatccacgatggcacatggacgtacaagatccccacggtcgacaccatcccaaagcagttcaacgttgagctgatcaacagcgcccgtgaccagaagcgcgtcctctcttccaaagcatcgggcgagcctccgcttctcctagcttcctctgtgcactgcgcaatgagggaggccatcagggccgccaggaaagaattctcggtctgcactggtccagcgaactccgccatcacgttccagatggacgtgccggcaacgatgcctgtcgtcaaggagctctgcggcctggatgtcgttgagaggtacctggagagcgtgtcggctgccagcccaacaaacaccgctaaagcatag

SEQ ID NO: 7018 - protein, 1349 aa, Zea mays
MEMGKAAAVVLAVNGKRYEAAGVDPSTTLLEFLRTHTPVRGPKLGCGEGGCGACVVLVSKYDPATDEVTEFSASSCLTLLHSVDRCSVTTSEGIGNTKDGYHPVQQRLSGFHASQCGFCTPGMCMSIFSALVKADKAANRPAPPAGFSKLTSSEAEKAVSGNLCRCTGYRPIVDACKSFAADVDLEDLGLNCFWKKGDEPADVSKLPGYNSGDVCTFPDFLKSEMKSSIQQANSAPVPVSDDGWYRPRSIDELHRLFQSSSFDENSVKIVASNTGSGVYKDQDLYDKYIDIKGIPELSVINRNDKGIELGSVVSISKAIEVLSDGNLVFRKIAGHLNKVASPFVRNTATIGGNIVMAQRLPFASDIATILLAAGSTVTIQVASKRLCFTLEEFLQQPPCDSRTLLLSIFIPEWGSNDVTFETFRAAPRPLGNAVSYVNSAFLARTSLDAASKDHLIEDICLAFGAYGADHAIRARKVEDYLKGKTVSSSVILEAVRLLKGSIKPSEGSTHPEYRISLAVSFLFTFLSSLANSLNESAKVSGTNEHSPEKQLKLDINDLPIRSRQEIFFTDAYKPVGKAIKKAGVEIQASGEAVYVDDIPAPKDCLYGAFIYSTHPHAHVKSINFKPSLASQKIITVITAKDIPSGGQNVGYSFPMIGEEALFADPVAEFAGQNIGVVIAQTQKYAYMAAKQAIIEYSTENLQPPILTIEDAIERSSFFQTLPFVAPKPVGDYDKGMSEADHKILSAEVKIESQYFFYMEPQVALAIPDEDNCITIYFSTQLPESTQNVVAKCVGIPFHNVRVITRRVGGGFGGKALKSMHVACACAVAALKLQRPVRMYLDRKTDMIMAGGRHPMKVKYSVGFKSNGKITALHLDLGINGGISPDMSPMIAAPVIGSLKKYNWGNLAFDTKVCKTNVSSKSSMRAPGDAQGSFIAEAIIEHVASALSADTNTIRRKNLHDFESLAVFFGDSAGEASTYSLVTMFDKLASSPEYQHRAEMVEQFNRSNKWKKRGISCVPVTYEVQLRPTPGKVSIMNDGSIAVEVGGVELGQGLWTKVKQMTAFGLGQLCPGGGESLLDKVRVIQADTLSMIQGGVTGGSTTSETSCEAVRKSCVALVESLKPIKENLEAKTGTVEWSALIAQASMASVNLSAHAYWTPDPTFTSYLNYGAGTSEVEIDVLTGATTILRSDLVYDCGQSLNPAVDLGQVEGAFVQGVGFFTNEEYATNSDGLVIHDGTWTYKIPTVDTIPKQFNVELINSARDQKRVLSSKASGEPPLLLASSVHCAMREAIRAARKEFSVCTGPANSAITFQMDVPATMPVVKELCGLDVVERYLESVSAASPTNTAKA

SEQ ID NO: 7019 - DNA, 3990 bp, Phaeosphaeria nodorum
  CDS (1)..(3990)
atggctccaggtctcgtcgtgcccgaacctgctgtccctgcctccgccacacgctcactcgccgacattacagcttcctacgacgacacgctacgcttctacctcaatggcacaaaagtcacgctcgacgctgcggacccggaagtcacgctgctcgagtatctaaggggcattgggctcacgggcacgaagttgggatgcgcggagggaggctgcggagcctgtactgtcgtcgtgtcgcagctgaatcccaccacgaagaagatctatcacgcatctgtgaacgcatgtctagcgccgctggtcagtgtggatggcaagcatgtcatcacggtagaagggattgggaatgtcaagaagccgcatccagcgcaggagaggattgcggaaggggaatgggagtcagtgtgggttttgcacgccggatgtacaggatatagaccgatattagacgccgcgcagagtttcagtgtgaagagtgggtgtggcaaagcgtcggcaaatggcgggagtggatgctgcatggagaagaagggcgcaaatggagatgggtgttgtaagagtgatggcgcagacgatcagcccatcaagcggtttactcctcctggcttcatcgaatataacccagataccgagctcatcttcccgccacaattacggaaacatgaattcaagcctctcgcgtttggcaataaaaggaagaagtggtttaggccgatgacggtggagcagttgctggagatcaagagcgcgtatccgtctgcgaaactcattggaggttcgacggagacgcagattgagatcaagttcaagggcatgaactacaacgcgtcggtcttcgtgggtgacatcgcggaactaaggcaattcacgttccatgaggatcatctggagattggtggaaacgtggtgttgacggatctcgagcaaatttgtgaagatgcagtcaagcactacggcagaatcaggggtcagccgtttgccatgatcctaaagcaaattcggtacttcgctggaaggcagattaggaatgttggcacgccggctggtaatctggcgacggcgagtccgatttcagatcttaatccggtgtttgtggcgacgaatagtacgctgttggcgaagagcttgaaagagacgacggagattcctatggcgactttcttcaagggatacagacaaacagctctgcctcctgatgcgattattgccggattgaggataccagttgcaagagaaaagggcgagttcatccgcgcgtacaagcagtctaagcgcaaggacgacgacattgccattgtgaacgctgcgctccgcatctccctagacgatgcacacaccgtcgagagcgtcgacctagtctatggcggcatggccccaaccaccatcggcgcgaagaaagccatggccttcctcaaaggcaagaagttcacagaccttcaaaccctcgaaggcgtcatggacaagctcgaagaagactttgacctccgctttggcgtacccggcggcatggcgacataccgcaaatccctggcgctcagcttcttctacaagttctaccacgaagtgctcgcggaactacacgcagaagaagtggagattgacacgcaggcgatcggcgagatcgagcgcgatatcagcaagggcgagaaagatggcaaggcggctgaggcgtataagcagaaagaggtgggacaaagtaagaatcacgtcgccgcgatgaagcagtgtactggcgaggcgcagtatacggacgacatcccgctgcagaggaacgagctctatggatgcttggtgctgtcgacaaaagcgcatgcgaagattctcagggtggatgcggaaccagcgctcaacgagcctggcgtagtatcctatgtcgaccacaacgacgtcgcgtctcccgaggcaaattggtggggcgctccagcctgcgacgagaccttcttcgccgtcgacgaagtcttcaccgtcggccagccgatcggcatggtactggcagacactgcgaaacacgccgagcaagccgcccgcgccgtcaagatcgagtacgaagaactcccggcgatattcaccatcgaagaggccatcgagcacgagagctatttccagcacttccgtcacatccagaagggagacacggagaaggcgttcgccgaggcggatcatgtcttcactggtaccgcgcgcatgggcggccaggagcatttctacctcgagacgaatgcgtgtttggcggttcctaagccggaagatggcgaaatggagatcttcagcagtacgcagaatccggctgagacgcaggcttatgtcgccaaggtggtgggtgttgcggctaacaagatcgtcacccgcgtgaagcgtatgggtggaggttttggtggtaaggagacgcgttcgattcagcttgctggtattgtagcgtgcgcggcgaataaggtccgtcgacctgttcgatgcatgttgaatcgggatgaggatattgctacttctggtcaacgccatcctttcctggctcgctggaaggttgctgtcaacaaggacggcaaaatccaagccctcgatgctgatgtcttttgcaacggtgggtggtcacaggacctctccggtgcggtcgtcgagcgctcgctttcgcacattgacggtgtctactctatccccaacatccatgtccgtggccgtgttgcaaagaccaacaccgtctccaacactgctttccgcggctttggcggtcctcaaggcttgttcatcgcagagacgtacatcgaagagatcgcagaccagctcaacatccccgctgagagaatgcgagaaatcaacatgtacagccccgagaccaacatgatcacgcacttcaaccaagaactcaaggactggtacgtcccactcatgtacaagcaagtccaatccgaatccgcctactccgagcgccgcgccgccatcacagagtggaacaaaatccacaaatggaacaagcgcggcctcgctattgtgcccaccaaattcggcatctccttcaccgccctcttcctcaatcaagccggcgccctcgtccacatctaccacgatggctccgtccttgtcgcccacggcggcacggaaatgggacagggcctgcacaccaagatgacgcaaatcgccgctgaggccctcaacgtacccttatccaacgtgtttatttccgaaaccgctactaatactgtggcgaatgcgtcgtccaccgctgcgtccgctagttctgacctcaacggctacgccatctggaacgcgtgcgaacagctcaactcgcgcctcgcaccgtaccgcgagaaactcggcaaagacgcgagcatgaaggacattgcacacatggcctacttcgaccgctgcaatctctctgcccaaggcttctacaagacacctgacatcggctacgtctggggcgccaacactggccagatgttcttctacttcacgcaaggcgtggccgccgccgaggtcgaaatcgacacgctgaccggcgacttcaccgtgcgccgcgcggatatcaaaatggatgtggggcgcagtattaatcccgcgattgactacggccagattgaaggcgcgtttgtccagggccagggactctttacgactgaggagatgctgtggcatcgcggcagtggaggcatcttcaccaaaggaccagggaattataaaattcctgggttcagggatattccgcagatctttaatgtgagtctgttgaaggatgtcgagtgggagaatttgaggacgattcagagaagtaggggtgttggcgaaccgcccttattcatgggcagctgtgtcttcttcgcgatccgcgacgcgctcaaggcggcgcgagcgcagtttggagaaaacagcgtgctgcatttgcagagtccggcgacgcctgagaggatcaggattagttgtgcggatccgattcttaagagagcgtgggtggagccgcaggagggggagaagagcttcttcgttagcatttga

SEQ ID NO: 7020 - protein, 1329 aa, Phaeosphaeria nodorum
MAPGLVVPEPAVPASATRSLADITASYDDTLRFYLNGTKVTLDAADPEVTLLEYLRGIGLTGTKLGCAEGGCGACTVVVSQLNPTTKKIYHASVNACLAPLVSVDGKHVITVEGIGNVKKPHPAQERIAEGEWESVWVLHAGCTGYRPILDAAQSFSVKSGCGKASANGGSGCCMEKKGANGDGCCKSDGADDQPIKRFTPPGFIEYNPDTELIFPPQLRKHEFKPLAFGNKRKKWFRPMTVEQLLEIKSAYPSAKLIGGSTETQIEIKFKGMNYNASVFVGDIAELRQFTFHEDHLEIGGNVVLTDLEQICEDAVKHYGRIRGQPFAMILKQIRYFAGRQIRNVGTPAGNLATASPISDLNPVFVATNSTLLAKSLKETTEIPMATFFKGYRQTALPPDAIIAGLRIPVAREKGEFIRAYKQSKRKDDDIAIVNAALRISLDDAHTVESVDLVYGGMAPTTIGAKKAMAFLKGKKFTDLQTLEGVMDKLEEDFDLRFGVPGGMATYRKSLALSFFYKFYHEVLAELHAEEVEIDTQAIGEIERDISKGEKDGKAAEAYKQKEVGQSKNHVAAMKQCTGEAQYTDDIPLQRNELYGCLVLSTKAHAKILRVDAEPALNEPGVVSYVDHNDVASPEANWWGAPACDETFFAVDEVFTVGQPIGMVLADTAKHAEQAARAVKIEYEELPAIFTIEEAIEHESYFQHFRHIQKGDTEKAFAEADHVFTGTARMGGQEHFYLETNACLAVPKPEDGEMEIFSSTQNPAETQAYVAKVVGVAANKIVTRVKRMGGGFGGKETRSIQLAGIVACAANKVRRPVRCMLNRDEDIATSGQRHPFLARWKVAVNKDGKIQALDADVFCNGGWSQDLSGAVVERSLSHIDGVYSIPNIHVRGRVAKTNTVSNTAFRGFGGPQGLFIAETYIEEIADQLNIPAERMREINMYSPETNMITHFNQELKDWYVPLMYKQVQSESAYSERRAAITEWNKIHKWNKRGLAIVPTKFGISFTALFLNQAGALVHIYHDGSVLVAHGGTEMGQGLHTKMTQIAAEALNVPLSNVFISETATNTVANASSTAASASSDLNGYAIWNACEQLNSRLAPYREKLGKDASMKDIAHMAYFDRCNLSAQGFYKTPDIGYVWGANTGQMFFYFTQGVAAAEVEIDTLTGDFTVRRADIKMDVGRSINPAIDYGQIEGAFVQGQGLFTTEEMLWHRGSGGIFTKGPGNYKIPGFRDIPQIFNVSLLKDVEWENLRTIQRSRGVGEPPLFMGSCVFFAIRDALKAARAQFGENSVLHLQSPATPERIRISCADPILKRAWVEPQEGEKSFFVSI

SEQ ID NO: 7021 - DNA, 4473 bp, Phaeosphaeria nodorum
  CDS (1)..(4473)
atggcgttgcccgttcctcccacctcggcagcggcggacccaccgcgggcgtattccgctgttgacgcgctcacacctctcatcacgtcgacatacacatcgcccgatatcacttgttacatcaatggcaagaaaattatcatcagtaatccgaatccgcattggacgctgctcgattacatccgcgcgcaaccgaatcttaagggaacgaagttgggatgtggcgaaggaggatgcggtgcttgcactgttgtgctgcaggtggcagacaagcagtctaagaagaggaggataaagcatctctccgtgaatgcctgtctgtttccactggtcggtgttgacggcaaacatgtcatcacagttgagggcatcgggaacgtcaaccgaccacatcctctgcaggagcggatagccaaactccatgggagtcaatgtggcttctgtacgcctggcattgttatgtctttatacgctgtcgtgaggaatgcgtataatccggagacacaaaagtttcatctcagtgcacgcgagatcgaaatggaaggacatctggatggcaatctctgtagatgcacaggatataaaccgattctaaacgccgcaaagaccttcgtcacggaagacttgaagggccagcttgcagaagaggatggcgcgactactgtggatgcagaaagtttcgagaaagatgtcatcgatatgactaggaatggttgcgcaggtccttcaaaggtatcttgcggacgtcctggaggctgctgtcgagatacaccatcggacagcagttcgaacgaaagtaagtcggatgcgtcatcgccaccaaccgagccaatttcaagctccgacgacgaacgcatacccgcgatcgttgttgcgaagaatgagccatcccaggatccagcgttaagtggagccgagtatgcgaaaccactgaagagcaaggagagcaaaagcgcagcggtagaatccaagacatctacatcattactagaagcacccgctgagagctcaatgaaaggtgtgccaaagattgagttcaaggaatacgtgccagacaccgagctcattttcccttcggcactttggaagtacgagtcacgaccactctgttatggtaacgacaagaagatttggttccgccctacaaagcttgagcagctggttgagttgaaggacgcctacccgtcagcgaagctcgttggtggtgctagtgaagtacaggtagaggttcgcttcaaaaactcggactttgcagtctccgtctatgtatcggacattccagaattaagacataccaaactacccgctgacgccgagctggaaaacgcaaaggaactggttcttgcagccaatacaccacttacagagttggaggaaatctgtaagactgtgtacgcgaaattgggcaagcgtgccatggttctcgaagccctgcgaaagcaactgcgatacttcgctggccgtcagattcgtaacgtcgcctctctcgctgggaacatcgccacagcatccccaatttccgatgcaaatcctgtcctcctggcggctggtgcaacactcgaagccgtcaataaaaatggtggcactgtcgatcttcccatgtcaaagtttttcgtggcataccgaacaacatcactaccaccagatgctgcgctgtaccggatacggataccgctcgcgcagaaagattgtcgagaagtgctgaaggcctacaagcaggcgaagaggaaagatgacgacattgcgattgtcacatctgcattccgcgtgcgcctagatcaagaaggtcttgtcgaagatgttagtatcgtgtacggtggcatggctccgactaccaaggagtcaatcaagacacagagtgctctactcggcaagcggtggttccactctgagacattggaagcagccttgtcagcactgctcgaggactacgatctgccgtatggcgttcctggtggcatggcagactaccgcaagacgctcacactctcgctcttcttccgcttctggcacgaatcagcagccgagctctgtcttggaaacgtggatgagcaggtggtagatgagatacatcgaggcttgtcaagcggcatgcgcgatgactacaacccatacgaacaacgcgttgttggcaagcaagtcgcgcatctgtctgctctcaagcaatgtacaggtgaagcagagtatgttgatgacatgccgcgtatggatcgtgagctcttcggtggacttgtcatgtctagcaaagctcacgcaaagatcattagcgttgattgggagcctgctttggagatgccgggtgttgtgggatatattgataagaacagcatcggcgccgacgtcaatatatggggctcaattaagaaggatgaaccattcttcgcggaagacaaagtgctttgccacggtatggtcattggcatggtttacgctgaaactgcgctcgaagcgcaggctgctgcaaaagctgtgaaggtggagtacgaagtcttgccacccatccttacgatcgacgaggccgttgctgcggacagcttcttccaacatggaaagttcttgcgaaagggtcttgctattgatgataagatggaggaagcgtttgccaagtgtgaccgaatatttgagggtgtttccagattaggtggacaggagcacttctatcttgagacgaacgctgcactatcaataccttctaccgaagatggcgccatggaagtatggtcttcgacacagaatactatggaaacacaagaattcgtaagtgcggtcttaggtgtgcccagcaaccgcatcaatgcacgggtaaagcgtatgggaggcggcttcggtggcaaagagtctcgcagtgtacctttcgcagtttacactgcccttgctgcacgaaaagagaagagaccagtccgattgatgctcaatcgcgatgaagacatgctcctcagtggccaacggcatccattccaggcacgatggaaggtcggtgtcactaaagagggcaagctattggcgcttgaggcagatgtatacaacaatggcggcttctcacaagatatgagtggcgcagtcatggatcgctgccttacccacctcgataactcatatgaatgtcctaacacgttccttaagggatatgtctgtagaacaaatactcacagcaacaccgcatatcgtggcttcggagcaccacagggaatgtacttctccgaaaccatcatgtacaacattgcagaaggactcggcatcgacgttgatgagctccgccaacgcaatctctacaagcctggcgaacacactccattcttccagaagatcgacgaggactggcatgtaccaatgcttctgcatcaactcgctaaatcatcggagtacgagaagagaaaagccacaatcaaagagttcaatgcgaagaaccggtggaagaagcgaggcacttgtctcatcccatgcaaattcggtctaagctttgcgacagcattacatctaaaccaagctggagcttacgtcaagatctaccacgatggtagcgtgctactccaccacggaggcactgagatgggtcaaggattgtacactaaaatgtgtcaaatcgccgcacaagaactcggcacaccgctcgacgcgatatacacgcaggatagccagacttatcaaatcgccaacgcgtcgcctactgccgcatcttcaggctctgatctcaacggcatggcagtcaagaatgcttgtgaccagatcaatgaacgcctagcgccttatcgcgagaagctgggtaaagatgcaccgttgaaagcgctcgctcacgccgcttacctcgaccgcgtcaacctcgccgccaacggattttggaaaatgcctaaagtcggatatacatggggtgacacaaactgggagaccgtgaagccaatgtactactactggacgcagggcgctgctacttctgaagtcgaagtcgaccttctcaccggcgatcatactgtcttacgctctgatatcatgatggacgtcggcaactccatcaaccccgccatcgactacggccaaatcgaaggcgccttcatccaaggccaaggcctcttcaccctcgaagaaaccctctggacgcgcgacggccagctcttcacacgcggacccggaacttacaaaatccccggcttctccgacatcccgcagatcttcaacgcgacattacttcgacaagacaacgatggcaacccgctgagttggaaccatcttaggagtgtgcagagtagcaaaggaattggtgaaccaccgctgttcttgggctcgacggttttcttcgcgctgagagaggcgttgagggcggcgagggagatgaatgggaagggaggaaagggtttcgtattggatagcccggcgacggcggagagattaagactggcggttggagatgatttggtggagagggcgaggacgaagaggaaagagggggagacaaacttcttggtcgctgttgcataa

SEQ ID NO: 7022 - protein, 1490 aa, Phaeosphaeria nodorum
MALPVPPTSAAADPPRAYSAVDALTPLITSTYTSPDITCYINGKKIIISNPNPHWTLLDYIRAQPNLKGTKLGCGEGGCGACTVVLQVADKQSKKRRIKHLSVNACLFPLVGVDGKHVITVEGIGNVNRPHPLQERIAKLHGSQCGFCTPGIVMSLYAVVRNAYNPETQKFHLSAREIEMEGHLDGNLCRCTGYKPILNAAKTFVTEDLKGQLAEEDGATTVDAESFEKDVIDMTRNGCAGPSKVSCGRPGGCCRDTPSDSSSNESKSDASSPPTEPISSSDDERIPAIVVAKNEPSQDPALSGAEYAKPLKSKESKSAAVESKTSTSLLEAPAESSMKGVPKIEFKEYVPDTELIFPSALWKYESRPLCYGNDKKIWFRPTKLEQLVELKDAYPSAKLVGGASEVQVEVRFKNSDFAVSVYVSDIPELRHTKLPADAELENAKELVLAANTPLTELEEICKTVYAKLGKRAMVLEALRKQLRYFAGRQIRNVASLAGNIATASPISDANPVLLAAGATLEAVNKNGGTVDLPMSKFFVAYRTTSLPPDAALYRIRIPLAQKDCREVLKAYKQAKRKDDDIAIVTSAFRVRLDQEGLVEDVSIVYGGMAPTTKESIKTQSALLGKRWFHSETLEAALSALLEDYDLPYGVPGGMADYRKTLTLSLFFRFWHESAAELCLGNVDEQVVDEIHRGLSSGMRDDYNPYEQRVVGKQVAHLSALKQCTGEAEYVDDMPRMDRELFGGLVMSSKAHAKIISVDWEPALEMPGVVGYIDKNSIGADVNIWGSIKKDEPFFAEDKVLCHGMVIGMVYAETALEAQAAAKAVKVEYEVLPPILTIDEAVAADSFFQHGKFLRKGLAIDDKMEEAFAKCDRIFEGVSRLGGQEHFYLETNAALSIPSTEDGAMEVWSSTQNTMETQEFVSAVLGVPSNRINARVKRMGGGFGGKESRSVPFAVYTALAARKEKRPVRLMLNRDEDMLLSGQRHPFQARWKVGVTKEGKLLALEADVYNNGGFSQDMSGAVMDRCLTHLDNSYECPNTFLKGYVCRTNTHSNTAYRGFGAPQGMYFSETIMYNIAEGLGIDVDELRQRNLYKPGEHTPFFQKIDEDWHVPMLLHQLAKSSEYEKRKATIKEFNAKNRWKKRGTCLIPCKFGLSFATALHLNQAGAYVKIYHDGSVLLHHGGTEMGQGLYTKMCQIAAQELGTPLDAIYTQDSQTYQIANASPTAASSGSDLNGMAVKNACDQINERLAPYREKLGKDAPLKALAHAAYLDRVNLAANGFWKMPKVGYTWGDTNWETVKPMYYYWTQGAATSEVEVDLLTGDHTVLRSDIMMDVGNSINPAIDYGQIEGAFIQGQGLFTLEETLWTRDGQLFTRGPGTYKIPGFSDIPQIFNATLLRQDNDGNPLSWNHLRSVQSSKGIGEPPLFLGSTVFFALREALRAAREMNGKGGKGFVLDSPATAERLRLAVGDDLVERARTKRKEGETNFLVAVA

SEQ ID NO: 7023 - DNA, 4083 bp, Brassica campestris
  CDS (1)..(4083)
atgggtgagaagaaagtgacagaggagaaagaagaaacgatgaagagcaagacctctcttgttttcgccgttaatggagaaagatttgagatcgacctctcttccattgatccttcaaccacactcatcgatttcttgcgtaataagactcctttcaagagcgtcaagctcggttgtggcgaaggtggttgtggtgcttgcgttgttcttctttcaaagtacgatcccctcctcgaaaaggtcgatgacttcacagtcagctcgtgcctcacgctcctctgcagcatcgacggctgttccatcacaacctcagaaggcctcggcaacagcagagccgggttccacgcagtccacgagcgcatcgccggttttcacgccacgcaatgcggtttctgcacgcccggtatgagcgtctccatgttctctgctctcttaaacgccgacaagacacatcctcctcgcgctggcgtctcaaacctaacagctgcagaagcagagaaggctgtctccgggaacctatgcaggtgcactggatacagaccgctagtggacgcttgtaagagcttctcggctgatgtggatatcgaagatctcgggttcaatactttttgcaagaaggggttgccttgttatgaccatacactttcctctcaggtctgtacgtttcctgagttcttgaagaaggaactcaagagtcttgttgatccaagaaagtacagatggtcaagtcctcttagtatctctgagcttcagagtctattagggcttgaaaatggagtgtcggttaagttagttgctggtaacactagcaccggttattacaaagaagagaaagacaagaagtacgacaggtttgtcgatataagacggatccctgagctcacagttgtaagaagagacgagaaaggagttgagctaggagctgctatcactatctcaaaagctattgaggttctaagagagaacgaaagtgttctcatcttggcgaaaatcgcggctcacatggagaagattgcaagcagattcgtgaggaacacggagactataggcggaaacatcatcatggcgcagaggaaacacttcccttcggatctcacaaccatactggtcgccgctggagccaccgtgaagatcatgagtaccggctcaggtgttcaagaacagtacacacttgaagagtttcttcaacgtcctcctcttgaagccaaatctgttctcttaagccttacgataccttcttggcgccccgtgaagaacggttccactcacagagcgggtcctgagcatagccagatgaaatattcgcctttgaatactcatttgctatttgaaacatacagagcagcgccgcgtcccctaggaaacgcattggcgtttctgaatgcagctttctcagctgaagtgtctttgaatgaagctggtgatggtgtagttgtgaatgattgcttgttcgcttttggtgcttatgggaccaaacacgcacatagggcgaagaaagtcgaagacttccttgcgggtaaagttatctctgatgaagttttgatggaagctattagcttacttaaagatgagatagtacctgataagggtacttcaaaccctggttatagatctagcttggctgttactttcctctttgagttcctcgtatctttaactacaaaaggtttgctcaacggagaatacaaagagcctttgaaacctgaagctctgttgtcatcagcacaacagatagttgaaaatcaagaatatagtccggtcggtaaaggcattgaaaagacaggagctaagctccaagcatctggtgaggcagtgtatgtagacgacattccttcaccggagaactgtctgtacggtgcatttatatacagtacaatgcctctggcaaggatcaagagtatagggttcaaggagaacagagttccagagggagttcttggcattataacttataaagatatccccaaaggtgggcaaaatgttggtactaaaggtttctttgcctctgatcttttgtttgctgaagaagtcacccattgtgccggtcagatcatcgcctttttggttgcagagagtcaaaagcttgcagatattgcaacaaagcttgttgtgattgattacgacaccgaagggttagaagagcctatactatctgtagaagaagctgtcaagaagtctagtcttttcgagatccctccatatctgcgtggtaaaccggttggtaacatcaacaagggaatgtctgaagctgaacataagattcttggatcaaagataagtttcgggtcacagtacttcttttacatggagacacaaacggctcttgcggtgcctgatgaagacaactgtatgttggtttatagctcaactcaagctcctgagtatgtacatagaaccatagctggatgtcttggagttcctgagcataatgtccgtgtgatcactcgacgtgttggaggtggctttggtgggaaagtcatgaaagcaatgccggttgctgcagcttgtgcacttgcagcatccataatgcaacgtccagtgaggacatacgtgaaccggaaaacagatatgataactactggaggaagacatccaatgaagattacatacagtgttggattcaaatccaatgggaagattactgctttggacttagagctgctacttgatgcagggctaagcgaagatgtaagcccacttatgccatcagggatacaaggagcaatgatgaagtatgattggggtgctctctcttttgatgtgaaagtatgcaaaacaaacactgtgagcagaacttcagttagagctcctggagatgtacaaggatcttatatagctgaagccatcattgagaaagtagcttcatatctttccattgatgttgatgtgatcaggaaggttaatctccatacatatgagagcttaaggttgtttcatgataagaaagctggtgaacccacagagtatactctaccacttctttgggacaaactagctgagttctcagggtttaaccagagggtaaaggtggttgaggagttcaatgcgttgaacagatggagaaagagagggatctcgcgtgtgcctgcggtttatggagtgcctatgaggttcacaccaggaagagtaagcgtgttgagtgatgggtcaatagttgttgaggttccagggattgagataggacaagggctatggacaaaggtgaaacagatggttgcatattcacttggactgatccagtgcggtactacaagcgatgagcttttggacaagatccgtgtcatccaagcagacacgttgagtttagtacaaggctcggtaactggtggtagcacaacctctgaggctagcagtgaagcggcgaggatttgctgtgatggcttagtggaaagacttttacctgtacatgctgctttggtggagaaaacaggtggacctgtgacttgggagagcctcatcagccaggcttatcaacaatctataaacatgtcggttagtaacgtatacacgccggatatctccactggctactaccttaactatggagttgcagcgagcgaggttgaagtaaacatattgacgggtgaaacaacgattctgcgcacggatattatctatgattgtgggagaagtctcaaccctgctgtggacttaggacagattgaaggagcatttgtgcaaggacttgggttcttcatgcttgaagagtacctaatgaactcagacggtctcatagtgacagacagtacatggacttacaagataccaacggtcgacacaatcccaagacagtttaatgttgagattctcaacagtggacaccacaagaaccgtgttctttcatccaaagcttcgggtgaaccaccgttgcttttagcggcttctgttcactgtgcggtccgagcagctgttaaagaagccaagaagcagattcagacctggagtaatgataaccgagaagggattgatctgagctttgacttgcctgttccagcaacaatgcctgttgtgaaggagttttgtggacttgatgttgttgagaaatacttggaatggaacatccaccagaagaagaacttttga

SEQ ID NO: 7024 - protein, 1360 aa, Brassica campestris
MGEKKVTEEKEETMKSKTSLVFAVNGERFEIDLSSIDPSTTLIDFLRNKTPFKSVKLGCGEGGCGACVVLLSKYDPLLEKVDDFTVSSCLTLLCSIDGCSITTSEGLGNSRAGFHAVHERIAGFHATQCGFCTPGMSVSMFSALLNADKTHPPRAGVSNLTAAEAEKAVSGNLCRCTGYRPLVDACKSFSADVDIEDLGFNTFCKKGLPCYDHTLSSQVCTFPEFLKKELKSLVDPRKYRWSSPLSISELQSLLGLENGVSVKLVAGNTSTGYYKEEKDKKYDRFVDIRRIPELTVVRRDEKGVELGAAITISKAIEVLRENESVLILAKIAAHMEKIASRFVRNTETIGGNIIMAQRKHFPSDLTTILVAAGATVKIMSTGSGVQEQYTLEEFLQRPPLEAKSVLLSLTIPSWRPVKNGSTHRAGPEHSQMKYSPLNTHLLFETYRAAPRPLGNALAFLNAAFSAEVSLNEAGDGVVVNDCLFAFGAYGTKHAHRAKKVEDFLAGKVISDEVLMEAISLLKDEIVPDKGTSNPGYRSSLAVTFLFEFLVSLTTKGLLNGEYKEPLKPEALLSSAQQIVENQEYSPVGKGIEKTGAKLQASGEAVYVDDIPSPENCLYGAFIYSTMPLARIKSIGFKENRVPEGVLGIITYKDIPKGGQNVGTKGFFASDLLFAEEVTHCAGQIIAFLVAESQKLADIATKLVVIDYDTEGLEEPILSVEEAVKKSSLFEIPPYLRGKPVGNINKGMSEAEHKILGSKISFGSQYFFYMETQTALAVPDEDNCMLVYSSTQAPEYVHRTIAGCLGVPEHNVRVITRRVGGGFGGKVMKAMPVAAACALAASIMQRPVRTYVNRKTDMITTGGRHPMKITYSVGFKSNGKITALDLELLLDAGLSEDVSPLMPSGIQGAMMKYDWGALSFDVKVCKTNTVSRTSVRAPGDVQGSYIAEAIIEKVASYLSIDVDVIRKVNLHTYESLRLFHDKKAGEPTEYTLPLLWDKLAEFSGFNQRVKVVEEFNALNRWRKRGISRVPAVYGVPMRFTPGRVSVLSDGSIVVEVPGIEIGQGLWTKVKQMVAYSLGLIQCGTTSDELLDKIRVIQADTLSLVQGSVTGGSTTSEASSEAARICCDGLVERLLPVHAALVEKTGGPVTWESLISQAYQQSINMSVSNVYTPDISTGYYLNYGVAASEVEVNILTGETTILRTDIIYDCGRSLNPAVDLGQIEGAFVQGLGFFMLEEYLMNSDGLIVTDSTWTYKIPTVDTIPRQFNVEILNSGHHKNRVLSSKASGEPPLLLAASVHCAVRAAVKEAKKQIQTWSNDNREGIDLSFDLPVPATMPVVKEFCGLDVVEKYLEWNIHQKKNF

SEQ ID NO: 7025 - DNA, 4083 bp, Lactuca sativa
  CDS (1)..(4083)
atggaagacacccaacttcaacttacttccacagaaacaaaggaacaacaaaatcaaagactggttttcgctgtgaacggagaacgctttgagctctccagcgtcgatccttcaaccactctgcttcagttcttgcgttctcgtactcgtttcaagagtgttaagctcggttgcggtgaaggtggttgtggtgcttgtaatgttctactgtcgaagtatgactccaacctcaaacaagtcgaagattatacagtgagttcatgtcttacacttgtttgcagcataaacgggtgttcaatcactacaaccgaaggacttgggaatagcaaagatggattccattccattcatcaacgttttgctggttttcatgcatctcaatgtgggttttgtactccaggaatgtgtgtttcactcttctcagcacttgtcaattcggaaaaaaacgatcatccacaaccccctcttggatcctccaaacttacttcctcagaagctgaaaagtcaatttctggaaatctttgcagatgcactggttatcgatctattgctgatgtctgtaaaagtttcgcatgtgatgttgatatggaagatttagggtttaattcattctggaaaaaggaaaagactccagattccaaacttcttaaactacccttttatgatccaaaaaagatctgtacttatcccgagtttttgaaaaacgaatccatgtcccctatgcatttgaagtatcagaaaagatcttggtatactccagtttctatgaaggaactaaatagcttattggtatctagtgtaactgaaaagggtaaaatggtaaagttggtagctggtaacacatgtataggttactataaagaagtggaccaatatgataagtacattgatcttagatttatccctgagctttctacaatcaaaagaacagactcacagattaaagttggagcaactgtttcaatctctaaactcatctttgccttgaaagaagaaagagatgatgatgatgatgatgatgaaggggacatggtgttccagaaaattgcttctcatttggagaaaattgcttctgaatctgttaggaattcagcaactataggtggaaatttagtaatggctcaaaggcatggacttccttcagacattgccactttacttgttgctgtgaaatcagaagttacaatcatgaatgggataaaaaaagttcttacattagaagagtttctagcacaacctgctttagattcaacaactttgcctttgagtgttcatattccattcatgaaaccaaataaaaacggttataactcagacaaatctgacactaaactattatttgaaacttatcgcgcttccccacgtcctcttgggaattccttagcttatttaaatgctgctttcttggctgaagtttctccatataagagtggcaatcatgtaattaacaacatacagttagcttttggtgcttttgggaataagcatgcaataagagcaaacacagttgagaattatcttcttggaaaaacgttgagtgttggattgttgtctgaatctctcaagttactaaaagctaatatccaaccagaagatgacacatcacattctgcttatcgatcaagcttggcttctagttttctctttgagtttctctttcctttacttgattctaatgcctcatatataaaaagttcaagggtgagatttgatcattatgatgaaaaaagaacattgttgtcatcttcaaagcaggtgttggaatctagccatgaacattatcctgttggtgaaccgattacaaaaacgggtgcttcaatccaagcttctggtgaagctgtatttgcggatgacattccttcaccattgaactgccttcatggagcattcatctacagcacaaatcctttagcatgggtaaaaggtgttgaagtgaagaaagatgtacatagtgttgtttcatttcaagatattccaaaaggaggagaaaacataggagccaaaactttattcggtccagaacctttatttgcaaatgagttaactgaatgcactggacaacgtatagcatttgtggtggcagattcacagaagaatgcagatattgcagctgaaacagccatggttgattatgacactcaagacttagaaccacctatattaactgttgaacatgctgtcgagaattcaagcttttttgaagtcccttcattcatatatccatcacaagttggtgatttcataaagggaatggctgaagctgatcataaaatccgttctgctgagatcaaacttggatcacaatactatttctatatggagacacaaactgcattagctgttccagatgaagataactgcatggtggtgtatagttccattcaggtccctgagtttgcacaaagtgtaatcgcacagtgtcttggaattcctgaacataatgttcgtgtgattacaagaagagttggaggaggatttggtggaaaagctattaaagctatgcctgttgcaacagcatgtgcacttgcagcatacaaattaaatcgccctgtgagaacatatgtgaacaggaagacagatatgataatggcaggaggaagacatcccatgaagataaactacactgttggcttcaaatccagtggaaaaatcacagctttacccctcgatatattaatcaatgctggaatttctccagatataagcccagtgatgccatggaatatgttgggtgcactgaagaaatacaattggggtgctttatcattcgattttaaaatctgtaaaacaaatcattcgagtaaatctgcaatgagagcaccaggagaagtgcaagcgtcttttatagctgaagcagttatagaacacgttgcatctgttgtttccattgatgttggttgcgtaagggagaaaaattttcatacattcgatagcttgaaaatgttctatggaggtgatagtgttggtgagtttgtcgaatatactttgccaacaatatgggataagttaatgaaatcatcaaatttcaatgatagagtcgaaacgataaagaagtttaataagtgtaacacatggagaaaaaagggtatttctcgagttcccattttgcatgaggtgtcgctaagggcaacacctggaaaagtgagtattttaagagatggatccattgtcgtagaagtaggtgggattgaattaggtcaagggctatggacaaaggtgaaacagatgactgcgtattgtttaaaagcaattcaatgtgaaggagctgatggaaatcagcttttggagaagatacgtgtcatacaagcagacacattgagtatgattcaaggagggtttacagctggaagcactacatctgaagcaagctgtgaagcagttagactttgttgcgatgttttagttgaaagactcgtgggtttgaaagaaagattagaagcgcaaatgggttttgttaaatgggattctctcattctgcatgcaaacatgcaatctgtaaatttatcagcaagttcgttttttgtacctgagtttacttccatgagatacattaactatggtgctgctgtaagtgaggtggaggtaaatcttctaactggagaaacgaaaatcttgcaagcagacattgtatacgattgtggacaaagcttgaatcctgctgtggatttgggacaggtggaaggcgcttttgttcaaggaattgggtttttcatgcttgaagaatattcgataaactctaatgggttagtgattgctgatagcacatggacatataagatacccacaattgatacgatacctaagcaacttaatgtgcatatactaaacagtggacatcataaaaaacgtgtcctctcttcaaaagcttctggagagcctcctttacttcttgcagtttctgttcattgtgcaactagagctgccattaaagaagcaagaaaccaagtacgttcatggaaagggttagagggttctgattcaattttccagttggatgttcctgcgactatgcctgtggtgaagacactgtgtggactagataatgtcgacttgtaccttcagagcttgatgtcaagttcatga

SEQ ID NO: 7026 - protein, 1360 aa, Lactuca sativa
MEDTQLQLTSTETKEQQNQRLVFAVNGERFELSSVDPSTTLLQFLRSRTRFKSVKLGCGEGGCGACNVLLSKYDSNLKQVEDYTVSSCLTLVCSINGCSITTTEGLGNSKDGFHSIHQRFAGFHASQCGFCTPGMCVSLFSALVNSEKNDHPQPPLGSSKLTSSEAEKSISGNLCRCTGYRSIADVCKSFACDVDMEDLGFNSFWKKEKTPDSKLLKLPFYDPKKICTYPEFLKNESMSPMHLKYQKRSWYTPVSMKELNSLLVSSVTEKGKMVKLVAGNTCIGYYKEVDQYDKYIDLRFIPELSTIKRTDSQIKVGATVSISKLIFALKEERDDDDDDDEGDMVFQKIASHLEKIASESVRNSATIGGNLVMAQRHGLPSDIATLLVAVKSEVTIMNGIKKVLTLEEFLAQPALDSTTLPLSVHIPFMKPNKNGYNSDKSDTKLLFETYRASPRPLGNSLAYLNAAFLAEVSPYKSGNHVINNIQLAFGAFGNKHAIRANTVENYLLGKTLSVGLLSESLKLLKANIQPEDDTSHSAYRSSLASSFLFEFLFPLLDSNASYIKSSRVRFDHYDEKRTLLSSSKQVLESSHEHYPVGEPITKTGASIQASGEAVFADDIPSPLNCLHGAFIYSTNPLAWVKGVEVKKDVHSVVSFQDIPKGGENIGAKTLFGPEPLFANELTECTGQRIAFVVADSQKNADIAAETAMVDYDTQDLEPPILTVEHAVENSSFFEVPSFIYPSQVGDFIKGMAEADHKIRSAEIKLGSQYYFYMETQTALAVPDEDNCMVVYSSIQVPEFAQSVIAQCLGIPEHNVRVITRRVGGGFGGKAIKAMPVATACALAAYKLNRPVRTYVNRKTDMIMAGGRHPMKINYTVGFKSSGKITALPLDILINAGISPDISPVMPWNMLGALKKYNWGALSFDFKICKTNHSSKSAMRAPGEVQASFIAEAVIEHVASVVSIDVGCVREKNFHTFDSLKMFYGGDSVGEFVEYTLPTIWDKLMKSSNFNDRVETIKKFNKCNTWRKKGISRVPILHEVSLRATPGKVSILRDGSIVVEVGGIELGQGLWTKVKQMTAYCLKAIQCEGADGNQLLEKIRVIQADTLSMIQGGFTAGSTTSEASCEAVRLCCDVLVERLVGLKERLEAQMGFVKWDSLILHANMQSVNLSASSFFVPEFTSMRYINYGAAVSEVEVNLLTGETKILQADIVYDCGQSLNPAVDLGQVEGAFVQGIGFFMLEEYSINSNGLVIADSTWTYKIPTIDTIPKQLNVHILNSGHHKKRVLSSKASGEPPLLLAVSVHCATRAAIKEARNQVRSWKGLEGSDSIFQLDVPATMPVVKTLCGLDNVDLYLQSLMSSS

SEQ ID NO: 7027 - DNA, 4080 bp, Aspergillus oryzae
  CDS (1)..(4080)
atggcgcccggcatcttgacgtcgccggggcctgaagtgtctcctctaaagactagctcactggcccagttaacggaggaatgggatgataccattcgcttctacttgaatggcacgaaagtgaccctcgactctgtggatccggagctcacccttttggaatacttaaggggaattggtttgacaggaacaaagctaggctgtgcagagggaggctgtggtgcttgcaccgtggtggtgtcgcacgtgaaccctacgaccaagaagctctatcacgcgtcggtaaacgcttgtcttgcgccagtcataagtgtggatggaaaacatgttattactgttgaaggcattggaaatgtgaagaacccccacgcggtccagcaacgaattgccatcggtaacggaagccagtgtggtttctgtacaccaggtatagtgatgagcctctatgcgcttatacgcaataatcctgaaccatcagaacatgctgtggaagaagcttttgatggaaatttgtgtcgttgcaccggatacaggccgatactagacgccgcccagagcttcaaagctagtggtggctgcgggaaatcaagtgccaatggtggaactggctgttgcatggaaaagcagactggctctggaggatgttgcaagggttcgtccgaggtggcgacagccaatggcgattctttgaagcttacggcacctgagttcataagtcataggccagacacagaactgatatttccgcccactcttcacaagcatgagtttcggcccttggttttcggtaataagagaaagaggtggtacagaccggttactctacagcagctcttggagatcaagcatgtgcacccagatgctaaagttatcggtggcagtaccgagactcagattgagacaaaattcaaggcgatgcgatatagtgcttcggtctacgtcggtgatattccggaacttcgccagttctcgttacaagacgatcacttggagattggggcgaatgtctctttgactgatttggagtcaatatgtgatgaagccttagagcgatatgggccggtgcgaggccagccctttactgctatcaaaaagcagcttcggtattttgccgggagacaaattagaaacgtggcgtctccggccggtaatttggctaccgcttcccccatctcggacttgaacccagtcttcgtggcaacaaacactgtactggttgccaaatcactaggaggggatattgagattccaatgaccgaattcttcaaaggttacaggactacggcccttccaccggatgctataatcggcagtctgcgcgtccctactgcatcagagaatggggagtatatgcgggcttacaaacagtccaaaaggaaagacgacgatatcgctattgtcaatgccgccttgcgggtttcgctctcgtcttcacatgatgtgacgagcgtaaacctcgtgtttggcggtatggccccaatgactgtgtctgcacgaaaggcagaagctttcttggtaggcaagaaattcacgcatcctgcgacccttgagggcaccatgagtgctctagaacaagacttcgatctgcagtacggagtgcccggtggtatggctagctatcgtcggtctcttgctctaggatttttctaccgattctatcatgacgttttgtcgggggtcgagttgaacagtacggacatcgaccacgacgtgattggtgagattgaaagagctatctcttgcggggaaaaggatcatgaggcttcagcggcatatcaacagcgagtattagggaaagctggccctcatgtctcggcgttgaaacaggccactggcgaagcgcagtacactgatgatgtacctgtcctacagaacgagttgtttggttgcatggttttgtcgacgaaaccgcatgcaaatattatcagcgttgatccatctgctgctctcgatatccctggagttcatgactatgtggatcacagagatcttcccagtccagaggctaattggtggggtgctcctgtagccgatgaggtgttttttgcagtagataaggttacaactgctggacagcccattggtatgatcctcgcaaagtcggccaaaactgccgaagaggctgcgagagctgtaaaaatcgagtatgaggagctgccggctatactaaccattgaagaggccattgaagccgaatcgttcttcgcgcacaaccactacatcaaaaacggcgatacagaagcggctttcagacatgctgaccacgttatcactggcgtatcgaggatgggaggccaggagcatttctacctggaaacccaagcgtgcgtcgccattcccaaacctgaagacggggaaatggagatctggagtggcacacaaaatcccaccgaaactcaaacatacgtcgctcaggtcacaggggtagcagccaacaagatagtctcaagagttaagcgactaggtggtggatttggtggtaaagagactcgatcaattcaacttgctggcctatgtgcgacggctgcagctaaaacaagacggcccgttcggtgtatgcttaaccgtgatgaagatattataacttcaggtcagcgtcacccgttctactgccgttggaaggttggcgtgaccaaggaagggaagctccttgccctcgatgctgatgtatatgccaacggtggacacacacaagatctttctgccgcagttgtggacaggtccttgtcacatattgacggagtgtataacatcccgaacgttcatgtccggggtcgtatttgcaagacaaatacagtctcaaattccgcgttccgtggattcggtggaccacagggcatgttcatggcggaaagcttcatgtcggagatcgcggatcatctggatatcccagtcgaaaagcttaggatggacaatatgtataagcacggagataagacccactttaaccaggagctcaaagactggcatgttcccttgatgtataatcaagtcttggaggagagctcgtatatggaacgtcgaaaagccgtggaggaatacaataagaagcacaagtggtcaaaacgtggcatggctatcattccgacaaaattcggcatctcctttacggccttgttcctgaaccaagctggggctctcgttcacatctatcatgacgggagcgttcttgtcgcccacggtggtgttgaaatgggccaggggctgcatactaagatgactatgattgcggcagaagcactaggcgttcctcagtcagacgtgttcatttccgaaacagccacaaacacagtcgcaaatacctcgtctacagctgcgtcggccagttccgacctcaatggttacgctattttcaatgcctgtgagcaactcaacgagcgtcttcggccttatcgggaaaagatgccgaatgccccaatgaaagaactcgcgcatgcagcttactttgaccgagtcaacctctctgctcaggggcattatcgtaccccagatattggctatgtctggggcgagaacacaggccaaatgtttttctacttcacacagggtgtgacagccgccgaagttgagatcgacacactaaccggtgattggactccgttacgtgcagacatcaagatggatgtcggccgcaccatcaatccctctatcgactacggacagatagagggagccttcattcagggtcaaggtctctttacgacagaggaaagcctctggcatcgtgcctcaggccaggttgtcactaagggacccggaaactacaagattcccggatttcgggacattccccaggttttcaacgttagccttctcaaggacgttgaatgggaaaatcttcgtacaatccaacgatctcgtggtgtcggtgaaccaccccttttcatgggaagcgctgttttctttgctatccgtgacgctctgaaagcagcacggaagcagtacaatgttcacgaagttctcagtctacgaagtccggccacccccgaacggattcgggtcagctgcgctgatcccattatcgaacgggcaagagtattgcctaaggaaggagagaagagcttttttgttgagatttga

SEQ ID NO: 7028 - protein, 1359 aa, Aspergillus oryzae
MAPGILTSPGPEVSPLKTSSLAQLTEEWDDTIRFYLNGTKVTLDSVDPELTLLEYLRGIGLTGTKLGCAEGGCGACTVVVSHVNPTTKKLYHASVNACLAPVISVDGKHVITVEGIGNVKNPHAVQQRIAIGNGSQCGFCTPGIVMSLYALIRNNPEPSEHAVEEAFDGNLCRCTGYRPILDAAQSFKASGGCGKSSANGGTGCCMEKQTGSGGCCKGSSEVATANGDSLKLTAPEFISHRPDTELIFPPTLHKHEFRPLVFGNKRKRWYRPVTLQQLLEIKHVHPDAKVIGGSTETQIETKFKAMRYSASVYVGDIPELRQFSLQDDHLEIGANVSLTDLESICDEALERYGPVRGQPFTAIKKQLRYFAGRQIRNVASPAGNLATASPISDLNPVFVATNTVLVAKSLGGDIEIPMTEFFKGYRTTALPPDAIIGSLRVPTASENGEYMRAYKQSKRKDDDIAIVNAALRVSLSSSHDVTSVNLVFGGMAPMTVSARKAEAFLVGKKFTHPATLEGTMSALEQDFDLQYGVPGGMASYRRSLALGFFYRFYHDVLSGVELNSTDIDHDVIGEIERAISCGEKDHEASAAYQQRVLGKAGPHVSALKQATGEAQYTDDVPVLQNELFGCMVLSTKPHANIISVDPSAALDIPGVHDYVDHRDLPSPEANWWGAPVADEVFFAVDKVTTAGQPIGMILAKSAKTAEEAARAVKIEYEELPAILTIEEAIEAESFFAHNHYIKNGDTEAAFRHADHVITGVSRMGGQEHFYLETQACVAIPKPEDGEMEIWSGTQNPTETQTYVAQVTGVAANKIVSRVKRLGGGFGGKETRSIQLAGLCATAAAKTRRPVRCMLNRDEDIITSGQRHPFYCRWKVGVTKEGKLLALDADVYANGGHTQDLSAAVVDRSLSHIDGVYNIPNVHVRGRICKTNTVSNSAFRGFGGPQGMFMAESFMSEIADHLDIPVEKLRMDNMYKHGDKTHFNQELKDWHVPLMYNQVLEESSYMERRKAVEEYNKKHKWSKRGMAIIPTKFGISFTALFLNQAGALVHIYHDGSVLVAHGGVEMGQGLHTKMTMIAAEALGVPQSDVFISETATNTVANTSSTAASASSDLNGYAIFNACEQLNERLRPYREKMPNAPMKELAHAAYFDRVNLSAQGHYRTPDIGYVWGENTGQMFFYFTQGVTAAEVEIDTLTGDWTPLRADIKMDVGRTINPSIDYGQIEGAFIQGQGLFTTEESLWHRASGQVVTKGPGNYKIPGFRDIPQVFNVSLLKDVEWENLRTIQRSRGVGEPPLFMGSAVFFAIRDALKAARKQYNVHEVLSLRSPATPERIRVSCADPIIERARVLPKEGEKSFFVEI

SEQ ID NO: 7029 - DNA, 3060 bp, uncultured bacterium
  CDS (1)..(3060): transl_table=11
atgaccaccgttccaacactctccgtcaacggacaacattatcgcgtcgcggtcgacccgggcgagacgctgctcgacgtgttgcgtgacaagctgggtctcaccggaaccaagaagggctgcaacgtcggcgactgcggggcctgcaccgtcctggtagacggcgagccaatgaacagttgcctcctgctcgcctcggagatggagggcaaggccgtcaccaccatcgaaggcctggcgcaaaacggcgagctcaccccgctccagaaggcgtttgtccacgaaggcggcatccagtgcggcttttgcacgccggggatggtcgtagccgccaccgccctgctcaacaagaacccgaatcccaccgccgatgagatcaaagatgctctggccggcaacctgtgccgctgcaccggctacaccggcatcctccgggccgtccagcgctgcgcggggcaggagccacaaagccacgaagccacggagccacgaagggctgaagccgcggagccacggagccacgaagccacgaagccacgaagggacgaagccgccgaggccagtcgccaatccgcaatccgcaatccgcaatccgcaatgcagagtgtcggcgtctcgattccgcgcgtcgatgccgccgacaaggtcaccggacgagcgcagtacaccgccgacatctcgctcccgaacatgatccacggcaagatcctcggctcgcccatcgcccacggccgcatcaagcgcatcgacgtttccaaagcgaaagcgctgccgggcgtggtcgcggtaattaccggtgcggacgtgcccgacacgctctacggcgtctcgcccgcccggtacgacgaacacgtgctggccaaggacagggtccgtcacgcgggtgacgaagtggccgccgttgcggcgatcgacgagagaaccgccgagaaagccgtttcgctgatcgaagtcgaatacgaagagctccccgccgtcttcgacccgctggaggcggtcgttgatggagccccgcagctccacgaacggtacaagaacaacatcaacacacacgtcgagcaaagcttcggcgacgtcgagaagggctttgccgagtcgtactgtgttcgggaggagaccttcaccggcaaccatgtctaccagtcgccgctcgagccgcacgcttcgatcgcgacctgggatcacgacggcacgctggtgctctacagctctacccaagtgccgttctacgtgcagtacatgatggctcacgtgctgcacatcccgctcggaaagattcgcatcatccgcccggcggtcggcgggggcttcggcgggaaagccgccacaagcccgctcgatctctgctccgcgtttctcagcaagaaaaccggccggccggtcaagatggcctactcgcgcgaagagatgttccactacggccgcggccggcacaagcagcacatgagaatgaagctcggcgtcgaccgcgacgggaagatcaaagcgttcaagagtgagatttacctggacggcggagcctacacatcgttcggcgtcgcgaccgcctactacgccggtagcatgatgcccacgctataccacattcccaactacagctacgacgggtatcgcgtgatgaccaacaagccggcctgcggggccatgcgcgggcacggcgtgccgcagccgcgcttcgcgttcgagtgcctgctcaacatggtcgccgacgacctggggatcgaccccatcgagatccgtcggcgcaatgccatgacccccaacaccagaacggtcaacgacctggacatcggcagttgcgagttcctcgccacgctcgatgccgcctgcgagaaaagcggctggaacgaaaagtaccgacgagccgcgggcttcagcccgcgcggcgccgggaacgaaacaggtgcttcacaagaccaaacgagccgcggacttcagtccgcgcggcccaacgtccgcagaggcatcggcgtcggctgcggcggcttcgtttccggcgcgggttactgcatttaccgcggccaggtccagctttcgcacgaaaagcctcgcgaacacttccagaagaagtccatcttcccgcacgccaacgccatcgtgaagatcagcgaagacggcatggccgcgatcttgctgatcggcgccgcggagatcggccaaggcagcgacaccgttttgacccagatgtgcgccgagtcgttgggaatcccaacttcccggctgcgcatccgcagcgaagacagcgacatctcgccactcgatctgggggcctactcgtcgcgcgtcacgctgatggccggccacgccgtgtcccgcgccggagccgccgtcgtcgacaagatgcggccctacgccgccaaggtactcggctgcgcggagtctgaagtcgtcgcccacgacggcataatgttcgccaccggccgcaaggccaatccgcaatccgcaatccccaatccccaatcggttccctgggaagaggtcgcccgaaggtatttcaacgacaacggcccgctggtcggcaccggctgctacaagccccccgacggcctgggcggcgactacaagggcgccaccgtcggcaccagcccggcctactcgttcggtacctcggtctgtgaactctcggtcgacctggagaccggcaaggtcaagatcgaccgctttaccgactaccacgactgcggcacggcgatcaacccccgcgccgtccacggccaggtcgagggagccatcgtaatgggcgccggcgagacgatcatggaggacgtccagttcgacgagaagggacggattctgaacccgaacctgcacggctacctgatcatgaccatcaaggacgccccggagatcttcagcggcatcgtgaactcctacgagccccgcggcccctacggcgccaaagaaatcggcgaaggcagcaccctccccgtcttgggcgccgtcgcccacgccatcgccaacgccaccggcgtctggatcaaagaccttcccatcacgccggagaagatcctcaaggcgattcgtgagcggcggggaaccggggaatcgacagctatgtag

SEQ ID NO: 7030 - protein, 1019 aa, uncultured bacterium
MTTVPTLSVNGQHYRVAVDPGETLLDVLRDKLGLTGTKKGCNVGDCGACTVLVDGEPMNSCLLLASEMEGKAVTTIEGLAQNGELTPLQKAFVHEGGIQCGFCTPGMVVAATALLNKNPNPTADEIKDALAGNLCRCTGYTGILRAVQRCAGQEPQSHEATEPRRAEAAEPRSHEATKPRRDEAAEASRQSAIRNPQSAMQSVGVSIPRVDAADKVTGRAQYTADISLPNMIHGKILGSPIAHGRIKRIDVSKAKALPGVVAVITGADVPDTLYGVSPARYDEHVLAKDRVRHAGDEVAAVAAIDERTAEKAVSLIEVEYEELPAVFDPLEAVVDGAPQLHERYKNNINTHVEQSFGDVEKGFAESYCVREETFTGNHVYQSPLEPHASIATWDHDGTLVLYSSTQVPFYVQYMMAHVLHIPLGKIRIIRPAVGGGFGGKAATSPLDLCSAFLSKKTGRPVKMAYSREEMFHYGRGRHKQHMRMKLGVDRDGKIKAFKSEIYLDGGAYTSFGVATAYYAGSMMPTLYHIPNYSYDGYRVMTNKPACGAMRGHGVPQPRFAFECLLNMVADDLGIDPIEIRRRNAMTPNTRTVNDLDIGSCEFLATLDAACEKSGWNEKYRRAAGFSPRGAGNETGASQDQTSRGLQSARPNVRRGIGVGCGGFVSGAGYCIYRGQVQLSHEKPREHFQKKSIFPHANAIVKISEDGMAAILLIGAAEIGQGSDTVLTQMCAESLGIPTSRLRIRSEDSDISPLDLGAYSSRVTLMAGHAVSRAGAAVVDKMRPYAAKVLGCAESEVVAHDGIMFATGRKANPQSAIPNPQSVPWEEVARRYFNDNGPLVGTGCYKPPDGLGGDYKGATVGTSPAYSFGTSVCELSVDLETGKVKIDRFTDYHDCGTAINPRAVHGQVEGAIVMGAGETIMEDVQFDEKGRILNPNLHGYLIMTIKDAPEIFSGIVNSYEPRGPYGAKEIGEGSTLPVLGAVAHAIANATGVWIKDLPITPEKILKAIRERRGTGESTAM

SEQ ID NO: 7031 - DNA, 4062 bp, Arabidopsis thaliana
  CDS (1)..(4062)
atggagcagaacgagttcatggaggcaataatgtacgttaatggtgttcgtagagttttgcctgatggattagctcacatgacgcttctcgaatatctcagagatttaggattgaccgggacaaagctcggatgcggcgaaggtggttgtgggtcttgcaccgtgatggtgtctagttatgaccgagagtcaaagacatgtgtgcattatgctgtcaacgcttgcctagcacctctctactctgtagaagggatgcatgtaatatccattgaaggagttggtcatcggaaacttggcttgcaccctcttcaggagtcattggcatcttcgcatggttctcaatgtgggttttgtactcccggttttgtcatgtcgatgtatgccttgttgaggtcaagtaaaaactcaccttctgaggaggagattgaagaatgccttgcaggaaatttgtgtcgttgtactggttatagacccatcattgatgcgtttcgggtttttgcaaaatctgatgatgctctatacagtggtttatcttcacttagccttcaggacggttcaaatatttgtccatctactggcaaaccttgttcttgtggatcaaaaacaacaagtgaagcagctacttgtaatgaagatagatttcagtcaatctcttatagtgatatagatggagctaagtatacagataaggagcttatttttccccctgaacttctgctgaggaagttagctcccttaaagttagggggaaatgaggggattacctggtatagacccgtaagtcttcagaacttgcttgaactcaaagcaaattttcctgatgcaaaactactggttggtaacacggaggtgggaatcgaaatgagactaaagaggttacagtatccggtgctaatctctgctgctcaagtcccagaactcaacgcattgaatgtcaatgacaatgggatagaggttggttcagctttgagactttctgaactcctgaggttattcaggaaggtagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataatcaactgcaatggagatgctagatctatacctgcaaaagatttcttccttggctatcgtaaagtggatatgggaagcaacgagatcttgttgtcggtattccttccatggacaaggcctttagagtatgtgaaagaatttaagcaggcccatcgcagggatgatgatatagctattgtcaatggtggaatgcgtgtgtttcttgaagagaaagggcaacaattgtttgtttctgatgcatctattgtttatggtggtgtggctcctctttcgttgcgtgcaagaaacactgaggaacttctaattggtaagaattggaataaatgtcttctgcaagacgcacttaaggtcatacagagtgatgtcttgattaaggaaggtgctcctgggggaatggtggagtttcgcaaatctctaaccctaagcttcttctttaaatttttcttatgggttactcatcatgtaaataatgtaaatcccactatagagacctttccaccctcgcatatgtcagctgtgcaacttgttcctcggttctctagaattggaaaacaagactatgagacagtaaaacagggtacatctgttggcttgccagaggtccatctttcggcaagaatgcaggtcacaggggaagcagaatatactgatgataccccattgccgccttgtaccttgcatgctgctttagtgctaagtaaagttccacatgcccgcatcctttcagttgatgattcggcagccaaatcttcatctggttttgttggtctgtttcttgccaaagatgttcccgggaataatatgattggaccaattgttgccgacgaagaattatttgctacagacgtggtcacgtgtgtgggacaagtcattggtgtgcttgtcgcggatacacatgaaaatgcaaaaactgcagcaagaaaagttgacgttaggtatcaggaactgccagcaatattatcaatcaaggaggcgattaatgctaaaagtttccatccgaacacagagagaaggcttagaaaaggggatgtcgagctgtgctttcaatctggtcagtgtgacagaataatagagggagaggttcaaatgggtggtcaggaacacttttacttggagcctaatggtagtttggtttggactatagatggaggcaacgaagttcatatgatttcatccacacaagctcctcaacagcaccagaaatatgtgtctcatgttcttggtcttccaatgtctaaagtggtatgcaaaaccaaacgacttggtggtggctttggtggtaaggaaacaagatcagctttcattgctgcagcagcttctgttccttcctacctattgaatcgacccgtgaaactcatactggacagagatgtggacatgatgattactggtcatcgccatagtttcgttggaaagtacaaggttggatttacgaacgaagggaaaatattggcgttggaccttgaaatctacaacaatggtggaaactctatggatctctctctttctaatcttgaacgtgccatgtttcactcggataacgtttatgagatcccacatgtgaggatcgttgggaacgtttgctttactaattttcccagcaacaccgctttccgagggtttggagggccccaaggtatgcttataactgaaaattggattcagagaattgcagctgagctggataaaatccctgaagaaatcaaagagatgaactttcaagtggaaggatcgatcacacattactttcagtcacttcagcactgcacattgcaccaactctggaaagaactgaaagtatccagcaacttcctaaagactcgtagagaagcggacgagtttaatagtcataatcggtggaaaaagcgtggtgtagctatggttcccacaaaatttggcatatcctttaccacaaagttcatgaatcaggccggtgctcttgttcacgtttacaccgatgggactgttttggtgacacatggaggtgttgagatgggccaagggttgcatacaaaggttgctcaagttgctgcaacggcctttaacattctccttagttcggtttttgtgtcagaaacaagcaccgacaaggttcctaatgcgtcacctactgctgcttctgcgagttctgatatgtatggtgctgcagttttagacgcttgtgagcagattatagcaagaatggagcctgttgcatctaaacacaatttcaacacattctctgagctagcaagtgcctgctactttcaacgtatagacctatcagctcacggttttcacattgttccagaacttgaatttgattgggtatctggaaaagggaacgcatatagatattacacatatggagctgcctttgctgaagttgagatagatacattgactggtgattttcacacaagaaaagcagacataatgttggatctcggatattctcttaacccaaccattgatattggacaaatagaaggagcgtttgtacaaggactaggttgggtagctctagaagaactcaagtggggagatgcagctcataaatggattaaaccaggaagtttactcacttgcggacccggaagctacaaaataccttccatcaacgacatgccgttccaactgaatgtttctcttctcaagggtaatccaaatgcaaaggcaatacattcatctaaagcagtgggtgagccaccgttctttcttgcagcatcagccttctttgcaataaaggaagcaatcaaagcggctagaagcgaggtaggtctcaccaactggttccctctggagactccagccactccagagcgtatcaggatggcttgtttcgacgagttttcagctccttttgcaaattcagatttctgcccaaagcttagtgtttga

SEQ ID NO: 7032 - protein, 1353 aa, Arabidopsis thaliana
MEQNEFMEAIMYVNGVRRVLPDGLAHMTLLEYLRDLGLTGTKLGCGEGGCGSCTVMVSSYDRESKTCVHYAVNACLAPLYSVEGMHVISIEGVGHRKLGLHPLQESLASSHGSQCGFCTPGFVMSMYALLRSSKNSPSEEEIEECLAGNLCRCTGYRPIIDAFRVFAKSDDALYSGLSSLSLQDGSNICPSTGKPCSCGSKTTSEAATCNEDRFQSISYSDIDGAKYTDKELIFPPELLLRKLAPLKLGGNEGITWYRPVSLQNLLELKANFPDAKLLVGNTEVGIEMRLKRLQYPVLISAAQVPELNALNVNDNGIEVGSALRLSELLRLFRKVVKERPAHETSACKAFIEQLKWFAGTQIRNVACIGGNICTASPISDLNPLWMASRAEFRIINCNGDARSIPAKDFFLGYRKVDMGSNEILLSVFLPWTRPLEYVKEFKQAHRRDDDIAIVNGGMRVFLEEKGQQLFVSDASIVYGGVAPLSLRARNTEELLIGKNWNKCLLQDALKVIQSDVLIKEGAPGGMVEFRKSLTLSFFFKFFLWVTHHVNNVNPTIETFPPSHMSAVQLVPRFSRIGKQDYETVKQGTSVGLPEVHLSARMQVTGEAEYTDDTPLPPCTLHAALVLSKVPHARILSVDDSAAKSSSGFVGLFLAKDVPGNNMIGPIVADEELFATDVVTCVGQVIGVLVADTHENAKTAARKVDVRYQELPAILSIKEAINAKSFHPNTERRLRKGDVELCFQSGQCDRIIEGEVQMGGQEHFYLEPNGSLVWTIDGGNEVHMISSTQAPQQHQKYVSHVLGLPMSKVVCKTKRLGGGFGGKETRSAFIAAAASVPSYLLNRPVKLILDRDVDMMITGHRHSFVGKYKVGFTNEGKILALDLEIYNNGGNSMDLSLSNLERAMFHSDNVYEIPHVRIVGNVCFTNFPSNTAFRGFGGPQGMLITENWIQRIAAELDKIPEEIKEMNFQVEGSITHYFQSLQHCTLHQLWKELKVSSNFLKTRREADEFNSHNRWKKRGVAMVPTKFGISFTTKFMNQAGALVHVYTDGTVLVTHGGVEMGQGLHTKVAQVAATAFNILLSSVFVSETSTDKVPNASPTAASASSDMYGAAVLDACEQIIARMEPVASKHNFNTFSELASACYFQRIDLSAHGFHIVPELEFDWVSGKGNAYRYYTYGAAFAEVEIDTLTGDFHTRKADIMLDLGYSLNPTIDIGQIEGAFVQGLGWVALEELKWGDAAHKWIKPGSLLTCGPGSYKIPSINDMPFQLNVSLLKGNPNAKAIHSSKAVGEPPFFLAASAFFAIKEAIKAARSEVGLTNWFPLETPATPERIRMACFDEFSAPFANSDFCPKLSV

SEQ ID NO: 7033 - DNA, 2763 bp, uncultured bacterium 582
  CDS (1)..(2763): transl_table=11
atggataatgtggcgcggcttttggggcaatccaccgaatttaagttgaatggccggatggtgacagtgtcagcggccgctggcgcgcggctgtcgcacagtttgcgcgaacaattgggggccaaggatgtcaaaattggctgtaacgcaggtgattgtggcgcctgcacagtcttggtcgatggtgatccggtttgtgcctgcctgatgccaactcagcaggctgcaggcaaaacgcttgaaaccttggtggggcttgtggggcaggatccccgcgccaaagccttggtacagagctttcagaaccatcaggcggcgcaatgcggcatttgcacacccggcgttatggtttcggcggttgcgttgttacgcaatgtccgtacaccgacaatcggacagattcaggatgcactcgggggagtgttgtgccgttgtaccgggtaccgcaagattatcgacgcggtctgtgaagttgggcaggctgaggcgttcccagaggcggtcagtggctccggcgcggtcggaacgtctgtggcacgtctggacgggttgcaaaaacttcaggggcgcgaggtgtttggtgatgatgtcgccccaacacaggcgctggtgattaaagcggttcgctcgcctttcgcccgagcagagttccgctttggggatcttgaacactatgtgacctccactgctggggtacatgcggttttgaccgcggcggatgtgcccgggaaaaatgcgtttggcgtcatccccgcgtttcaggatcagccggtttttgctgagaaagaagcccggtttcgcggtgaagccgttgccgccgtgattggtaccgcaactgcgatggcgtgttttgatgaaaccggttttccggtgacttgggaagagcgtcacgctgtatctcaggttgcacaggcgctgatgaccacggcaccgcaactgcatgcagaccatcccaaaaacgtgatgtgcggcggctttgtggcgcgtggtgacgcacaaagcgggttgatcggtgccgaggttgtggtggaagggttgtttgaaaccggttttgtggagcatggatatatcgagccagaggctggcttcgccgaatgtgtggaagggcgtattgaggtgcatgcctgcacccaagcgccggtcatggatttagaaagtctggcggcaattctcggatgtgatcaacgtaaaattcggatacgacccaccgcggtcggaggcggatttggctctaagctggatttgtcagtccagccgtttctggcgctggcggcgctgaaaacgggtcagccggtgcgcatgacttacagccgcacagagacgatgcaagcgacaaccaaacgccacccctctcaaattaatctcaagataggcgcaacgaaagccggacggctgtgcgggtttgcatttaaaggagactttaacaccggggcctatgcctcatgggggccaacggttgccaatcgcgtgccggtgcatgcttcgggtccctatcagatagccaattaccgcgctgagtctcgtggaatctatacccattgtccgcccgccggggcgtttcgcggctttggtgttccgcaggcggcgattgcgcaagaaagcctatttgacgaattggcaaataaactggggatcgacgcgctggaatttcgcgagataaacgcgctggaagacggcgctgaaacagtttgtgggcaggtgtttgaacagggtgtcggcatcaaagcttgtctgcgggctttgcgttccgcctggcggcgggaaaaggcactttgcgccgcgttcaatgccgagaacgcatctcgaaagcgcggtgttggggtggctgctggctggtatggatgtggcaatacttcgctgcccaacccgtcgacgattaaatctggaattaccgcggatgggcgtatttttttgcatcaaggtgcgactgatatcgggcagggggccaatacggtaattacgcagatttttgcgcaggcgttgggggtatcggtgtacgatatccatctgttgggtcccgacacggatatcacgcccgacgcgggtaaaacatcggcctcgcgccagacgtttgtgtccggcaatgccgcgcgtctgtcgggcgaaagtttgcggcgcaaagtactggcactggcaaatgcaggtcccgatgcacctctcagctttgacgtcgggacggtgaccatcggggatagcgccgcgccgcatgtcgtggcattacagcggctgcctgaaggggcagacggctatgttcttacggcgacagaaacctatgatccgccaactctgcccttggatgaaaacggccaaggggtgccttatgcgcagttcggctatgcggcccatcttgctgtggttgaggtggatatccgtttggggtgcgtcacaccgcagcggttcacggcggcccatgatgtgggccaagcgatcaatccgctgctggtcgaaggtcaggtacaggggggcattgcgcagggattgggcatggccctaatggaggaatatctgccgggaaagactgaaaatctgcatgattatctggtgccaaccatcggagatgttccaccgatcgagacgttgattatcgaacgggccgatgccgagggcccctatggcgccaaaggactgggcgagcacgttctgatcccgacggccccggcgatattgaacgcgatcaaagatgcgaccggggtgcggctttatagcgtgccggccactccatcaagggtgcgcatggcattgaaagaggctgggtatgactga

SEQ ID NO: 7034 - protein, 920 aa, uncultured bacterium 582
MDNVARLLGQSTEFKLNGRMVTVSAAAGARLSHSLREQLGAKDVKIGCNAGDCGACTVLVDGDPVCACLMPTQQAAGKTLETLVGLVGQDPRAKALVQSFQNHQAAQCGICTPGVMVSAVALLRNVRTPTIGQIQDALGGVLCRCTGYRKIIDAVCEVGQAEAFPEAVSGSGAVGTSVARLDGLQKLQGREVFGDDVAPTQALVIKAVRSPFARAEFRFGDLEHYVTSTAGVHAVLTAADVPGKNAFGVIPAFQDQPVFAEKEARFRGEAVAAVIGTATAMACFDETGFPVTWEERHAVSQVAQALMTTAPQLHADHPKNVMCGGFVARGDAQSGLIGAEVVVEGLFETGFVEHGYIEPEAGFAECVEGRIEVHACTQAPVMDLESLAAILGCDQRKIRIRPTAVGGGFGSKLDLSVQPFLALAALKTGQPVRMTYSRTETMQATTKRHPSQINLKIGATKAGRLCGFAFKGDFNTGAYASWGPTVANRVPVHASGPYQIANYRAESRGIYTHCPPAGAFRGFGVPQAAIAQESLFDELANKLGIDALEFREINALEDGAETVCGQVFEQGVGIKACLRALRSAWRREKALCAAFNAENASRKRGVGVAAGWYGCGNTSLPNPSTIKSGITADGRIFLHQGATDIGQGANTVITQIFAQALGVSVYDIHLLGPDTDITPDAGKTSASRQTFVSGNAARLSGESLRRKVLALANAGPDAPLSFDVGTVTIGDSAAPHVVALQRLPEGADGYVLTATETYDPPTLPLDENGQGVPYAQFGYAAHLAVVEVDIRLGCVTPQRFTAAHDVGQAINPLLVEGQVQGGIAQGLGMALMEEYLPGKTENLHDYLVPTIGDVPPIETLIIERADAEGPYGAKGLGEHVLIPTAPAILNAIKDATGVRLYSVPATPSRVRMALKEAGYD

SEQ ID NO: 7035 - DNA, 3978 bp, Anopheles gambiae
  CDS (1)..(3978)
ctggtctttttcgtcaatggaaagaaggttaccgatgatgtgccggatcgagtgcacctcgtggtgtatctgcgtgaaaagttacgcctctgcggcacgaaatcgatgtgccgagagatgcgagcatgtacggtgatggtgtcgagtgatcgtaaacggctcactgcatcatctgctgtcaacgcttgtctgacgcgttgtgcgttcacggatgctgtgacgacggtcgaagtatcgaagtactcgacgcgcctccaccccgtccaggagcgcatcgccaaagcgcacggctcgcagtgtggcttctgtactcctggtatcgtcatgtcgatgtactcgttgctgcgcagctctcccgttccctcgatgaaagagctggaggttgcctttccaaggaatctgtgtcgctgcaccggctatcgaccgatcctggaggggtacaaaaccttcaccaaggagttcgcgctgcgcatgggagacaaatgctgtcgcaacggcaatggtaacggatgtggacagaacggcaacggagagctagacaccgagctgttccagccgaacgagttcgttccttacgatccatctcaagagcccatttttccaccggaattgaagctttccgacaagctcgactctgaatcgctggtctttcggacctcccgtaccgcttggtatcgaccaacaacgctcaacgatctgttggccctcaagaaagctcatccggagacgaagatcgtcgtcggtaacacggaagtgggcgtggaagtgaaattcaaacactttgagtatccgtcctcgccaatccatccaaataaaggagttgacgacgatcgagcgacaagcagtggactcaaaataggatccgccgtcacgttaatggaaatggagatcgcgctggcaaagaaatcgaaaccggtccttgaaacggagactcgtctgtaccaagcgatcgtcgacatgctgcactggttcgctggaaagcagatccgtaatgttgcctctgttggaggaaacatcatgacgggaagccccatttcggatctaaatcccatcttcacggcagccgcgatcgagctggaagtggccagcctcgacggaggcttccgcaaggtgcgcatgggtgatggattcttcactggctaccggaagaacgtcattcaaccgcatgaggcgctcgtttcgctgtttatcccacgcaccaccaaggatcaatacttcatcgcacacaagcaggccaaacgccgcgatgatgatattgccatcgtgaatggagcgttcaatgtgcgtttccgacccggtacgatagtcgtcgatgagatccatctggcctttggtggaatggcgccaacgacagttctggccaagaagacggccaccgctctagtcgggacgcgatgggacgcacagctcgtggagcgttgcaatgatttgctggtggaagagcttcctctaagtccttcggctccgggcggcatgatcgtgtatcgtcgttcattgactttgagtctctttttcaaggcttatcttgccattgcacaatcactcgataagcaatccattccccacaggacacccgttggcgaacgggagaaaagtggagccaatacgttccatacgctggtacccaagagcactcagctgttcgagaaggtttctggcgatcaaccggctaccgatcccattcgtcgaccgcaagtgcacgcttccgcttataaacaagtcaccggggaagctatctattgtgacgacattccaaagtttgccaacgagctgtatctagcatttgtgtacagtacaaaggcacacgccaagattctgtcgatcgatgcatcggaagcactggaacaggaagggtgtcatcggttctttagcgcagatgacttgaccgaagaacaaaacaaggctggtccagtgttccacgatgaatttgtctttgtgaaagatgtcgttactacgcagggacaaataattggagctattgtggccgacaatcaaacaattgcacaaagagccgctcgccaggtgaaagtcacttacgaagaactgcagccggtaatcgttacgctggaggatgctatcagactggagtcgttctatcccggattccccagaatcattgccaagggagacgttgagaaagctctgtccgaggcggatgttatcatcgaaggtgattgtcgcatgggtggacaggagcacttctacctagaaacgcaagcatgttctgctgtgccgaaggattcagacgaaatcgaggtgattagcagcacccagcatcctaccgagattcaacaccacgtggcgcaaactctgggcatacccgcctcgaaggttgtttctcgtgtgaagcgtcttgggggtggttttggtggcaaggaatcgcgtgctgccattgtggccattccggttgctttggccgcgcaccgcatgggcagacccgtccgctgcatgcttgacagagacgaagatatggcagtgtccggtacgcgacatcctttctacttccattacaaagtgggagtcagcaaggacgacaagctgttggccggcgatttccgcgcttacaacaatgccggccattcgatggacctgtcctttgccgtgctggagcgttcaatgttccacatccaaaacgcgtatcgtatcccgtcatctggctgtccgtggatgggtttgtcgcacaaactaccttcaaacaccgctttccgggctttcggtggtccgcagggcatgatggcggcagaaacaatgatgcgccatgtggcccgcacactgaaccgggactacgtcgagctgatcgagctgaacatgtaccgggaaggcgatacaacgcactacaaccagcagatcgagggctgtaatgttggtaagtgctggagtgaggttttgcaatcggccgattttgccaaacgccgggaagcggtcgaaaagttcaacgaagaacaccgttggcgcaaacgcggcattcacgtcgtgccgacaatgttcggcatcgctttcaccgtgctgcacctgaaccaaagcggcgccctgattcacgtgtaccaggatggcacggtgctgctaacccatggcggtaccgagatgggccagggactgcacacgaaaatgattcaggttgctgccacggcgctaggaattcctttcgatcgcatccacatttccgagacgtctaccgacaaggttccgaacacttcggctacggcggccagtgctgggtcggatctaaacggcactgcggtgctgaatgcttgcctcaccatccgcgagcgattggaacctatccgcaaagagttccccgacaaggactggaacttctgggtcagtaaggcgtacttcagccgggtgtcgctgtccgccactggattctatgcgacgcccgatctgggctacgattttggcaccaattcgggcaaagcgttcaactactacacttacggtgcggcttgctcggaggtagagatcgactgtctgactggagaccatcaggctatccgaaccgacgtcgtaatggacctgggctccagcattaatcctgccatcgatatcggccaaatcgaaggtggattcatgcaaggctacgggctattcacgctggaagaaatggtctactcgccccagggtcaggtgttttcccgcggtcctggcatgtacaaattgcccggttttgccgacatccctggggagttcaacgtttcactgctcactggggcgcccaatccgcgcgcagtttactcatcgaaggccgttggtgaaccgccacttttccttgcctcgtccatattcttcgcaatccgcgatgctattgccgcggctcgaaaggaggaaaaactgtccgacgattttacattagtttcaccggccacttcgtcgcgcatccgcacagcttgtcaggataaatttgtagaacgctttacgaagcagcaaagcaatggaggggaagcagctcgcgtcgttccatggaatgtaatgccttaa

SEQ ID NO: 7036 - protein, 1325 aa, Anopheles gambiae
LVFFVNGKKVTDDVPDRVHLVVYLREKLRLCGTKSMCREMRACTVMVSSDRKRLTASSAVNACLTRCAFTDAVTTVEVSKYSTRLHPVQERIAKAHGSQCGFCTPGIVMSMYSLLRSSPVPSMKELEVAFPRNLCRCTGYRPILEGYKTFTKEFALRMGDKCCRNGNGNGCGQNGNGELDTELFQPNEFVPYDPSQEPIFPPELKLSDKLDSESLVFRTSRTAWYRPTTLNDLLALKKAHPETKIVVGNTEVGVEVKFKHFEYPSSPIHPNKGVDDDRATSSGLKIGSAVTLMEMEIALAKKSKPVLETETRLYQAIVDMLHWFAGKQIRNVASVGGNIMTGSPISDLNPIFTAAAIELEVASLDGGFRKVRMGDGFFTGYRKNVIQPHEALVSLFIPRTTKDQYFIAHKQAKRRDDDIAIVNGAFNVRFRPGTIVVDEIHLAFGGMAPTTVLAKKTATALVGTRWDAQLVERCNDLLVEELPLSPSAPGGMIVYRRSLTLSLFFKAYLAIAQSLDKQSIPHRTPVGEREKSGANTFHTLVPKSTQLFEKVSGDQPATDPIRRPQVHASAYKQVTGEAIYCDDIPKFANELYLAFVYSTKAHAKILSIDASEALEQEGCHRFFSADDLTEEQNKAGPVFHDEFVFVKDVVTTQGQIIGAIVADNQTIAQRAARQVKVTYEELQPVIVTLEDAIRLESFYPGFPRIIAKGDVEKALSEADVIIEGDCRMGGQEHFYLETQACSAVPKDSDEIEVISSTQHPTEIQHHVAQTLGIPASKVVSRVKRLGGGFGGKESRAAIVAIPVALAAHRMGRPVRCMLDRDEDMAVSGTRHPFYFHYKVGVSKDDKLLAGDFRAYNNAGHSMDLSFAVLERSMFHIQNAYRIPSSGCPWMGLSHKLPSNTAFRAFGGPQGMMAAETMMRHVARTLNRDYVELIELNMYREGDTTHYNQQIEGCNVGKCWSEVLQSADFAKRREAVEKFNEEHRWRKRGIHVVPTMFGIAFTVLHLNQSGALIHVYQDGTVLLTHGGTEMGQGLHTKMIQVAATALGIPFDRIHISETSTDKVPNTSATAASAGSDLNGTAVLNACLTIRERLEPIRKEFPDKDWNFWVSKAYFSRVSLSATGFYATPDLGYDFGTNSGKAFNYYTYGAACSEVEIDCLTGDHQAIRTDVVMDLGSSINPAIDIGQIEGGFMQGYGLFTLEEMVYSPQGQVFSRGPGMYKLPGFADIPGEFNVSLLTGAPNPRAVYSSKAVGEPPLFLASSIFFAIRDAIAAARKEEKLSDDFTLVSPATSSRIRTACQDKFVERFTKQQSNGGEAARVVPWNVMP

SEQ ID NO: 7037 - DNA, 4095 bp, Neurospora crassa
  CDS (1)..(4095)
atggctccaagcgctgtccccgtggagtcgggcgccacccctctaaacttgggatcactgcccggatccctaacgacgacattcgacgacactctccgattctacctcaacggcacccgggtggtcttggatgacatcgacccggaaatcactttgttggaataccttcgtggtatcggtttgacgggcacaaaactcggctgtggagagggtgggtgtggagcatgcactgttgtcgtctcccagttcaacccaacaacaaacaaaatttaccatgccagtgtaaacgcctgtctggcaccattagtatctgtcgacggcaagcatgtcatcactgtcgagggtatcggcaacgtcaagaagccacatcccgcccaggaacgggtggcaaagggtaatggctcccagtgcgggttctgtacgcccggcattgtcatgagcttgtacgctcttctgcgtaacaatgacaacccctcagaacacgacattgaggaggcgtttgatggaaacctctgcaggtgtaccggataccgccctattctggacgctgctcacactttcatcaagaaggcgccttcagcttgcggtaacagcaaggcgaatggcggcagtggatgctgtatggagggaggtggtggtggtggtggctgcggaggagcaaatcagaacggagacgaccagcccatcaagcgcttcactcctccaggattcatcgagtacaacccagagaccgagctcatcttccctccagcactcaagaagcaggagtttaggccactttcgtttggaaacaagcggaaacgatggttccgtcccaccaagctggagcagctgcttgagatcaagaaagtgtaccccaatgccaagatcattggtggcagcacggaaacacaaatcgagatcaagttcaaggctcttcaatatcccatttctgtctttgttggcgatattcccgaactacgacagtatttcttgaaggaaaatcatctcgaggtgggcggcaacatcactcttaccgatctggagaatgtctgccaggaagccatcaagcactatggagagaagagggggcagatcttcaatgccatgtacaagcagctcaagtactttgctggcaggcagatcagaaatgtcggtacaccagcagggaacttggtgactgcctcacccatctccgacttgaacccagtactgctggctgctgatgctgtcctggtggccaagtctctcggcgaaaatggaattgttgagaccgagatccccatgtcccagttctttacgggttatcgccgtacggcacttccgcaggacgctattctggctgctattcgtgtcccgctaactcgggagaaaaacgagctcttcagggcttataagcaggccaagaggaaggatgacgatattgctatcgttacttctgccttcagagttcgcctgaacgaggacggcattgtcgaccaatgcagccttgtctacggcggtatggcacctacaaccgtcggtgccaagacggcaaattcgtatcttctgggcaagaagttcgccgaacaagagacattggaaggtgtcatgaatgcgttggagcaggacttcaacctttcattcagcgtaccgggaggcatggccacttacagaaagtcgctggccattggtctcttttaccgattctaccacgagtttatgctcattctaggtagtagcgccgatgaagaggttgtacccgagctggagagggaaatctctactggtcaggaagatagagaggcggctgctgcttacatgcaggagactgttggaaagtcaaatcctcatcttgcggcgctcaagcaggtaacgggagaggctcaatataccgacgacattccaccactcaagaacgaactgtacggttgcctggtcctctctaccaaggcgcatgccaaactcttgtccgttcacgcttcagctgcgttggatattccaggagttgttgactacatcgacaagaatgacatgcctaatgccgcagccaatcactggggtgccccccactaccaagaagtcttcttcgccgaagacacggtctacacggctggtcagcctattggtcttattgttgctacatcggctgcccgtgctgccgagggtgccagagctgtcaaggtggaatatgaggagttgcctgccatttacaccatggaggaggctatcgagaaggagagcttctttgacttcttcagggagatcaagaagggtgatacgcaagaaggcttcaagaactccgactatgtcttctctggtgttgccaggatgggcggtcaggagcacttttacttggagaccaacgccacgttggcgatccccaagcacgaagacggcgagatggagatcatctccagtacccagaatcccaacgaagctcaagcatatgctgcccgtgtcttggatgttgcggccaacaagattgtggtcaaggtcaagcggttgggaggtggttttggtggaaaggagacaagatcggtgcagcttagcagtatcattgcccttgccgcgcagaagactggccgcccagtccgctgcatgctgactcgtgaagaagacatggtcatctccggacagcgtcaccccttcttgggccggtggaagatgggtgtcaacaaggatggcaagatccaggcccttgaagtcgacatcttcaacaatggtggttggtgttgggacctgagtgccgccgtctgcgagcgtgccatgacacactcggataactgctatagcattcccaacatgcatgtcaccggccgcatttgcaagaccaacaccatgtccaacaccgccttccgtggttttggcggccctcagggcatgttcattgccgagtcgtatatgaatgaagttgccgatcgtctcggcatgcctgttgagagattccgtgagatcaatttctacaagcctggcgagcgcacccacttcaatcaagagattcaagattggcacgttcctctgatgtggggacaggttatgaaggaggccgagtacgagtcccgtcgcgaggccatcgccaagtacaacgtcgagcacaagtggcgcaaacgcggtcttgccatcatccccaccaagttcggtatctccttcactgccttgtggttcaaccaagccggtgccctcgttcacatttaccacgacggctccgtgctcgtcgctcacggcggtaccgagatgggtcaaggcctacacaccaagatgacgcagatcgccgctcaagctctcaacgtccccctcgagaacgtcttcatctcggaaaccgccaccaacaccgtcgccaacgcctcagccactgccgcttccgcctcctccgatctcaacggttacgctatctacaacgcctgccaacaacttaacgagcgtctcgccccttaccgcgagaagctcggccccgacgccaccatgaaggaccttgcccacgccgcctactttgaccgcgtcaatctgtccgcccagggcttctacaagacgcccgagatcggctacacctggggcgagaacaagggcaagatgttcttctacttcacgcagggtgtcacggccgccgaagtcgaaatcgacacgcttacgggtacctggacgtgcttgcgcgccgacatcaagatggatgtcgggcagagtatcaaccctgccattgactacgggcagatccagggcgcttttgtgcaaggtttgggattgtttaccatggaagagtcgttgtggatgcgcaacggaccgatggcgggtaacttgttcacccgcggcccgggcacatacaagatccctggcttccgcgatatcccgcaaaagtggaatgttagcttgctcaaggacgtggagtggaaggagctgaggacgattcagaggagtagaggtgtcggcgagccgccgctgttcatgggcagcgccgtgttctttgccattcgtgatgcgctcaaagcggcgagagcgcagtatggtgatgatgggttgttgaggctggagagcccggcgacgccggagaggatcaggttggcatgtgttgatcctattgttgagagggcgagggtgttgccgaaggagggagagaagagcttctttattgccatctga

SEQ ID NO: 7038 - protein, 1364 aa, Neurospora crassa
MAPSAVPVESGATPLNLGSLPGSLTTTFDDTLRFYLNGTRVVLDDIDPEITLLEYLRGIGLTGTKLGCGEGGCGACTVVVSQFNPTTNKIYHASVNACLAPLVSVDGKHVITVEGIGNVKKPHPAQERVAKGNGSQCGFCTPGIVMSLYALLRNNDNPSEHDIEEAFDGNLCRCTGYRPILDAAHTFIKKAPSACGNSKANGGSGCCMEGGGGGGGCGGANQNGDDQPIKRFTPPGFIEYNPETELIFPPALKKQEFRPLSFGNKRKRWFRPTKLEQLLEIKKVYPNAKIIGGSTETQIEIKFKALQYPISVFVGDIPELRQYFLKENHLEVGGNITLTDLENVCQEAIKHYGEKRGQIFNAMYKQLKYFAGRQIRNVGTPAGNLVTASPISDLNPVLLAADAVLVAKSLGENGIVETEIPMSQFFTGYRRTALPQDAILAAIRVPLTREKNELFRAYKQAKRKDDDIAIVTSAFRVRLNEDGIVDQCSLVYGGMAPTTVGAKTANSYLLGKKFAEQETLEGVMNALEQDFNLSFSVPGGMATYRKSLAIGLFYRFYHEFMLILGSSADEEVVPELEREISTGQEDREAAAAYMQETVGKSNPHLAALKQVTGEAQYTDDIPPLKNELYGCLVLSTKAHAKLLSVHASAALDIPGVVDYIDKNDMPNAAANHWGAPHYQEVFFAEDTVYTAGQPIGLIVATSAARAAEGARAVKVEYEELPAIYTMEEAIEKESFFDFFREIKKGDTQEGFKNSDYVFSGVARMGGQEHFYLETNATLAIPKHEDGEMEIISSTQNPNEAQAYAARVLDVAANKIVVKVKRLGGGFGGKETRSVQLSSIIALAAQKTGRPVRCMLTREEDMVISGQRHPFLGRWKMGVNKDGKIQALEVDIFNNGGWCWDLSAAVCERAMTHSDNCYSIPNMHVTGRICKTNTMSNTAFRGFGGPQGMFIAESYMNEVADRLGMPVERFREINFYKPGERTHFNQEIQDWHVPLMWGQVMKEAEYESRREAIAKYNVEHKWRKRGLAIIPTKFGISFTALWFNQAGALVHIYHDGSVLVAHGGTEMGQGLHTKMTQIAAQALNVPLENVFISETATNTVANASATAASASSDLNGYAIYNACQQLNERLAPYREKLGPDATMKDLAHAAYFDRVNLSAQGFYKTPEIGYTWGENKGKMFFYFTQGVTAAEVEIDTLTGTWTCLRADIKMDVGQSINPAIDYGQIQGAFVQGLGLFTMEESLWMRNGPMAGNLFTRGPGTYKIPGFRDIPQKWNVSLLKDVEWKELRTIQRSRGVGEPPLFMGSAVFFAIRDALKAARAQYGDDGLLRLESPATPERIRLACVDPIVERARVLPKEGEKSFFIAI

SEQ ID NO: 7039 - DNA, 4095 bp, Solanum lycopersicum
  CDS (1)..(4095)
atggaagaaaaacaaaagaaagtgagtttggttttggcagttaatggagaaaggtttgagttgccatgtgttgatccttctacaactctgcttcagttcttgcgctctgagacttgtttcaagagtcccaagcttggttgtggtgaaggtggttgtggagcttgtgtcgttctggtgtcgaagtatgatcccagtcataaaaaggttgaagattttagcgtgagttcgtgccttacacttctttgcagtttgaatggttgttcaattactacaagtgaaggccttgggaacaccagagatggttttcactctattcatgaaagatttgccggtttccatgcttctcaatgcggcttttgcactcctggcatgtgtatgtcatttttttcagctcttgtcaatgccgataaaggaaacaaacccaatcctccatcaggattctctaagcttacttcatctgaagctgaaaaggccatcacagggaacctttgtcgatgcactggataccggcccattgctgatgcctgcaagagttttgctgctgatgttgatatagaggatttggggttcaattctttttggaaaaagggagattccaaggaagtgaaagtaagtaagttacctccctatgatccaactaagaattttagtacatatcctgagttcttgaaaagtgaatccactacgaattcggactcctcaaggagatacccttggtacagtcctgtttccattgaggagctacggagcttgttgtactccaatgtgatggaaaatggtgcaagctttaaacttgtcgttggtaataccggcacaggttattataaggaaactcagccatatgatcattatgttgatctcaggtacattcctgaatcctcaatcatcgaaagagatcagaatggcattgaagttggagcaaccgtgactatctctaaactgatttcattcttgaaagaggaaaacatagtcaatattggttcatacgggacgttggtgtcccaaaaactggctagacacatggagaagattgcttcaccatttgttagaaactctgctagtgtgggaggaaatttggttatggcacagaagaatggttttccttcagatattgctacattatttcttggacttagtgctactgttagattgatgaccagtcatggatttgaaaagctctcattggaggagttattatcgagaccaccgctagactcaaagactgtgcttctaagtgtttgcatcccatttaagaatgctcaaagttctctccaaactaactctaaattgttgtttgaaacctttcgagcttctccacgacctcatgggaatgccattgcatatgtaaatgcggctttccacgctgatgtttctcactgcaagaacggtgtcctgataaacaatatccagttggcgtttggtgcttatggaacaaaacatgcaacaagggctaaaaaagtagaggaatatctagaggggaagatattaaatgtacatgttttatatgaagcacttaaattggtcaaactagcagtaataccggaagatgacactctacaccccgagtacagatcaagcttggccgtcagttatgttttcaagtttcttcatcccttaactgatgttcattctgctatttctggtggtttactcaatggaattagtgacatctcagttgaggaactttctaaaagttgtaatgatggtcgcattagtcaggggagagaacaaacactattgtcttctgctaagcaagtcgtggaatattcaagcaccgagtactatccagtcggtgaaccgatgaagaaggttggagctgcgatgcaagctgctggtgaagctgtttatgtagatgacattccttcaccaccaaactgcctgcatggatcatttatctatagtacaaaaccattagcaggtgtaactggaatccaactcgagtcaaatcgattaacagatggagtcaccgctgttattacttttaaagatatcccaagcggaggggaaaatataggagttcttacaaagtttggtaccgagcccttattttcagatgatctcgcccgatatgctggcgacagagttgctgttgtggttgctgacagtcagatgtctgctgatgtggctgcaagaacagccctcgttgagtacgacactgaaaatatagatcctcccatcttaaccgttgaggaggctgttgagaaatctagctttttccagatcccaccatttctaaatccaaaacaggttggtgatttctccaaaggaatggctgaggcagatcacaagattctctctgctgagataaggctcggttccgaatactatttttatatggagacacagactgcccttgcgattccagatgaagacaactgcatggttgtttatacttcaagtcagtaccctgagtattcgcatcgtgttattgccagttgtcttggtgttcccgaacacaatatccgcgtaattacaagaagggttggaggtggctatgggggcaaggcaatcagagcaatgcctgtttccgcagcctgtgcactagcagcatacaagttaagacgacctgtcaggatatacgtcaaccggaatagtgacatgataatgacaggaggacgacacccgatgaaagtaacgtacagtgtaggattcaaatcgagcggaaagatcacagcattacatcttgatatattgataaatgccgggatctcggaagatgtaagccccattgtaccatcaaatgtgataaaagcactaaaaaaatatgattggggtgccttatctttcaatgtaaaactgtgcaagacgaatctttccagcaaatcagctatgcgggcccctggtgaagtgcaaggatcttatatagccgaagctataatggagcgtgttgcaggtttactttcgatggaggtggactcagtcagaaacaaaaatttccatacatttgaaagccttaatttattctatggtaacattgtagcagaaggagaatatacattgcctagtatcatggataagttggcagtgtcctcaagctttttccaacgaagcaagatgatagaacagttcaaccagaataacacatggaagaaaaggggtatttctcgagtgccaatcgtgtatgaagtcatgcaaagaccaacctcaggaaaagtcagtattctgcaagatggatcaatcgtagtagaggttggagggattgaactaggccaagggctatggacaaaggttagacaaatgactgcttatgctcttggttttattgatagtagttgggctgaagacctcgtggagaaagtacgagtcatacaagcagacaccttaagcttagtacaagccgggtttacagctggaagcactacatcggaatcaagctgtgaagctgttagactttgctgtgacgtattggttgaaagactgacccctttgaagaaacagctgcaggaacaaaatggttctgttgattggccaatgctgattctccaggcacaaacgcaatcagtaaacttagcagcaaattcttattatgtaccagaatccggttccatgagttatttgaactttggcgctgctgtcagtgaggtggagattgatattctgactggagagacagccattttgcagtcggatattatttacgactgtgggcagagcttgaatcctgctgttgatttgggacagattgaaggggctttcgtacaaggaattggatttttcatgcacgaagaatatctcaccaacgaagacgggctaatggtctcgaatagcacttggaaatacaagatcccaacaattgacactatacctcggaatttcaatgttcatgtgctaaacagtggacatcatgaaaaacgtgttctctcgtctaaagcatctggtgaaccgcctctgcttctggcagcttcggtccactgtgcaacaagagaagctgttaaagcagcacgcgaacagctcaaactttggggcaatctggacgggtctgtttcagaattctatctggacatccccgccatattacccgttgtgaagacacagtgtggcctggattatgtagagaaatatttggaaagtatcttggctcagaaatctaactaa

SEQ ID NO: 7040 - protein, 1364 aa, Solanum lycopersicum
MEEKQKKVSLVLAVNGERFELPCVDPSTTLLQFLRSETCFKSPKLGCGEGGCGACVVLVSKYDPSHKKVEDFSVSSCLTLLCSLNGCSITTSEGLGNTRDGFHSIHERFAGFHASQCGFCTPGMCMSFFSALVNADKGNKPNPPSGFSKLTSSEAEKAITGNLCRCTGYRPIADACKSFAADVDIEDLGFNSFWKKGDSKEVKVSKLPPYDPTKNFSTYPEFLKSESTTNSDSSRRYPWYSPVSIEELRSLLYSNVMENGASFKLVVGNTGTGYYKETQPYDHYVDLRYIPESSIIERDQNGIEVGATVTISKLISFLKEENIVNIGSYGTLVSQKLARHMEKIASPFVRNSASVGGNLVMAQKNGFPSDIATLFLGLSATVRLMTSHGFEKLSLEELLSRPPLDSKTVLLSVCIPFKNAQSSLQTNSKLLFETFRASPRPHGNAIAYVNAAFHADVSHCKNGVLINNIQLAFGAYGTKHATRAKKVEEYLEGKILNVHVLYEALKLVKLAVIPEDDTLHPEYRSSLAVSYVFKFLHPLTDVHSAISGGLLNGISDISVEELSKSCNDGRISQGREQTLLSSAKQVVEYSSTEYYPVGEPMKKVGAAMQAAGEAVYVDDIPSPPNCLHGSFIYSTKPLAGVTGIQLESNRLTDGVTAVITFKDIPSGGENIGVLTKFGTEPLFSDDLARYAGDRVAVVVADSQMSADVAARTALVEYDTENIDPPILTVEEAVEKSSFFQIPPFLNPKQVGDFSKGMAEADHKILSAEIRLGSEYYFYMETQTALAIPDEDNCMVVYTSSQYPEYSHRVIASCLGVPEHNIRVITRRVGGGYGGKAIRAMPVSAACALAAYKLRRPVRIYVNRNSDMIMTGGRHPMKVTYSVGFKSSGKITALHLDILINAGISEDVSPIVPSNVIKALKKYDWGALSFNVKLCKTNLSSKSAMRAPGEVQGSYIAEAIMERVAGLLSMEVDSVRNKNFHTFESLNLFYGNIVAEGEYTLPSIMDKLAVSSSFFQRSKMIEQFNQNNTWKKRGISRVPIVYEVMQRPTSGKVSILQDGSIVVEVGGIELGQGLWTKVRQMTAYALGFIDSSWAEDLVEKVRVIQADTLSLVQAGFTAGSTTSESSCEAVRLCCDVLVERLTPLKKQLQEQNGSVDWPMLILQAQTQSVNLAANSYYVPESGSMSYLNFGAAVSEVEIDILTGETAILQSDIIYDCGQSLNPAVDLGQIEGAFVQGIGFFMHEEYLTNEDGLMVSNSTWKYKIPTIDTIPRNFNVHVLNSGHHEKRVLSSKASGEPPLLLAASVHCATREAVKAAREQLKLWGNLDGSVSEFYLDIPAILPVVKTQCGLDYVEKYLESILAQKSN

SEQ ID NO: 7041 - DNA, 4104 bp, Solanum lycopersicum
  CDS (1)..(4104)
atggaggaaagacagaaaaaagggggttcattggtttttgcagttaatggagagaggtttgagttgccatgtgttgatccttctacaactttgcttcagttcttgcgctctcagacttttttcaagagtcctaaacttggttgtggtgaaggtggttgtggggcttgtgttgttctggtatcgaagtatgatccaaagcttaaaaaggttgaagattttagcgtaagttcatgccttacacttctttgcagtttaaatggtttttcaattactacaagtgaaggtcttgggaacaccagagatggtttccactctattcatgaaaggattgccggtttccatgcttctcaatgcggcttttgcactcccggcatgtgtatgtcatttttctccgctcttgtcaatgccgataaaggaaacaagccagatcctccaccgggattctctaagcttacttcgtccgaagctgaaaaggcaatagaaggaaacctttgtcggtgcactggataccggcccattgctgatgcctgcaagacttttgctgctgatattgatatagaggatttaggattcaatgctttttggaaaaacggagattccaagcaaatgaaagtaagtaaattacctccctatgatccaactaagaacttcaatacatatcccgagttcttgaaaagtgaatccaccacgaatttagactctttaaggtactcttggtatactcctgtttccattgaggatctacagagcttgttgaactccaacgtgacagaaaatggtgcaagctttaaactagtcgttggtaatactggaacaggttattataaagaaactcagcgatatgatcattacattgatctaaggtacattcccgaactctcgatcatcaaaagagatcaggcaggcatcgacattggatcaactgtgacaatctataaactcatttcattcctgaaagaggaaagtaaaatcaatttcggttcatatgggaagttggtgtccgataaactggcttaccacatggagaagattgcttcaccatttgttagaaattctgctagtgtgggaggaaatttggttatggcacagaagaatggttttccttcagatatagctacattatttcttgggctttgtgctactgttagcttgatgactcgtcatggacttgtaaagctcacatgggaggagttattgttgaaaccaccactggactcgagaattgtgcttctaagtgtttcgatcccatttaagaaagatcaaaattctaaatttttatttgaaacttatcgagctgctccacgacctcatggaaatgcattggcatatgttaatgctgctttccaggctgatgtttctctctgccagaacggcttcttgataaactatatccggttggcatttggtgcttatggcacaaaacacgcaacaagggctaaaatgatagagagatatctaaccgggaaaatgttaaacatacaagttttatatggagctcttaaattagtcaaactagcagttgtaccagaagatggcacttcacatcctgagtacagatcaagcttagctgtcagttatgtttttgagttcctttatcccttcactgatgctcattctgccctttctggtggtttattcaatggaattaatgatacctcagtcgaaaaggttttgaaaagtagtaaagatggttgcattagtcaggggagaaaacaaacactactctcttctgctaagcaggttgtggaatcaagtaccgagtactatccagtaggtgaaccgatgaagaaggtcggagctgccatgcaagctgctggtgaagctgtttatgtagatgacatcccttcaccgccaaactgcctgtatggagcatttatatacagtacgaaagcattagcaggtgtaaagggaatccagctcgaatcgaatcaattaacagatggagtcgccgccgttattacttttaaagatatcccaatcggaggggcaaatataggagctactagattttctgatcccgagcccttatttgcagatgatctcgtccgatatgctggcgacagaattgcaattgtggttgctgacagtcagaggtctgctgacgtggctgcaagaacagcccttgttgaatacgacactgcaaatgtagattcgcccattttaaccgttgaggaagctgttgagaaatctagctttatccaaatcccgccgtttctatatccaaaacaggtcggtgatttctcgaaaggaatggctgaagctgatcacaagattctctcagctgaggtaagacttggttctgagtactatttttatatggagacacagactgctcttgcaattccagacgaagacaactgcatggttgtttatacttcaagtcagtgccctgagagcgcacatcgtgtgattgccacttgtcttggtgttcctacacacaatatccgtgtaattacaagaagggtcggaggtggttttgggggcaagggagtcagagcaatgcctgtctccacagcctgtgcacttgcagcatacaagttaaggcgacctgtcaggatatatgtcaacaggaacactgacatgataatgacaggaggaagacacccaatgaaagtaacatatagtgtaggattcaagtcgagcggaaagatcacagcattacatcttgatctattgataaatgctgggatctcagaagatgtaagccctatcctaccattaagtgtgataaaagcactaaagaaatatgattggggtgccctatcttttgatgtaaaactatgcaagacaaatcttaccagcaaatcgactatgcggggccctggggaggtgcaaggatcttacattgctgaagctataatcgaacatgtatcgagttcactattgttggaggtggacttggtcagaaataaaaatgcccatacatttgaaagcctcaattttttctatggtaacattgtatcggtaggagaatatacactgcctagtatcatggataagttggctgtgtcctcgagctttttcaaacgaagagagatgatcaaacagtttaaccagaaaaatacatggaaaaaaaggggtatttctcgagtgccaatcgtgcatgaagtttcgcaacgatcgaccccggggaaagtcagtattctgcaagatggatcgattgttgtagaggttggagggattgaaattggccaagggctatggacaaaggtgaaacagatgactgcctatgctcttggtttaattgaaagtagttgggccgaagaccttgtggagaaagtaagagtcatacaagcagacaccttaagcatagtgcaaggtgggttgacggcagggagcactacatcggaatcaagctgtgaagctgttagactttgctgtaatgtcttggttgaaagactgactcctttgaagaatcagttgcaggaacaaaatgtctctgttgactggccaacactgattcgacaggcacaaatgcaatcagtacacttagcagcacattcttattatgtaccagaatctagttccaagaattatttgaacttcggcgctgctgtcagtgaggtggagattgatattttgactggagagactactattttgcaatcggatattatttatgactgcgggcagagcttgaatccagccattgatttgggacagattgaaggggcatttgttcaaggaattggatttttcatgcatgaagaatatcttacaaacgaagacgggttaatggtctcaaatagcacttggacgtacaagatcccgactattgacaccatacctcagaatttcaatgtccatgtggtaaacagtggacatcacaaaaagcgtgttctctcgtccaaagcatctggtgaaccaccgttgctgctggcagttagtgtccattgtgcaacacgagcagcggttaaagcagcacgtgaacagctcaaacaatgggacaagcttgacgggtctgtttcagaattctatctggacgtccctgccatattacctgttgtgaagacacagtgtggcctggattatgtggagaaatacttggaaactttggtggctcagaaatctaactatacttgcatcaacatggatctcaaatga

SEQ ID NO: 7042 - protein, 1367 aa, Solanum lycopersicum
MEERQKKGGSLVFAVNGERFELPCVDPSTTLLQFLRSQTFFKSPKLGCGEGGCGACVVLVSKYDPKLKKVEDFSVSSCLTLLCSLNGFSITTSEGLGNTRDGFHSIHERIAGFHASQCGFCTPGMCMSFFSALVNADKGNKPDPPPGFSKLTSSEAEKAIEGNLCRCTGYRPIADACKTFAADIDIEDLGFNAFWKNGDSKQMKVSKLPPYDPTKNFNTYPEFLKSESTTNLDSLRYSWYTPVSIEDLQSLLNSNVTENGASFKLVVGNTGTGYYKETQRYDHYIDLRYIPELSIIKRDQAGIDIGSTVTIYKLISFLKEESKINFGSYGKLVSDKLAYHMEKIASPFVRNSASVGGNLVMAQKNGFPSDIATLFLGLCATVSLMTRHGLVKLTWEELLLKPPLDSRIVLLSVSIPFKKDQNSKFLFETYRAAPRPHGNALAYVNAAFQADVSLCQNGFLINYIRLAFGAYGTKHATRAKMIERYLTGKMLNIQVLYGALKLVKLAVVPEDGTSHPEYRSSLAVSYVFEFLYPFTDAHSALSGGLFNGINDTSVEKVLKSSKDGCISQGRKQTLLSSAKQVVESSTEYYPVGEPMKKVGAAMQAAGEAVYVDDIPSPPNCLYGAFIYSTKALAGVKGIQLESNQLTDGVAAVITFKDIPIGGANIGATRFSDPEPLFADDLVRYAGDRIAIVVADSQRSADVAARTALVEYDTANVDSPILTVEEAVEKSSFIQIPPFLYPKQVGDFSKGMAEADHKILSAEVRLGSEYYFYMETQTALAIPDEDNCMVVYTSSQCPESAHRVIATCLGVPTHNIRVITRRVGGGFGGKGVRAMPVSTACALAAYKLRRPVRIYVNRNTDMIMTGGRHPMKVTYSVGFKSSGKITALHLDLLINAGISEDVSPILPLSVIKALKKYDWGALSFDVKLCKTNLTSKSTMRGPGEVQGSYIAEAIIEHVSSSLLLEVDLVRNKNAHTFESLNFFYGNIVSVGEYTLPSIMDKLAVSSSFFKRREMIKQFNQKNTWKKRGISRVPIVHEVSQRSTPGKVSILQDGSIVVEVGGIEIGQGLWTKVKQMTAYALGLIESSWAEDLVEKVRVIQADTLSIVQGGLTAGSTTSESSCEAVRLCCNVLVERLTPLKNQLQEQNVSVDWPTLIRQAQMQSVHLAAHSYYVPESSSKNYLNFGAAVSEVEIDILTGETTILQSDIIYDCGQSLNPAIDLGQIEGAFVQGIGFFMHEEYLTNEDGLMVSNSTWTYKIPTIDTIPQNFNVHVVNSGHHKKRVLSSKASGEPPLLLAVSVHCATRAAVKAAREQLKQWDKLDGSVSEFYLDVPAILPVVKTQCGLDYVEKYLETLVAQKSNYTCINMDLK

SEQ ID NO: 7043 - DNA, 4086 bp, Solanum lycopersicum
  CDS (1)..(4086)
atggaggaaagacagaaaaaggggaatttggtgtttgcagttaatggagagaggtttgagttgccatccgttgatccttcgacaactttgcttcacttcttgcgctcggagacttgttacaagagtcctaagcttggttgtggtgaaggtggttgtggagcttgtgttgttctgatctcaaagtatgaaccgaagtttaaaaaggtggaagattttagtgcaagttcgtgccttacacttctttgtagtttaaatggttgttcaattactacaagtgaaggccttgggaacaccagagatggttttcactctattcatgaaagatttgccggtttctatgcttctcaatgcggcttttgcactcctggcctgtgtatgtcacttttctcagctctcgtcaacactgataaaggaaacaaacccaatcctccaccaggattctctaagcttacttcatctgaagctgaaaatgccatagcgggaaacctttgtcggtgcactggctaccggcccattgctgatgcctgcaagacttttgctgctgatattgatatagaggatttggggttcaattctttttggaaaaagggagactccaaggaaatgaaagtaagtaaattacctccctatgatccaaccaagaattttagtacatatcctgagttcttaaaaagtgaatccgccacgaatttggactcctcaaagtacccttggtacagtcctgtttccattaaggagctatggagcttgttgaacttcaatgtgacggtaaatcgtggaagctttaaacttgtcgttggtaataccggcacaggttattataaggaaactcagcgatatgatcattatgtcgatctcaggcacattcctgaactctcaatcatcaaaagagatcagacaggcattgaagttggagcaactgtgactatctctaaattcatctcagtcttgaaagaggaaagtcatatcaatttgggttcatatgggaagttggtatcccaaaaattggctgaccacatggagaagattgcttcaccatttgttagaaactctgctagtgtgggaggaaatttggtcatggcacagaagaatggttttccttctgatatcgctacactacttctcgggctttctgctactgttagcttgatgaccagtcatggacctgaaaaccacacatgggaggagttattatcaagaccaccactagactcaaagactgtgcttctaagtgtttgcatcccatttaagaaagatcaaagttctcaccaaactcattctagatttttgtttgaaacctatcgagctgctccacgacctcatgggaatgcattggcatatgtaaatgctgcgttccaggctgatgtttctcactgcaataacggcgtccttataaacaatatctatttggcatttggtgcatatggcacaaaacatgcaacaagggctaaaaaggtagaagaatgtctaacggggaaaatgttgagtgtacatgttttgtatgaagcacttaaattagtcaaattagcggtggtaccggaagatggcactttacaccctgagtacagatcaagcttggctgtcagttatgtttttgagtttctttatcccttaactgatgttcatccttctatttctggtggtttactggatggaattaatgacatctcagataaggaagtttcggaaagtagtaataatggttgcattagtaaggggagaaaacaaaaactgctatcttcttctaagcaggttgtggagttcagtacggagtactctccagtaggtgaaccgttgaagaagatcggagctgccatgcaagctgctggcgaagctgtttatgtagatgacattccttcaccaccaaactgcttgcatggagcgtttatctacagtacaaagccattagctggtgtcaagggaatccagcttgagcctaatcatttaacagacaccaccataattacttacaaagatatcccaacaggaggagcaaatacaggagctgttacaccatttggctccgagcccttatttgctgaagatctctcccgttgtgctggtgacagaattgcatttgtggttgctgatagtcagaggtctgcagatttggctgcaagaactgccctcattgaatacgacactacaaatgtagattcggccattttaactgttgaggaagctgttgagaaatctagttttatccaagtccctccaccttttcagcctgaacagattggcgatttcacaaaaggaatggctgaagctgatcaaaaaattctctctgctgagttaagattcggttccgagtaccatttctatatggagacacagactgcccttgcaattccagatgaagacaactgcatggttgtttatacttcaagccagtgccctgagaattcacagagtatgattgccagttgtcttggtgttcctgcacacaacatccgcgtaattacaagaaggcttggaggtgcctttgggggcaagtttgtcaaagcaatgcctgtttccacagcctgtgcactagcagcatacaagttgagaagacctgtcaggatatatgtcaaccggaacagtgacatgataatgacaggaggacgacacccaatgaaagtaacatacagtgtaggattcaagtcgagcggaaagatcacagcattacatcttgatatattgataaatgctgggatcacagatgatttaagccccatcataccatcatatctgatgaatacactaaaaaaatataattggggtgccttatcttttgatatacaagtatgcaagacaaatctcaccagcaaaacgatcatgcggggtcctggggaggtgcaaggatcttatatcgccgaagctatagtagagcatgtcgcaagtttactgtcgattgaggtggactcagtcagaaatgagaatgttcatacatttgaaagccttaacttattctatggtaacgttgtagcagaaggagaatatacattgcctagtatcatggataagttggcagtgtcgtccagctttttccaacgaagcaagatgatagaacagttcaaccagaaaaacacatggaagaaaaggggtatttctcgagtaccagctgtgtacaatgcttcgcaacgaccgacaccaggaaaagtcagtattctgcaagatgggtcaattgttgtggaggttggaggggttgatgttggccaagggctatggacaaaggttagacagatgactgcctatgctctcggttcaatcgaaagtagttgggccgaagaccttgtcgagaaagtacgagtcatacaagcagacaccttaagtgtagtgcaaggtggattaacggctggaagtaccacatcggaatcaagctgtgcagctgttaaactttgctgtgatatcttggttgaaagactgaccgctctgaagaaacagttgcaggaaaaaaatgtttctgttgattggccaacgctgattcgccaggcacaaacacaatcaataaacttagcagcaaattcttattatgtgccagaattcttgaggtatttgaccttcggcgctgctgtcagtgaggtggagatagatgttctgactggagagactaccattttgcagtctgatattatttacgactgcggacagagcttgaatgcagctgttgatttgggacaggttgaaggagctttcgtacaaggaatcggatttttcatgaaagaagaatatgttacaaatgaagatgggttaatggtctcaaatagcacttggacatacaagatcccaactattgacaccataccccagaatttcaatgttcatctcgtaaacagtggacatcacgaacaacgtgtcctctcgtccaaaacatctggtgaaccaccgctgtttctggcagcttcggtccattgtgcaacaagagcagccataagagcagcacgtgaacagctcaaacgttgggacaagctcgacgagtctgcttcagaattttatctagatgtccctgcaatattaccagttgtgaaaacacagtgtggcctggattatgcagagaagttcgtagaaactctgctggctcgaaaatcaacgtgtttcaaatga

SEQ ID NO: 7044 - protein, 1361 aa, Solanum lycopersicum
MEERQKKGNLVFAVNGERFELPSVDPSTTLLHFLRSETCYKSPKLGCGEGGCGACVVLISKYEPKFKKVEDFSASSCLTLLCSLNGCSITTSEGLGNTRDGFHSIHERFAGFYASQCGFCTPGLCMSLFSALVNTDKGNKPNPPPGFSKLTSSEAENAIAGNLCRCTGYRPIADACKTFAADIDIEDLGFNSFWKKGDSKEMKVSKLPPYDPTKNFSTYPEFLKSESATNLDSSKYPWYSPVSIKELWSLLNFNVTVNRGSFKLVVGNTGTGYYKETQRYDHYVDLRHIPELSIIKRDQTGIEVGATVTISKFISVLKEESHINLGSYGKLVSQKLADHMEKIASPFVRNSASVGGNLVMAQKNGFPSDIATLLLGLSATVSLMTSHGPENHTWEELLSRPPLDSKTVLLSVCIPFKKDQSSHQTHSRFLFETYRAAPRPHGNALAYVNAAFQADVSHCNNGVLINNIYLAFGAYGTKHATRAKKVEECLTGKMLSVHVLYEALKLVKLAVVPEDGTLHPEYRSSLAVSYVFEFLYPLTDVHPSISGGLLDGINDISDKEVSESSNNGCISKGRKQKLLSSSKQVVEFSTEYSPVGEPLKKIGAAMQAAGEAVYVDDIPSPPNCLHGAFIYSTKPLAGVKGIQLEPNHLTDTTIITYKDIPTGGANTGAVTPFGSEPLFAEDLSRCAGDRIAFVVADSQRSADLAARTALIEYDTTNVDSAILTVEEAVEKSSFIQVPPPFQPEQIGDFTKGMAEADQKILSAELRFGSEYHFYMETQTALAIPDEDNCMVVYTSSQCPENSQSMIASCLGVPAHNIRVITRRLGGAFGGKFVKAMPVSTACALAAYKLRRPVRIYVNRNSDMIMTGGRHPMKVTYSVGFKSSGKITALHLDILINAGITDDLSPIIPSYLMNTLKKYNWGALSFDIQVCKTNLTSKTIMRGPGEVQGSYIAEAIVEHVASLLSIEVDSVRNENVHTFESLNLFYGNVVAEGEYTLPSIMDKLAVSSSFFQRSKMIEQFNQKNTWKKRGISRVPAVYNASQRPTPGKVSILQDGSIVVEVGGVDVGQGLWTKVRQMTAYALGSIESSWAEDLVEKVRVIQADTLSVVQGGLTAGSTTSESSCAAVKLCCDILVERLTALKKQLQEKNVSVDWPTLIRQAQTQSINLAANSYYVPEFLRYLTFGAAVSEVEIDVLTGETTILQSDIIYDCGQSLNAAVDLGQVEGAFVQGIGFFMKEEYVTNEDGLMVSNSTWTYKIPTIDTIPQNFNVHLVNSGHHEQRVLSSKTSGEPPLFLAASVHCATRAAIRAAREQLKRWDKLDESASEFYLDVPAILPVVKTQCGLDYAEKFVETLLARKSTCFK

SEQ ID NO: 7045 - DNA, 4095 bp, Arabidopsis thaliana
  CDS (1)..(4095)
atggagcagaacgagttcatggaggcaataatgtacgttaatggtgttcgtagagttttgcctgatggattagctcacatgacgcttctcgaatatctcagaggattgaccgggacaaagctcggatgcggcgaaggtggttgtgggtcttgcaccgtgatggtgtctagttatgaccgagagtcaaagacatgtgtgccttcttatactgttcataccggaaacttttattgcaggcattatgctgtcaacgcttgcctagcacctctctactctgtagaagggatgcatgtaatatccattgaaggagttggtcatcggaaacttggcttgcaccctcttcaggagtcattggcatcttcgcatggttctcaatgtgggttttgtactcccggttttgtcatgtcgatgtatgccttgttgaggtcaagtaaaaactcaccttctgaggaggagattgaagaatgccttgcaggaaatttgtgtcgttgtactggttatagacccatcattgatgcgtttcgggtttttgcaaaatctgatgatgctctatacagtggtttatcttcacttagccttcaggacggttcaaatatttgtccatctactggcaaaccttgttcttgtggatcaaaaacaacaagtgaagcagctacttgtaatgaagatagatttcagtcaatctcttatagtgatatagatggagctaagtatacagataaggagcttatttttccccctgaacttctgctgaggaagttagctcccttaaagttagggggaaatgaggggattacctggtatagacccgtaagtcttcagaacttgcttgaactcaaagcaaattttcctgatgcaaaactactggttggtaacacggaggtgggaatcgaaatgagactaaagaggttacagtatccggtgctaatctctgctgctcaagtcccagaactcaacgcattgaatgtcaatgacaatgggatagaggttggttcagctttgagactttctgaactcctgaggttattcaggaaggtagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataatcaactgcaatggagatgttagatctatacctgcaaaagatttcttccttggctatcgtaaagtggatatgggaagcaacgagatcttgttgtcggtattccttccatggacaaggcctttagagtatgtgaaagaatttaagcaggcccatcgcagggatgatgatatagctattgtcaatggtggaatgcgtgtgtttcttgaagagaaagggcaacaattgtttgtttctgatgcatctattgtttatggtggtgtggctcctctttcgttgcgtgcaagaaacactgaggaacttctaattggtaagaattggaataaatgtcttctgcaagacgcacttaaggtcatacagagtgatgtcttgattaaggaaggtgctcctgggggaatggtggagtttcgcaaatctctaaccctaagcttcttctttaaatttttcttatgggttactcatcatgtaaataatgtaaatcccactatagagacctttccaccctcgcatatgtcagctgtgcaacttgttcctcggttctctagaattggaaaacaagactatgagacagtaaaacagggtacatctgttggcttgccagaggtccatctttcggcaagaatgcaggtcacaggggaagcagaatatactgatgataccccattgccgccttgtaccttgcatgctgctttagtgctaagtaaagttccacatgcccgcatcctttcagttgatgattcggcagccaaatcttcatctggttttgttggtctgtttcttgccaaagatgttcccgggaataatatgattggaccaattgttgccgacgaagaattatttgctacagacgtggtcacgtgtgtgggacaagtcattggtgtgcttgtcgcggatacacatgaaaatgcaaaaactgcagcaagaaaagttgacgttaggtatcaggaactgccagcaatattatcaatcaaggaggcgattaatgctaaaagtttccatccgaacacagagagaaggcttagaaaaggggatgtcgagctgtgctttcaatctggtcagtgtgacagaataatagagggagaggttcaaatgggtggtcaggaacacttttacttggagcctaatggtagtttggtttggactatagatggaggcaacgaagttcatatgatttcatccacacaagctcctcaacagcaccagaaatatgtgtctcatgttcttggtcttccaatgtctaaagtggtatgcaaaaccaaacgacttggtggtggctttggtggtaaggaaacaagatcagctttcattgctgcagcagcttctgttccttcctacctattgaatcgacccgtgaaactcatactggacagagatgtggacatgatgattactggtcatcgccatagtttcgttggaaagtacaaggttggatttacgaacgaagggaaaatattggcgttggaccttgaaatctacaacaatggtggaaactctatggatctctctctttctaatcttgaacgtgccatgtttcactcggataacgtttatgagatcccacatgtgaggatcgttgggaacgtttgctttactaattttcccagcaacaccgctttccgagggtttggagggccccaaggtatgcttataactgaaaattggattcagagaattgcagctgagctggataaaatccctgaagaaatcaaagagatgaactttcaagtggaaggatcgatcacacattactttcagtcacttcagcactgcacattgcaccaactctggaaagaactgaaagtatccagcaacttcctaaagactcgtagagaagcggacgagtttaatagtcataatcggtggaaaaagcgtggtgtagctatggttcccacaaaatttggcatatcctttaccacaaagttcatgaatcaggccggtgctcttgttcacgtttacaccgatgggactgttttggtgacacatggaggtgttgagatgggccaagggttgcatacaaaggttgctcaagttgctgcaacggcctttaacattctccttagttcggtttttgtgtcagaaacaagcaccgacaaggttcctaatgcgtcacctactgctgcttctgcgagttctgatatgtatggtgctgcagttttagacgcttgtgagcagattatagcaagaatggagcctgttgcatctaaacacaatttcaacacattctctgagctagcaagtgcctgctactttcaacgtatagacctatcagctcacggttttcacattgttccagaacttgaatttgattgggtatctggaaaagggaacgcatatagatattacacatatggagctgcctttgctgaagttgagatagatacattgactggtgattttcacacaagaaaagcagacataatgttggatctcggatattctcttaacccaaccattgatattggacaaatagaaggagcgtttgtacaaggactaggttgggtagctctagaagaactcaagtggggagatgcagctcataaatggattaaaccaggaagtttactcacttgcggacccggaagctacaaaataccttccatcaacgacatgccgttccaactgaatgtttctcttctcaagggtaatccaaatgcaaaggcaatacattcatctaaagcagtgggtgagccaccgttctttcttgcagcatcagccttctttgcaataaaggaagcaatcaaagcggctagaagcgaggtaggtctcaccaactggttccctctggagactccagccactccagagcgtatcaggatggcttgtttcgacgagttttcagctccttttgcaaattcagatttctgcccaaagcttagtgtttga

SEQ ID NO: 7046 - protein, 1364 aa, Arabidopsis thaliana
MEQNEFMEAIMYVNGVRRVLPDGLAHMTLLEYLRGLTGTKLGCGEGGCGSCTVMVSSYDRESKTCVPSYTVHTGNFYCRHYAVNACLAPLYSVEGMHVISIEGVGHRKLGLHPLQESLASSHGSQCGFCTPGFVMSMYALLRSSKNSPSEEEIEECLAGNLCRCTGYRPIIDAFRVFAKSDDALYSGLSSLSLQDGSNICPSTGKPCSCGSKTTSEAATCNEDRFQSISYSDIDGAKYTDKELIFPPELLLRKLAPLKLGGNEGITWYRPVSLQNLLELKANFPDAKLLVGNTEVGIEMRLKRLQYPVLISAAQVPELNALNVNDNGIEVGSALRLSELLRLFRKVVKERPAHETSACKAFIEQLKWFAGTQIRNVACIGGNICTASPISDLNPLWMASRAEFRIINCNGDVRSIPAKDFFLGYRKVDMGSNEILLSVFLPWTRPLEYVKEFKQAHRRDDDIAIVNGGMRVFLEEKGQQLFVSDASIVYGGVAPLSLRARNTEELLIGKNWNKCLLQDALKVIQSDVLIKEGAPGGMVEFRKSLTLSFFFKFFLWVTHHVNNVNPTIETFPPSHMSAVQLVPRFSRIGKQDYETVKQGTSVGLPEVHLSARMQVTGEAEYTDDTPLPPCTLHAALVLSKVPHARILSVDDSAAKSSSGFVGLFLAKDVPGNNMIGPIVADEELFATDVVTCVGQVIGVLVADTHENAKTAARKVDVRYQELPAILSIKEAINAKSFHPNTERRLRKGDVELCFQSGQCDRIIEGEVQMGGQEHFYLEPNGSLVWTIDGGNEVHMISSTQAPQQHQKYVSHVLGLPMSKVVCKTKRLGGGFGGKETRSAFIAAAASVPSYLLNRPVKLILDRDVDMMITGHRHSFVGKYKVGFTNEGKILALDLEIYNNGGNSMDLSLSNLERAMFHSDNVYEIPHVRIVGNVCFTNFPSNTAFRGFGGPQGMLITENWIQRIAAELDKIPEEIKEMNFQVEGSITHYFQSLQHCTLHQLWKELKVSSNFLKTRREADEFNSHNRWKKRGVAMVPTKFGISFTTKFMNQAGALVHVYTDGTVLVTHGGVEMGQGLHTKVAQVAATAFNILLSSVFVSETSTDKVPNASPTAASASSDMYGAAVLDACEQIIARMEPVASKHNFNTFSELASACYFQRIDLSAHGFHIVPELEFDWVSGKGNAYRYYTYGAAFAEVEIDTLTGDFHTRKADIMLDLGYSLNPTIDIGQIEGAFVQGLGWVALEELKWGDAAHKWIKPGSLLTCGPGSYKIPSINDMPFQLNVSLLKGNPNAKAIHSSKAVGEPPFFLAASAFFAIKEAIKAARSEVGLTNWFPLETPATPERIRMACFDEFSAPFANSDFCPKLSV

SEQ ID NO: 7047 - DNA, 4080 bp, Arabidopsis thaliana
  CDS (1)..(4080)
atgggttcactgaaaaaggacggcgagatcggagatgagtttacggaggcgttactgtacgttaacggcgttcgtagagtcttgcctgatggattggctcatatgacacttctcgaatatctcagaggattgaccggtacaaagctgggatgcggcgaaggtggttgtggggcttgcacggtgatggtgtctagttatgacaggaagtcaaagacctctgtgcattatgctgtcaacgcttgcctagcacctctctattctgtagaagggatgcatgtaatatccattgagggacttgggcatcgcaaacttggcttgcaccctgtccaggagtctttggcatcttcccatggttcccaatgtgggttttgtactcccgggtttatcatgtccatgtattcgttgttgaggtcaagtaaaaactcaccttctgaggaggagattgaagaatgtcttgcaggaaatctatgtcgttgtactggttatcgacccattgttgatgcgtttcgggtttttgcaaaatctgatgatgctctctactgtggtgtatcttcacttagccttcaagatggttctactatttgcccatctactggcaaaccttgctcttgtggatcaaaaacaacaaatgaagttgccagttgtaatgaagatagatttcagtcaatctcttatagtgatatagatggagctaagtatacagataaggagcttattttcccccctgaacttttgctgaggaagttaactcccttaaagttaaggggaaatggggggattacctggtatagacccgtatgtcttcagaacttgcttgagctcaaagcaaattatcctgatgcaaaactactggtaggtaatacagaggtgggaatcgaaatgagattgaagaggttacagtatcaggtgctgatctctgttgctcaagtcccagaactcaacgcattgaatgtcaatgacaatgggatagaggttggttcagctttgagactttctgaactcctgaggttattcaggaagatagtaaaggagcgtcctgcacatgaaacatcagcatgcaaggcttttatcgaacagctgaagtggtttgctgggacacaaataagaaatgttgcttgcattggtggaaacatctgtacagctagtccaatatctgatttaaatcctctttggatggcttcaagagcagagtttcggataaccaactgcaatggagatgttaggtctatacctgcaaaagatttcttcctcggttatcgtaaagtggatatggggagcaacgagatcttgttgtcggtattccttccatggacaagacccttagagtatgtgaaagaatttaagcaggcccatcgcagggatgatgatatagctattgtcaatggtggaatgcgtgtgtttcttgaagacaagggtcaacaattgttcgtttctgatgcatccattgcttatggaggtgtggctcctctttctttgtgtgcgagaaagactgaagagtttctaattggaaagaattggaataaagatcttctgcaggatgcgcttaaggtcatacagagcgatgtcgtgattaaggaagatgctcctgggggaatggtggagtttcggaaatctctaaccctaagcttcttctttaaatttttcttatgggtttctcataatgtcaataatgcaaattctgcgatagagaccttcccaccctcccatatgtcagctgtgcaacctgttcctcggttatctagaattggaaaacaagactatgagacagtaaagcagggaacatctgttggctcgtcggaggtgcatctttcagcgagaatgcaggtcacaggggaagcggaatatactgatgatactccagtacctcctaataccttacatgctgcctttgtgctaagcaaagtgccacatgcccgcatcctttcaatcgatgattcggcagccaaatcttcatctggttttgttggtctgtttcttgccaaagatattcctggggataatatgattggaccaattgttcccgacgaagaattatttgctacagatgtggtcacgtgtgtgggacaagtcattggtgtggtcgtcgcggatacacatgaaaatgcaaaaactgcagcaggaaaagttgacgttaggtatgaggaactaccagcaatattatcaatcaaggaggctattaatgctaaaagtttccatccgaacacagagaaaaggctaagaaaaggggatgtcgagctgtgttttcaatctggtcagtgtgacagggtaatagagggagaggttcaaatgggtggtcaggaacacttctacttggagcctaatggtagtttggtttggacagtagatgggggcagcgaagttcatatgatttcatccacacaggctcctcaaaagcaccagaaatatgtgtcgcatgttcttggtcttccgatgtctaaagtggtatgcaaaaccaaacgaattggtggtggctttggtggtaaagaaacaagatcagctttcattgctgcggcagcttctgttccttcctacctattgaatcgacctgtgaaactcatactggaccgagatgtggacatgatgataactggtcatcgtcatagttttcttggaaagtacaaggttggatttacgaacgaaggaaaaatattggcgttggaccttgaaatttacaacaatggtggcaactctttggatctctccctttctgttcttgaacgtgccatgtttcactcggataacgtttatgagatcccgcatgtaaggattgttgggaatgtttgctttactaattttcctagcaacactgctttccgagggtttggaggcccccaaggtatgcttataactgaaaactggattcaaagaatcgcagctgagcttaataaaagccctgaagaaatcaaagagatgaactttcaagtggaaggatcagtcacccattactgtcagactcttcagcactgcacattgcatcagctctggaaagagctgaaagtatcgtgcaacttcttaaaggcccgcagagaagctgacgaatttaatagtcataatcggtggaaaaagcgtggtgtagctatggttcccacaaaatttggcatatcatttaccacaaagttcatgaatcaggccggagctcttgttcatgtttacactgacgggactgttttagtgactcatggtggtgtggagatgggtcaaggattgcatacaaaggtcgctcaagttgctgcatccgcctttaacattccacttagctcagttttcgtgtcagagacaagcactgacaaggttcctaatgcgtcaccaactgctgcttctgcgagctctgatatgtatggtgctgcagttttagacgcttgtgagcagattatagcaagaatggaacctgttgcatctaagcacaatttcaacacatttactgagctagtaagtgcctgctactttcaacggatagacctatcagctcatggttttcacatagttcctgatcttgggtttgactggatatctggaaaagggaacgcctttagatattacacatatggagctgcctttgcggaagttgagatagatacattgactggtgatttccacacaagagcagctgatataatgttggacctcggatattctcttaacccagccattgatgttggacaaatagaaggagcgtttgtacaaggactgggttgggtagctttagaagaactcaaatggggagatgcagctcataaatggattaaaccaggaagtttactcacttgcggacccggaaactacaaaataccttccatcaacgacatgccgttcaacctcaatgtttcgcttctcaaggggaatccgaatacaaaggcaatacattcatctaaagcagtgggtgagccaccattctttcttgcatcatcggttttctttgcgataaaggaagctattaaagcggctagaaccgaggtgggtctcacagactggttccctctagagagtccagccactccagagcgtatcaggatggcttgtttcgacgaattttcagctccttttgtaaattcagatttctaccctaatcttagtgtttga

SEQ ID NO: 7048 - protein, 1359 aa, Arabidopsis thaliana
MGSLKKDGEIGDEFTEALLYVNGVRRVLPDGLAHMTLLEYLRGLTGTKLGCGEGGCGACTVMVSSYDRKSKTSVHYAVNACLAPLYSVEGMHVISIEGLGHRKLGLHPVQESLASSHGSQCGFCTPGFIMSMYSLLRSSKNSPSEEEIEECLAGNLCRCTGYRPIVDAFRVFAKSDDALYCGVSSLSLQDGSTICPSTGKPCSCGSKTTNEVASCNEDRFQSISYSDIDGAKYTDKELIFPPELLLRKLTPLKLRGNGGITWYRPVCLQNLLELKANYPDAKLLVGNTEVGIEMRLKRLQYQVLISVAQVPELNALNVNDNGIEVGSALRLSELLRLFRKIVKERPAHETSACKAFIEQLKWFAGTQIRNVACIGGNICTASPISDLNPLWMASRAEFRITNCNGDVRSIPAKDFFLGYRKVDMGSNEILLSVFLPWTRPLEYVKEFKQAHRRDDDIAIVNGGMRVFLEDKGQQLFVSDASIAYGGVAPLSLCARKTEEFLIGKNWNKDLLQDALKVIQSDVVIKEDAPGGMVEFRKSLTLSFFFKFFLWVSHNVNNANSAIETFPPSHMSAVQPVPRLSRIGKQDYETVKQGTSVGSSEVHLSARMQVTGEAEYTDDTPVPPNTLHAAFVLSKVPHARILSIDDSAAKSSSGFVGLFLAKDIPGDNMIGPIVPDEELFATDVVTCVGQVIGVVVADTHENAKTAAGKVDVRYEELPAILSIKEAINAKSFHPNTEKRLRKGDVELCFQSGQCDRVIEGEVQMGGQEHFYLEPNGSLVWTVDGGSEVHMISSTQAPQKHQKYVSHVLGLPMSKVVCKTKRIGGGFGGKETRSAFIAAAASVPSYLLNRPVKLILDRDVDMMITGHRHSFLGKYKVGFTNEGKILALDLEIYNNGGNSLDLSLSVLERAMFHSDNVYEIPHVRIVGNVCFTNFPSNTAFRGFGGPQGMLITENWIQRIAAELNKSPEEIKEMNFQVEGSVTHYCQTLQHCTLHQLWKELKVSCNFLKARREADEFNSHNRWKKRGVAMVPTKFGISFTTKFMNQAGALVHVYTDGTVLVTHGGVEMGQGLHTKVAQVAASAFNIPLSSVFVSETSTDKVPNASPTAASASSDMYGAAVLDACEQIIARMEPVASKHNFNTFTELVSACYFQRIDLSAHGFHIVPDLGFDWISGKGNAFRYYTYGAAFAEVEIDTLTGDFHTRAADIMLDLGYSLNPAIDVGQIEGAFVQGLGWVALEELKWGDAAHKWIKPGSLLTCGPGNYKIPSINDMPFNLNVSLLKGNPNTKAIHSSKAVGEPPFFLASSVFFAIKEAIKAARTEVGLTDWFPLESPATPERIRMACFDEFSAPFVNSDFYPNLSV

SEQ ID NO: 7049 - DNA, 4077 bp, Oryza sativa subsp
  CDS (1)..(4077)
atgggggaggcggcggcggtggtggcggtgaacggggagaggtacgaggcggtgggggtggacccgtcgatgacgctgctcgagttcctccgcacgcggacgccattcagaggccccaagctcggctgcggcgaaggaggatgcggggcgtgcgcggtggtggtgtccaagtacgacgccgccgccgacgaggtgacgtcgttctcggcgagctcgtgcctgacgctgctgggcagcctccaccactgcgcggtgaccaccagcgagggcatcggcaactccagggatggcttccaccccgtgcagcgccgcctcgccggcttccacgcctcccagtgcggcttctgcaccccgggcatgtgcgtctccatcttctccgccctcgccaacgccgacagggcggcctccgccgcgccgccgccgccgccgacgccgccggggttctccaggctcaccgccgccgacgccgagcgggccgtctccggcaacctctgccgctgcaccggctaccggcccatcctcgacgcctgcaagagcttcgccgccgacgtcgacctcgaggatctgggtctcaactccttctggaagaaaggcgagcgcgctgacatcaccaagcttccggcctactcctgtactgccgatgttgccaccttcccggagttcctcaagtccgagattaggtcatccggtggtgctccggcggtggcggtcaccggcgacggctgctggttccatcccaggagcatcgaggagttccacaggttgtttgaatgcaacctgttcgacgaaatgtccgtgaagattgtggcgtcgaacaccggctccggggtgtacaaggatcaggacctccatgacaagtacatcaacatctcgcagattcctgagctctcggccatcaacagaagcagcaatggcatcgagatcggagcagccgtgtctatctccaaagccatcgagatactacggtcagatggtggagacgcggtggtgtttcgaaagattgcttatcacctgggcaaggtggcctcaccgttcgtccggaacacggccaccataggaggcaacatcatcatggcgcagaggatgtcgttcccgtcagacatcgcaactgttcttctcgctgcaggatcaactgtcaccatccagcaggtggcttccaagaggatgtgcctcactctggaggaattcttgaagcagcctccatgtgattccaggacattgctaatcagcatctccatcccagattggtgttcatatgatggcatcacttttgagacatttcgtgcggctcctcgtccatttggcaatgctgtctcatatgtgaattctgcattcttggcaaggagttcgttggatgcagcatcaggaagccatcttattgaggatgttcgcttggcattcggcgcttttgggtctgaacatgccatcagagctagtaaggttgaggagttcttgaagggaaaattggttagtgcatctgtgatacttgaagcagtccggctgcttaaaggagttgtttcaccagcagaaggcaccacacatcctgaatacagagtcagtctagccgtcagttacctgttcaggttcctgtcttcccttgctaatggcttggatgataagcctgaaaatgctaataatgttcccaatggttcatgtactactaatggaaccaccaacggtagcgctgagtcgacggttgacagctttgatttgccaataaaatcaagacaagagatggttttctctgatgaatacaaaccagtcggaaaaccaatcaagaaagtcggggcagagctccaagcttctggggaggcagtgtatgttgatgacatccctgctccaaaggattgcctctatggagcatttatctacagcacacaccctcacgctcacataaaaggtgtaaactttagatcatctttggcttcacagaaggttatcacagttatcactgcaaaggacattccgaccggtggagaaaatgttggatcctgcttcccaatgttaggagatgaagcactttttgctgatccagttgctgaattcgctggtcaaaatatcggcgttgtgattgcggaaacacaaaaatacgcctatatggcagcaaggcaagctgtgattgaatataatactgaaaatcttcagccaccaattctaacagtagaagacgctgtccagcataacagctacttccaagttcccccatttttacaacctaagccaattggtgacttcaaccaagccatgtctgaagccgatcacaagatcatagatggggaggtgaaacttggatcccagtactatttctacatggagacacaaacggctttagctttccctgatgaagataactgtataaccgtctactgctcagcgcaaatgcctgaggttactcaagatattgttgcaaggtgcctcggcgttccatttcataatgtccgtattatcacgagaagagttggaggaggtttcggtggaaaggcaatgaaagcaacacatgttgcaactgcttgcgctgtggcagcattcaagctgcggcgcccagttcgaatgtacctcgatcgcaagacggacatgataatggcgggagggcggcatccgatgaaggccaagtactccgtcgggttcaagtccgacggcaagatcacggccctgcacctcgatctcaagatcaacgccgggatatcaccggaattcagcccggcgatcccgtacgccattgtcggggccctgaagaagtacagctggggcgctctcgcgttcgacatcaaggtctgcaagacgaacgtctcgtccaagtcggccatgcgtgctccgggcgacgcgcagggctcgttcatcgccgaggccatcgtcgagcacgttgcgtccacgctctccgtggccacgaacaccatcaggaggaagaacctccatgacttggagagcctcaaggtgttcttcggggacagcgccgccggcgaggcctcgacgtcgtcgtacagcctcgtcatcatcttcgacaggctggcctcgacgccggagtaccagcggagggccgccatggtggagcaattcaacggcagcagcaggtggaagaagcgtggcatttcttgcgtgccgatcacctactcggtgacgctccggccgtctccggggaaggtctccatcttgaacgacggctccatcgccgtcgaggtcggcggcgtcgagatcgggcagggcctgtggaccaaggtgaagcagatgaccgccttcgcgctgggccagctgtgcgatgacggcggcgagggcctcctcgacaatgtccgtgtcatccaggctgacaccctgagcatgatccagggaggatggaccgccgggagcacgacctccgagaccagctgcgaggctgttcggaagtcgtgcgccgcgctcgtcgagcggctcaagcccatcaaggagaaggctggcaccctaccatggaaatcctttattgcgcaggcaagcatggctagtgtaaaactgacggagcacgcgtactggacccctgacccgacgttcactagctacatgaactatggagctgccactagtgaggtggaagtcgatgtgctgacaggggcaaccaccatcctgaggagcgacctcgtgtatgactgtgggcagagcctgaatcctgctgtcgacttaggccaggtggaaggcgcgttcgtgcaaggtgtgggcttcttcacgaacgaggagtacgcgaccaacgccgatgggctggtcatccacgacggcacatggacgtacaagatccccaccgtagacaccatccccaagcagttcaacgtcgagctcatcaacaccgctcgccatcacagccgcgtcctctcctcaaaagcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctag

SEQ ID NO: 7050 - protein, 1358 aa, Oryza sativa subsp
MGEAAAVVAVNGERYEAVGVDPSMTLLEFLRTRTPFRGPKLGCGEGGCGACAVVVSKYDAAADEVTSFSASSCLTLLGSLHHCAVTTSEGIGNSRDGFHPVQRRLAGFHASQCGFCTPGMCVSIFSALANADRAASAAPPPPPTPPGFSRLTAADAERAVSGNLCRCTGYRPILDACKSFAADVDLEDLGLNSFWKKGERADITKLPAYSCTADVATFPEFLKSEIRSSGGAPAVAVTGDGCWFHPRSIEEFHRLFECNLFDEMSVKIVASNTGSGVYKDQDLHDKYINISQIPELSAINRSSNGIEIGAAVSISKAIEILRSDGGDAVVFRKIAYHLGKVASPFVRNTATIGGNIIMAQRMSFPSDIATVLLAAGSTVTIQQVASKRMCLTLEEFLKQPPCDSRTLLISISIPDWCSYDGITFETFRAAPRPFGNAVSYVNSAFLARSSLDAASGSHLIEDVRLAFGAFGSEHAIRASKVEEFLKGKLVSASVILEAVRLLKGVVSPAEGTTHPEYRVSLAVSYLFRFLSSLANGLDDKPENANNVPNGSCTTNGTTNGSAESTVDSFDLPIKSRQEMVFSDEYKPVGKPIKKVGAELQASGEAVYVDDIPAPKDCLYGAFIYSTHPHAHIKGVNFRSSLASQKVITVITAKDIPTGGENVGSCFPMLGDEALFADPVAEFAGQNIGVVIAETQKYAYMAARQAVIEYNTENLQPPILTVEDAVQHNSYFQVPPFLQPKPIGDFNQAMSEADHKIIDGEVKLGSQYYFYMETQTALAFPDEDNCITVYCSAQMPEVTQDIVARCLGVPFHNVRIITRRVGGGFGGKAMKATHVATACAVAAFKLRRPVRMYLDRKTDMIMAGGRHPMKAKYSVGFKSDGKITALHLDLKINAGISPEFSPAIPYAIVGALKKYSWGALAFDIKVCKTNVSSKSAMRAPGDAQGSFIAEAIVEHVASTLSVATNTIRRKNLHDLESLKVFFGDSAAGEASTSSYSLVIIFDRLASTPEYQRRAAMVEQFNGSSRWKKRGISCVPITYSVTLRPSPGKVSILNDGSIAVEVGGVEIGQGLWTKVKQMTAFALGQLCDDGGEGLLDNVRVIQADTLSMIQGGWTAGSTTSETSCEAVRKSCAALVERLKPIKEKAGTLPWKSFIAQASMASVKLTEHAYWTPDPTFTSYMNYGAATSEVEVDVLTGATTILRSDLVYDCGQSLNPAVDLGQVEGAFVQGVGFFTNEEYATNADGLVIHDGTWTYKIPTVDTIPKQFNVELINTARHHSRVLSSKASGEPPLLLASSVHCAMREAIRAARREFAAVGGGTGGSDQVTSFQMDVPATMPAVKELCGLDVVERYLESFSATTA

SEQ ID NO: 7051 - DNA, 3966 bp, Arabidopsis thaliana
  CDS (1)..(3966)
atgagcttggttttcgccattaatggacaaaggttcgagcttgagctctcctctgttgacccttcaacaactttgttggagtttcttcgttatcagacttctttcaagagtgtcaagctcagctgcggtgaaggaggatgtggtgcttgtgttgttcttctctccaagttcgatcctgtcttacaaaaagtcgaagatttcactgtgagctcttgtcttacactcctctgcagcgtcaaccactgcaatattacgacatcagaaggacttgggaacagcagagacggtttccacccgattcacaagcggttatccggtttccatgcctctcaatgtggtttctgtacacctggaatgtctgtttctctcttctctgctcttttagatgctgacaagtctcaatattccgaccttacggttgtggaagcagagaaggctgtctcaggaaacttatgtcggtgtactggttaccgtccgattgttgatgcttgtaagagctttgcttcggatgttgacattgaggatcttggattaaactctttttgtaggaaaggggataaagattctagtagtttaactcggtttgatagtgagaagcgtatttgtacatttccagagtttctcaaggatgagattaagtctgtggattctggaatgtaccgatggtgcagcccagcgagtgttgaggaactctcgagcttattggaagcttgcaaggctaatagtaatacagtttctatgaaattggttgctggtaacacaagtatgggatactataaagatgaaagagagcagaattacgacaaatacatagatataactcgaatcccgcaccttaaagagatcagagaaaaccagaatggggttgagataggatcagtggtaacaatctctaaagttattgctgctctgaaggagattagggtctcaccgggagtggagaagatatttggaaaacttgctactcatatggaaatgatagcggcgagatttatcaggaactttggtagcattggtggaaaccttgtgatggctcagaggaaacagtttccttctgatatggctacaatacttcttgcagctggtgcatttgttaacataatgagctcatcaagaggactcgaaaagctaacacttgaagagttccttgaacgttctcctcttgaggctcatgatctggttctgagtattgaaattcctttttggcattctgaaacaaactctgaattgttctttgaaacctatagagctgcacctcgtccacatggaagcgctctggcctacctgaatgctgctttcttggctgaagtgaaggatacaatggtagttaactgtagattggctttcggggcttacgggaccaaacacgccattaggtgtaaggaaatcgaagagttcctgtctggtaaagtaatcactgacaaagttctgtatgaggctattaccttacttggcaatgttgtggtgcctgaagacggtacaagcaatcctgcttacaggtcaagcttggcgcctggcttccttttcaagttccttcacaccttaatgacccatcctactacagataaaccttcaaatggttaccacttggatccaccaaaaccgttgccaatgttgtcttcttcacaaaatgttcctataaacaatgaatataatccagttggtcagcctgttactaaagttggagcttcccttcaggcttctggtgaggctgtttatgtggacgatattccatctcccacaaactgtctctatggagcatttatctatagcaaaaagccattcgctaggataaaaggtattcacttcaaggacgatttggtacctactggagttgttgcagtcatttctcgcaaggatgttcctaaaggcggaaagaatattggtatgaagattggattaggctccgaccaattgttcgcagaggatttcaccactagtgtaggcgaatgcatcgccttcgtggttgctgatacgcagagacatgcggatgctgcagtaaaccttgcagttgttgaatacgagacagaggatttggaaccaccaatcttatctgtagaagacgcggtcaagaaatctagtctgtttgacattatccctttcctttatccacaacaagttggtgatacatcaaaaggaatggctgaagctgatcaccaaattctcagctcggaaataagactcggatcgcaatacgtcttctacatggagacacaaacagctcttgcagtgggagatgaagacaactgcattgtagtctatagttcaacacagacccctcagtacgtacagtcatcggtcgctgcttgcctaggcatccctgaaaataacatccgtgtcataaccagacgtgttggtggaggttttggagggaaatctgtcaagtcaatgccagttgcaacagcgtgcgctcttgctgctaagaaactgcagcgtcctgtgagaacttatgtcaaccgcaagaccgatatgataatgactggtgggaggcatccgatgaagataacgtatagtgtggggttcaaatctacagggaagatcacagctttggagctagaaatactaattgatgctggggcaagttatggttttagtatgtttattccatcaaatctcatagggtcgctaaagaagtacaattggggcgccttatcttttgatatcaaactttgtaaaacaaatcttctaagcagagcaatcatgagatccccgggggacgtgcagggtacgtatattgctgaagccatcatcgaaaatatagcctctagcctctctttggaggttgatacaataagaaagattaatctccatacacatgagagcttagccctgttctacaaggatggtgctggtgaaccacatgagtatactttatcttcgatgtgggataaggttggcgtatcttccaagtttgaggagagggtttctgttgtcagagagttcaacgagtctaacatgtggagaaaacgagggatatctcgagtacctattatctatgaggttttattgtttgctactccagggagagtaagtgttttgagcgatgggacgattgttgttgagattggtggaatcgagctaggacaagggttatggacaaaggtgaagcagatgactagttatgctcttggtatgctacaatgcgatggaacggaagaactcttggagaagataagagttatacaatcagattcattgagcatggtccaaggaaatttcacaggaggtagcacaacatccgagggaagctgcgcagctgttcgtctctgctgcgaaaccttagtcgaaagattgaaacctttaatggaaagatcagatggtccaatcacctggaatgagttgatttctcaggcttatgcacaatccgtgaacttatcagctagtgacttgtatactccaaaagacactcccatgcagtacctgaactatggtactgcggtcagcgaggttgaagtagaccttgtgacgggacaaaccacagttctacagacagatatcttatatgactgtggaaaaagtctcaatcccgctgtcgatttaggacagattgaaggatcttttgttcaaggacttgggtttttcatgcttgaagagtacatagaagatccagaaggactccttctgacggatagcacatggacatacaagattccaacagttgacaccattcctaaacagttcaatgtcgagatactaaatggtggatgtcatgaaaaacgcgtactctcttctaaagcctcgggagagcctccgttgctactggcagcttcggtgcactgcgctaccagacaggctgttaaagaagcacgcaaacagctatgtatgtggaaaggtgagaatggttcctccggttcagcgtttcagttgccagttccagctacaatgccggttgtgaaggagctatgcggtctagatatcattgaaagctatttggagtggaagttacacgacaactcaaacctatga

SEQ ID NO: 7052 - protein, 1321 aa, Arabidopsis thaliana
MSLVFAINGQRFELELSSVDPSTTLLEFLRYQTSFKSVKLSCGEGGCGACVVLLSKFDPVLQKVEDFTVSSCLTLLCSVNHCNITTSEGLGNSRDGFHPIHKRLSGFHASQCGFCTPGMSVSLFSALLDADKSQYSDLTVVEAEKAVSGNLCRCTGYRPIVDACKSFASDVDIEDLGLNSFCRKGDKDSSSLTRFDSEKRICTFPEFLKDEIKSVDSGMYRWCSPASVEELSSLLEACKANSNTVSMKLVAGNTSMGYYKDEREQNYDKYIDITRIPHLKEIRENQNGVEIGSVVTISKVIAALKEIRVSPGVEKIFGKLATHMEMIAARFIRNFGSIGGNLVMAQRKQFPSDMATILLAAGAFVNIMSSSRGLEKLTLEEFLERSPLEAHDLVLSIEIPFWHSETNSELFFETYRAAPRPHGSALAYLNAAFLAEVKDTMVVNCRLAFGAYGTKHAIRCKEIEEFLSGKVITDKVLYEAITLLGNVVVPEDGTSNPAYRSSLAPGFLFKFLHTLMTHPTTDKPSNGYHLDPPKPLPMLSSSQNVPINNEYNPVGQPVTKVGASLQASGEAVYVDDIPSPTNCLYGAFIYSKKPFARIKGIHFKDDLVPTGVVAVISRKDVPKGGKNIGMKIGLGSDQLFAEDFTTSVGECIAFVVADTQRHADAAVNLAVVEYETEDLEPPILSVEDAVKKSSLFDIIPFLYPQQVGDTSKGMAEADHQILSSEIRLGSQYVFYMETQTALAVGDEDNCIVVYSSTQTPQYVQSSVAACLGIPENNIRVITRRVGGGFGGKSVKSMPVATACALAAKKLQRPVRTYVNRKTDMIMTGGRHPMKITYSVGFKSTGKITALELEILIDAGASYGFSMFIPSNLIGSLKKYNWGALSFDIKLCKTNLLSRAIMRSPGDVQGTYIAEAIIENIASSLSLEVDTIRKINLHTHESLALFYKDGAGEPHEYTLSSMWDKVGVSSKFEERVSVVREFNESNMWRKRGISRVPIIYEVLLFATPGRVSVLSDGTIVVEIGGIELGQGLWTKVKQMTSYALGMLQCDGTEELLEKIRVIQSDSLSMVQGNFTGGSTTSEGSCAAVRLCCETLVERLKPLMERSDGPITWNELISQAYAQSVNLSASDLYTPKDTPMQYLNYGTAVSEVEVDLVTGQTTVLQTDILYDCGKSLNPAVDLGQIEGSFVQGLGFFMLEEYIEDPEGLLLTDSTWTYKIPTVDTIPKQFNVEILNGGCHEKRVLSSKASGEPPLLLAASVHCATRQAVKEARKQLCMWKGENGSSGSAFQLPVPATMPVVKELCGLDIIESYLEWKLHDNSNL

SEQ ID NO: 7053 - DNA, 4068 bp, Oryza sativa subsp
  CDS (1)..(4068)
atggggtcagaggcggcggcggcgaggccggtggtggtgacggtgaacggggagaggtacgaggcggtgggggtcgacccgtcgacgacgctgctcgagttcctccgcacgcggacccccgtccggggccccaagctcggctgcggcgaaggtggatgcggcgcatgcgtggtcgtcgtttccaagtacgacgccgtcgccgacgaggtgaccgagttctcggcgagctcctgcctgacgctgctcggcagcctgcaccactgcgcggtcaccaccagcgagggcatcggcaactccagggatggcttccacgccgtgcagcggcggctctccggcttccacgcctcgcagtgcggcttctgcaccccgggcatgtgcatgtccatctactccgcgctcgccaaggccgacaggtgctcgtcccgtccctcgccgccgccggggttctccaagctcaccgccgctgaggccgagaaggccgtctccggcaacctgtgccgctgcaccggctacaggcccatcgtcgacgcgtgcaagagcttcgccgccgacgtcgacctcgaggaccttggcctcaacgccttctggaagaaaggcgccgacgacgagcgcgctgacgtcggcaagctgcctgcatactctggtggcgccgccgtctgtacgttcccggagttcctcaagtcggagataaggtcatccatgggtcaagcgaatggtggcgctccggcggtggcggtcaccggagacggctggttccaccccaagagcgtcgaggagttccacaggttgtttgactctaacctgttcgacgaaaggtctgtgaagattgtggcatcgaacaccggctccggagtgtacaaggatcaagacctccatgacaagtacatcaacatctcgcagattctggaactctcagccatcaatagaagcagcaagggcgtcgagatcggagctgtcgtgtctatctccaaagccattgagatattgtcggatggaggcgcagtgttcagaaagattgccgatcacctgagcaaagtggcctcgtcgttcgtccagaacacggcgaccattggaggcaacatcatcatggcgcagaggctgtctttcccgtcggacatcgcaacggttcttctcgctgcaggatcaactgtcaccatccaggtggccgccaagaggatgtgcatcactctggaggagttcttgaagcagcctccatgtgattccaggacgttgttggtcagcatctctatcccggattggggttcagatgatggcatcacctttgagtcgtttcgtgcggctcctcgtccacttggcaatgctgtgtcatatgttaattctgcattcttggcaagaagttcagtggatggatcatcagggagccatctcattgaggatgtttgcttggcatttggcgccttcggggccgaacacgccatcagagctagggaggttgaggagttcttgaagggaaaattggttagtgcaccagtgatacttgaagcagttcggcttcttaaaggtgttgtttcaccagctgaaggcacaacacatcctgaatacagagtcagcttggccgtcagttatctgttcagattcctgacttcccttgctaatggcttggatgagcctgaaaatgctaatgttcccaatggttcatgtactaatggaaccgcaaacggtagcgctaattcctctccggagaagcactcaaatgttgacagctctgatttgccaataaaatcaaggcaagagatggttttctctgatgaatacaaacctgttggaaagccgatcgagaaaaccggagcagagctccaagcttctggagaggcagtgtatgttgatgacatccctgctccgaaggattgcctctatggagcatttatctatagcacacaccctcacgctcacataaaagatataaacttcagatcatctttggcttcacagaaggtcatcacagttatcactgcaaaggacattcctaccggtggagaaaatattggatcatgcttcccaatgcttggagatgaagcgcttttcgttcatcctgtttctgaatttgccggccagaatattggtgttgtgattgctgaaacacaaaagtatgcctatatggcggcgaagcaagctgtgatcgaatatagtaccgaaaatcttcagccaccaattctgacaatagaagatgctgtccagcataacagctacttcccagttcccccatttttagctcctacgccaattggtgacttcaaccaagctatgtctgaagctgatcacaagatcatagatggggaggtgaaacttgaatcccagtactatttctacatggagacacagacggccttagctatccctgatgaagataactgtataaccctctatgtgtcggcgcaactacctgagattactcaaaatactgttgcgaggtgccttggcattccatatcacaatgtccgtatcatcacgagaagagttggaggaggttttggtggaaaggcaatgaaagcaatacatgttgccgctgcatgtgctgtcgccgcattcaagctgcggcgtccggttcgaatgtacctcgatcgcaagacagacatgatcatggcgggagggcggcatccgatgaaggtaaagtactccgtcggtttcaagtccgacggcaagatcacgggtctgcactttgatcttggaatgaacggcggaatatcgccggattgcagcccggtgttgccagtcgccattgtcggggctctgaagaagtacaactggggcgctctctccttcgacatcaaggtctgcaagacgaacgtctcgtcgaagtcggcgatgcgggctcccggcgacgcgcagggctcgttcatcgccgaggccatcgtcgaacacatcgcgtccactctctcagtggacacgaacgccatcaggaggaagaacctccacgacttcgagagcctcaaggtgttttatgggaatagcgccggtgatccttcgacgtacagtctcgtcaccatcttcgacaagctggcctcgtcgccggagtaccagcagagggccgccatggtcgagcacttcaacgccggcaacaggtggaagaagcggggcatttcttgcgtgccgatcacctacgacgtgaggctccggccaactccggggaaggtgtccatcatgaacgacggctccatcgccgttgaggtcggcggcgtcgagatcgggcaggggctgtggacgaaagtgaagcagatgacagcgttcgcgctgggccagctctgcgatgatggcggcgagggcctcatcgacaaggtccgtgtcatccaggccgacaccctgagcatgatccagggaggcttcaccggtgggagcacgacctccgagactagctgcgaggctgttcggaagtcgtgcgccgccctcgtggagaggttgaagcccatcaaagagaaggctggcacgccaccatggaaatcccttattgcccaggcaagcatggcgagtgtgaagctgacagagcacgcgtactggacgcctgaccccacgttcactagctacttgaactatggagctgcaattagtgaggtggaagtcgatgtgctgacgggagaaaccaccatcctgaggagcgacctcgtgtacgactgtgggcagagcctgaatcctgctgtggacttgggccaggtggaaggcgcattcgtgcaagggatcggcttcttcacgaacgaggagtacacgaccaactccgatgggctggtcatcaacgacggcacgtggacgtacaagatccccaccgtggacaccatccccaagcagttcaacgtcgagctcatcaacagcgcccgcgatcacaagcgcgtcctctcctccaaagcgtccggtgagccgccgctgctgctggcgtcgtcggtgcactgcgcgatgagggaggcgatcagggcggccaggaaggagttcgccggcgccggaggctcgccgctgacgttccagatggacgtgccggcgacgatgccgatcgtcaaggagctctgcggccttgacgtcgtggagagatatctcgagagctttgctgccaaagcctag

SEQ ID NO: 7054 - protein, 1355 aa, Oryza sativa subsp
MGSEAAAARPVVVTVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADRCSSRPSPPPGFSKLTAAEAEKAVSGNLCRCTGYRPIVDACKSFAADVDLEDLGLNAFWKKGADDERADVGKLPAYSGGAAVCTFPEFLKSEIRSSMGQANGGAPAVAVTGDGWFHPKSVEEFHRLFDSNLFDERSVKIVASNTGSGVYKDQDLHDKYINISQILELSAINRSSKGVEIGAVVSISKAIEILSDGGAVFRKIADHLSKVASSFVQNTATIGGNIIMAQRLSFPSDIATVLLAAGSTVTIQVAAKRMCITLEEFLKQPPCDSRTLLVSISIPDWGSDDGITFESFRAAPRPLGNAVSYVNSAFLARSSVDGSSGSHLIEDVCLAFGAFGAEHAIRAREVEEFLKGKLVSAPVILEAVRLLKGVVSPAEGTTHPEYRVSLAVSYLFRFLTSLANGLDEPENANVPNGSCTNGTANGSANSSPEKHSNVDSSDLPIKSRQEMVFSDEYKPVGKPIEKTGAELQASGEAVYVDDIPAPKDCLYGAFIYSTHPHAHIKDINFRSSLASQKVITVITAKDIPTGGENIGSCFPMLGDEALFVHPVSEFAGQNIGVVIAETQKYAYMAAKQAVIEYSTENLQPPILTIEDAVQHNSYFPVPPFLAPTPIGDFNQAMSEADHKIIDGEVKLESQYYFYMETQTALAIPDEDNCITLYVSAQLPEITQNTVARCLGIPYHNVRIITRRVGGGFGGKAMKAIHVAAACAVAAFKLRRPVRMYLDRKTDMIMAGGRHPMKVKYSVGFKSDGKITGLHFDLGMNGGISPDCSPVLPVAIVGALKKYNWGALSFDIKVCKTNVSSKSAMRAPGDAQGSFIAEAIVEHIASTLSVDTNAIRRKNLHDFESLKVFYGNSAGDPSTYSLVTIFDKLASSPEYQQRAAMVEHFNAGNRWKKRGISCVPITYDVRLRPTPGKVSIMNDGSIAVEVGGVEIGQGLWTKVKQMTAFALGQLCDDGGEGLIDKVRVIQADTLSMIQGGFTGGSTTSETSCEAVRKSCAALVERLKPIKEKAGTPPWKSLIAQASMASVKLTEHAYWTPDPTFTSYLNYGAAISEVEVDVLTGETTILRSDLVYDCGQSLNPAVDLGQVEGAFVQGIGFFTNEEYTTNSDGLVINDGTWTYKIPTVDTIPKQFNVELINSARDHKRVLSSKASGEPPLLLASSVHCAMREAIRAARKEFAGAGGSPLTFQMDVPATMPIVKELCGLDVVERYLESFAAKA

SEQ ID NO: 7055 - DNA, 3999 bp, Arabidopsis thaliana
  CDS (1)..(3999)
atggatttggagtttgcagttaatggggaacgattcaagattgattctgttgatccatcaacgaccttacttgagttcttgcgattgaacactcctttcaagagtgtcaagctcggctgtggcgaaggagggtgtggtgcttgtcttgtagtgttatctaaatatgatccagagttagatcaagtgaaggaatgttgtataaactcttgtctcactcttctctgtagtgtaaatggatgttccattactacatctgaaggtcttggaaacacgaagaaaggatttcatccgattcataagcggttcgcgggttttcacgcctctcaatgcgggttttgtacaccagggatgtgtatttctctctactcatctcttgcaaatgctgagaataacagctctaaagattttacggtttctgaagctgagaaatctgtttcgggtaatctttgtcgatgtactggttatcgtcccattgtcgatgcttgtaagagttttgcttctgatgttgatattgaggacttagggttaaattccttttggaaaaaaggagaaagcaaagaggttatgtttaagaatttgcctccttataaccccaaagaccatcttgtaacattccctgagttcttgaagaagaaagagaaggttgataatggttcggatcatttgaagtatcgttggaccactccttttagtgtggctgagcttcataacataatggaagcagctaactctggagactcgttgaagttagttgtaggcaacacgggtacaggttactataaagacgaggaacggtttgatagatatattgatatcagtaacattccggagatgtcaatgatcaagaaagatgagaaaggaattgaaataggagcagctgttactatatcgaatgctattgatgctttggagaaggaaagcaaatcttcttatgttttcaagaaaatggccactcatatggagaaaattggcaaccgttctatccgaaactcgggtagtattggtggtaatctagtgatggcacagagcagaaagtttccttctgatgttaccactttgttgctcgctgtagatgcctcggtgtatatgttaaatggtaggaaaaccgagaaggttacgctacaggagtttcttgaattgtctccggtgttagactccaaacgcgttcttttaaaggttgagattccatcatggactgctccttctggtgatgacactgaatttctctttgaaagctatcgagccgcacctcgttctattggaaatgcattgccttacttgaacgctgctttcttggcgctagtgtctcgccaagaagcatcaagaaaaggtgtaacggtagaaaaatgcttcctggcatttggttcttatggcggggatcattcgatcagggcgatagaagtggagactttcttgacaggtaaattacttagctacagtgttctatatgaagctgttggtttacttaaaggaatcatagtccctggcaaagacaccttgcactcggaatatagaaaaagcttggctgttggatatctttttgagtttttttacccactgatcgagagtggccatagaatatgtagtcttgattcagggaataagcataacaacagccatgttgataccgtaaaatctcttcccttcctctcatcttcacagcaagtattagagagcaatgaatttaaacctattggtgaagcagttatcaaagttggagctgccttacaagcttctggtgaggcggtttttgttgatgatataccgactttaccagactgtcttcatggagcattcatttatagcacagagcctttggctaagataaaaagcttaagcttcagagagaatgtaactcctactggagtttttgctgttcttactttcaaggatattccacaacaaggacaaaacattggttccaagaccctttttggaccaggacctttatttgcagatgaactaactcgatgtgcaggtcaaagaattgctcttgtggttgcagacacacagaaacatgcagacatggctgcaaaacttgcagtagttgagtatgatacaaagaatttagaacaaccgatattaactgtcgaagatgcagttaaaagatctagctttttcgaggttcatccgatgttttaccccgaaccagtaggtgatgttataaaaggaatggaagaagctgagcgaaagataatctcctctgagttgaggctagggtcacagtacttcttctatatggagccacaaacagcacttgccttgccagacgaagacaattgtgtcaaggtatttagttcatctcaagcacctgagtacgtacattcggttattgctacatgtcttggcattcaagagcataacgtgagagtcatcactagaagagttggtggtggctttggtggtaaagctgtaaagtcaatgcctgttgcaaccgcatgcgcactaggcgcatacaagttgcaacgtcctgttaagatgtttttgaaccgcaagacggatatgataatggctggaggaagacatccgatgaagataaattacaatgtgggatttagatcagatgggaagctcacagcactggagcttacaatgcttatagatgcagggcttgagccagacgtaagtccaatcatgccgcggaatataatgggtccgctgaggaagtatgactggggagctttgtcatttgatgtaaaagtgtgtaagacgaattgtctgagtagaacagcgatgagagctcccggggaagttcaaggttcttacatagcggaatccattatcgagaatgtagcttcttctcttcaaatggatgttgatgcagtgagaaaaataaaccttcatacttatgatagccttagaaaattctacaatcacattgctggtgatcctgatgaatatacactgcctttattatgggagaaacttgagatatcttcaaagttcaaggaaagatctgagatggtgaaggagtttaatctttgtaatgtatggcgaaagagagggatttctcgagtacctatagtccatcaagttatgcagagaccgaccccggggaaagtaagcatactgagtgatggttctgttgtagttgaggttggaggaattgagatagggcaaggattgtggactaaagtacaacagatggttgcttatggtctcggtatggttaaatgcgaaggaaacgaaaagctcttggatagaatacgtgtagttcagtccgatacactaggtatgatccaaggaggtttcactgctggtagcacgacatccgagagcagttgtgaagccgttaggctttgctgtgttatcttggtggagagattgaaacctataatggatcagatgatgatggagaagtcaggttccgtgacatggaacatactcattcaacaagcgtatggtcagtatattaatttatcggcgagtacattgtataagccagagtattcttccatggaatatctcaactatggagttggagtcagcgaggtggaagtggaccttgtgacaggaaaaaccgagattttaagatccgatattatttatgactgtggaaagagtcttaatcctgcagttgatttaggacagaccgaaggagcatttgttcaaggcatcgggtttttcatgatggaagagtacactactgatgagaaggggcttgtggtgcaacaaggcacttgggactacaaaataccgactgtggacacaatcccaaaacacttcaacgttgagattgtcaacactggtcatcataaaaaccgcgttctctcctccaaagcgtcgggtgagccgccattgcttttagcagcttctgttcattgtgcaacaagatcagccattagggaagctcggaaacattccctttcatcgaacttcattgatgggtctgattcggaatttgagttacctgttccagcgactatgcctgtggtgaagtctctttgcggattgtatagtgtagagaaatacttacaaggaaagatcaaaggacaataa

SEQ ID NO: 7056 - protein, 1332 aa, Arabidopsis thaliana
MDLEFAVNGERFKIDSVDPSTTLLEFLRLNTPFKSVKLGCGEGGCGACLVVLSKYDPELDQVKECCINSCLTLLCSVNGCSITTSEGLGNTKKGFHPIHKRFAGFHASQCGFCTPGMCISLYSSLANAENNSSKDFTVSEAEKSVSGNLCRCTGYRPIVDACKSFASDVDIEDLGLNSFWKKGESKEVMFKNLPPYNPKDHLVTFPEFLKKKEKVDNGSDHLKYRWTTPFSVAELHNIMEAANSGDSLKLVVGNTGTGYYKDEERFDRYIDISNIPEMSMIKKDEKGIEIGAAVTISNAIDALEKESKSSYVFKKMATHMEKIGNRSIRNSGSIGGNLVMAQSRKFPSDVTTLLLAVDASVYMLNGRKTEKVTLQEFLELSPVLDSKRVLLKVEIPSWTAPSGDDTEFLFESYRAAPRSIGNALPYLNAAFLALVSRQEASRKGVTVEKCFLAFGSYGGDHSIRAIEVETFLTGKLLSYSVLYEAVGLLKGIIVPGKDTLHSEYRKSLAVGYLFEFFYPLIESGHRICSLDSGNKHNNSHVDTVKSLPFLSSSQQVLESNEFKPIGEAVIKVGAALQASGEAVFVDDIPTLPDCLHGAFIYSTEPLAKIKSLSFRENVTPTGVFAVLTFKDIPQQGQNIGSKTLFGPGPLFADELTRCAGQRIALVVADTQKHADMAAKLAVVEYDTKNLEQPILTVEDAVKRSSFFEVHPMFYPEPVGDVIKGMEEAERKIISSELRLGSQYFFYMEPQTALALPDEDNCVKVFSSSQAPEYVHSVIATCLGIQEHNVRVITRRVGGGFGGKAVKSMPVATACALGAYKLQRPVKMFLNRKTDMIMAGGRHPMKINYNVGFRSDGKLTALELTMLIDAGLEPDVSPIMPRNIMGPLRKYDWGALSFDVKVCKTNCLSRTAMRAPGEVQGSYIAESIIENVASSLQMDVDAVRKINLHTYDSLRKFYNHIAGDPDEYTLPLLWEKLEISSKFKERSEMVKEFNLCNVWRKRGISRVPIVHQVMQRPTPGKVSILSDGSVVVEVGGIEIGQGLWTKVQQMVAYGLGMVKCEGNEKLLDRIRVVQSDTLGMIQGGFTAGSTTSESSCEAVRLCCVILVERLKPIMDQMMMEKSGSVTWNILIQQAYGQYINLSASTLYKPEYSSMEYLNYGVGVSEVEVDLVTGKTEILRSDIIYDCGKSLNPAVDLGQTEGAFVQGIGFFMMEEYTTDEKGLVVQQGTWDYKIPTVDTIPKHFNVEIVNTGHHKNRVLSSKASGEPPLLLAASVHCATRSAIREARKHSLSSNFIDGSDSEFELPVPATMPVVKSLCGLYSVEKYLQGKIKGQ

SEQ ID NO: 7057 - DNA, 4071 bp, Oryza sativa subsp
  CDS (1)..(4071)
atggggtcagaggcggcggcggcggcgagggcggtggtggtggcggtgaacggggagaggtacgaggcggtgggggtcgacccgtcgacgacgctgctcgagttcctccgcacgcggacccccgtcaggggccccaagctcggctgcggcgaaggtggatgtggcgcatgcgtggtcgtcgtgtccaagtacgacgccgtcgccgacgaggtgaccgagttctcggcgagctcctgcctgacgctgctcggcagcctgcaccactgcgcggtcaccaccagcgagggcatcggcaactccagggatggcttccacgctgtgcagcggcggctctccggcttccacgcctcacagtgcggcttctgcacgccgggcatgtgcatgtccatctactccgcgctcgccaaggctgacaaggcatccggtcgccccgcgccgccgacggggttctccaagatcaccgccgccgaggcagagaaggccgtctccggcaacctgtgccgctgcactggctacaggcccatcgtcgacgcctgcaagagcttcgccgcggacgtcgacctcgaggatcttggcctcaacgccttctggaagaaaggcgtcgacgacgagcacgctgacatcaacaagctgcctgcatactccggtggcgccgccgtctgtacgttcccggagttcctcaagtcggagataaggtcgtccatgggtcaagcgaatggtgacacttcggcggtggtggtcaccggcgacggctggttccaccccaagagcgtcgaggagttccacaggttgtttgactctaacctgttcgatgaaaggtctgtgaagattgtggcatcgaacaccggctccggagtgtacaaggatcaagacctccatgacaagtacatcaacatctcgcagattccggaactctcagccatcaatagaagcagcaagggcgtagagatcggagctgtcgtgtctatctcccaagccatcgacatactgtcggatggaggcgcggtgtttagaaagatcgctgatcacctgagcaaagtggcctcgccgttcgtccggaacacggcgaccattggaggcaacatcatcatggcgcagaggttgtctttctcgtcggacatcgcaactgttcttctcgctgcaggatcaactgtcaccatccaggtggccgccaagaggatgtgcatcactctggaggagttcttgaagcagcctccatgtgattccaggacattgctggtcagcatctctatcccggattggggttcagatgatggcatcacctttcagacgtttcgtgcggctcctcgtccacttggcaatgctgtgtcatatgttaattctgcattcttggcaagaagttcagtggatggatcatcagggagccatctcattgaggatgtttgcttggcattcggcccctttggggccaagcacgccatcagagctagggaggttgagaagttcttgaagggaaaattggttagtgcaccagtgatacttgaagcagttcgtcttctgaaaggtgttgtttcaccagctgaaggcacaacacatcctgaatacagagtcagcttggccgtcagttatctgttcaaattcctgtcttcccttactaatggcttggatgagcctgaaaatgctaatgttcccaatggttcatttactaatggaaccgcaaatggtattgttgattcctcgccagagaagcactcaaatgttgacagctcttatttgccaataaaatcaaggcaagagatggttttctctgatgaatacagacctattggaaaaccgatcgagaaaacgggagctgagctccaagcttctggggaggcagtgtatgtcgatgacatctctgctccaaaggattgcctctatggggcatttatctacagcacacaccctcacgctcacataaaaggtgtaaacttcagatcatctttggcttcacagaaggtcatcacagttatcactttaaaggacattcctaccaatggaaaaaatattggatcatgctccccaatgctaggagatgaagcgcttttcgttgatcctgtttctgaatttgctggacagaatattggtgttgtgattgctgaaactcaaaagtatgcctatatggcggcgaagcaatctgtgatcgaatatagtactgaaaatcttcagccaccaattctgacagtagaagacgctgtccagcataacagctacttccaagttcccccatttttagctcctacgccaattggtgagttcaaccaagccatgtctgaagctgatcacaagatcatagatggggaggtgaaacttgaatcccaatactatttctacatggagacacagacggccttagctatccctgatgaagataactgtataaccctctatgtgtcggcgcaactacctgagattactcaaaatactgttgcgaggtgccttggcattccatatcacaacgtccgtatcatcacgagaagagttggaggaggttttggtggaaaggcaatgaaagcaatacatgttgcaactgcttgtgctgtcgccgcattcaagctgcggcgtccggttcgaatgtacctcgatcgcaagacagacatgatcatggcgggagggcggcatccgatgaaggtaaagtactccgtcggtttcaagtccgacggcaagatcacgggtctgcacgttgatctcagaatcaactgcggaatatcgccggactgcagcccggcgttgccagtcgccattgtcggggctctgaagaagtacaactggggggctctctccttcgacatcaagctctgcaagacgaacgtctcgtcgaagtcggcgatgcgggctcccggcgacgcgcagggctcgttcatcgccgaggccatcgtcgaacacatcgcgtctactctctcagtggacacgaacgccatcaggaggaagaacctccatgacttcgagagcctcaaggtgttttacgggaatagcgccggtgatccttcgacgtacagcctcgtcaccatcttcgacaagctggcgtcgtcgccggagtaccagcagagggccgccgtggtcgagcatttcaacgccggcagcaggtggaagaagcggggcatttcttgcgtgccgatcacctacgacgtgaggctccggccatctccggggaaggtgtccatcatgaacgacggctccatcgccgtcgaggtcggcggcgtcgagatcgggcaggggctgtggacgaaagtgaagcagatgacagcgttcgcgctgggccagctctgcgatgatggcggcgagggcctcctcgacaaggtccgtgtcatccaggccgacaccctgagcatgatccagggaggcttcaccggcgggagcacgacctccgagactagctgcgaggctgttcggaagtcgtgcgccgccctcgtggagaggttgaagcccatcaaggagaaggctggcacgctaccatggaaatccttgattgcccaggcaagcatggcgagcgtgaagctgacagagcacgcgtactggacgcctgaccccacgttcactagctacttgaactatggagctgcaattagtgaggtggaagtcgatgtgctgacgggagaaaccaccatcctgaggagcgacctcgtgtacgactgtgggcagagcctgaatcctgctgtggacttgggccaggtggaaggcgcattcgtgcaagggatcggcttcttcacgaacgaggagtacacgaccaactccgatgggctggtcatcaacgacggcacgtggacgtacaagatccccaccgtggacaccatccccaagcagttcaacgtcgagctcatcaacagcgcccgcgatcacaagcgcgtcctctcctccaaagcgtccggtgagccgccgctgctgctggcgtcgtcggtgcactgcgcgatgagggaggcgatcagggcggccaggaaggagttcgccggcgccggcggctcgtcgctgacgttccagatggacgtgccggcgacgatgccgatcgtcaaggagctctgcggcctcgacgtcgtggagagagatctcgagagctttgctgccaaagcctag

SEQ ID NO: 7058 - protein, 1356 aa, Oryza sativa subsp
MGSEAAAAARAVVVAVNGERYEAVGVDPSTTLLEFLRTRTPVRGPKLGCGEGGCGACVVVVSKYDAVADEVTEFSASSCLTLLGSLHHCAVTTSEGIGNSRDGFHAVQRRLSGFHASQCGFCTPGMCMSIYSALAKADKASGRPAPPTGFSKITAAEAEKAVSGNLCRCTGYRPIVDACKSFAADVDLEDLGLNAFWKKGVDDEHADINKLPAYSGGAAVCTFPEFLKSEIRSSMGQANGDTSAVVVTGDGWFHPKSVEEFHRLFDSNLFDERSVKIVASNTGSGVYKDQDLHDKYINISQIPELSAINRSSKGVEIGAVVSISQAIDILSDGGAVFRKIADHLSKVASPFVRNTATIGGNIIMAQRLSFSSDIATVLLAAGSTVTIQVAAKRMCITLEEFLKQPPCDSRTLLVSISIPDWGSDDGITFQTFRAAPRPLGNAVSYVNSAFLARSSVDGSSGSHLIEDVCLAFGPFGAKHAIRAREVEKFLKGKLVSAPVILEAVRLLKGVVSPAEGTTHPEYRVSLAVSYLFKFLSSLTNGLDEPENANVPNGSFTNGTANGIVDSSPEKHSNVDSSYLPIKSRQEMVFSDEYRPIGKPIEKTGAELQASGEAVYVDDISAPKDCLYGAFIYSTHPHAHIKGVNFRSSLASQKVITVITLKDIPTNGKNIGSCSPMLGDEALFVDPVSEFAGQNIGVVIAETQKYAYMAAKQSVIEYSTENLQPPILTVEDAVQHNSYFQVPPFLAPTPIGEFNQAMSEADHKIIDGEVKLESQYYFYMETQTALAIPDEDNCITLYVSAQLPEITQNTVARCLGIPYHNVRIITRRVGGGFGGKAMKAIHVATACAVAAFKLRRPVRMYLDRKTDMIMAGGRHPMKVKYSVGFKSDGKITGLHVDLRINCGISPDCSPALPVAIVGALKKYNWGALSFDIKLCKTNVSSKSAMRAPGDAQGSFIAEAIVEHIASTLSVDTNAIRRKNLHDFESLKVFYGNSAGDPSTYSLVTIFDKLASSPEYQQRAAVVEHFNAGSRWKKRGISCVPITYDVRLRPSPGKVSIMNDGSIAVEVGGVEIGQGLWTKVKQMTAFALGQLCDDGGEGLLDKVRVIQADTLSMIQGGFTGGSTTSETSCEAVRKSCAALVERLKPIKEKAGTLPWKSLIAQASMASVKLTEHAYWTPDPTFTSYLNYGAAISEVEVDVLTGETTILRSDLVYDCGQSLNPAVDLGQVEGAFVQGIGFFTNEEYTTNSDGLVINDGTWTYKIPTVDTIPKQFNVELINSARDHKRVLSSKASGEPPLLLASSVHCAMREAIRAARKEFAGAGGSSLTFQMDVPATMPIVKELCGLDVVERDLESFAAKA

SEQ ID NO: 7059 - DNA, 4014 bp, Arabidopsis thaliana
  CDS (1)..(4014)
atggcgggtgacgatttggtgtttgctgttaatggagagaaatttgaagtcttgtcagttaatccttctacgactttgctcgagttcttgcgttccaatacttgctttaagagtgtcaagctcagctgtggcgaagggggttgtggtgcttgcatcgtaattctatcaaaatacgatcctgtgttagaccaagtcgaggagtattctataaactcttgcctgacccttctttgcagcttaaatgggtgctccataactacatccgatggactcggaaacactgaaaaagggttccacccaattcacaagagatttgcggggttccatgcctctcaatgtggtttctgtaccccagggatgtgcatctctctctactccgctctttcaaaagcccataactcacaatcttctccagactacctgactgctcttgcagcagagaagtccattgctggaaatctttgtcgctgcaccgggtatcgtcccattgctgatgcttgtaagagttttgcttccgatgtcgatatagaggatttgggcttcaactctttttggaggaaaggagaaagcagagaagagatgttaaagaaattgcctccttacaaccctgagaaagatcttatcacttttccggatttcttgaaggaaaagattaagtgtcaacacaatgttttggatcagacgaggtatcattggagcactcctggtagcgtcgcagagcttcaggaaatattggcaacaaccaaccctggcaaagatagaggtttgataaaattagttgttggcaacacgggaacaggttactacaaagaagagaaacaatatggtagatatattgatattagccacattccagagatgtcaatgatcaagaaagatgacagagaaattgaaattggagcagttgttaccatatctaaagttattgatgctttgatggaggaaaatacatctgcttatgttttcaagaaaatcggtgtccatatggagaaggtggctaaccattttatcagaaactcagggagtatcggtggtaatctagtgatggcacagagcaaaagttttccttctgacataaccacacttttgctcgctgcagatgcatctgtgcatatgataaatgctgggagacacgagaagcttaggatgggagagtatcttgtgtcgcctccaatattagacactaaaactgttcttttaaaggttcatattcctaggtggattgcttcttccactactggtttgcttttcgaaacctatcgggctgcacttcgccctattggaagtgcattgccttatatcaacgctgctttcttagcagtagtctctcacgatgcatcatcaagcggcatcattgtggataaatgccggttggcatttggttcttatggtgggtatcattccatcagggcgagggaagttgaggatttcttgacgggtaaaatactcagccacagtgttttatatgaagctgtgaggttacttaaagggatcatagttcccagcatagatacctcatattctgagtataagaaaagcttggccgttgggtttctctttgattttctctatcctctgatcgagagtggcagttgggattccgaaggaaagcatatcgatgggcacatcgatccaacaatatgtctacctttgctgtcatctgcgcagcaggtgtttgaaagtaaagaatatcaccctgttggtgaagccattatcaaatttggagctgaaatgcaggcttctggtgaagctgtttacgttgatgatattccatccttaccccattgtctacatggagcattcatttatagcacaaagccattggcttggataaagagcgttggtttctcaggaaatgtgacaccaattggagttttggcagttattactttcaaagatatacctgaagtggggcaaaacattggttacataacgatgtttggcacagggcttctatttgcagatgaagttactatatctgccggacaaataattgctcttgtggttgcagacacacaaaagcatgcagatatggcagcacaccttgcagtagttgagtacgattcaaggaatataggaacaccagtattatctgtggaggatgcagtcaaaaggtccagcctttttgaggttcctcccgagtatcagcccgaacctgttggcgatatttcaaaaggaatggctgaagctgatcgcaagatacgctcagtagagttgagacttgggtcacagtacttcttctatatggagacacaaacagcacttgccttgccagatgaagacaactgtttagtggtttacagttcaactcaagcacccgagttcacacaaacagtaattgctacatgtcttggaatcccggagcataacgttcgagtcatcaccagaagagttggaggtggctttggtggaaaagctataaagtctatgcctgttgcgacagcatgtgcgcttgctgcaaaaaaaatgcagcgtcctgtaaggatatacgtcaaccgtaagactgatatgataatggctggaggaaggcatcccctgaaaataacttacagtgtaggattcagatctgacggtaaactcacagcactagacctaaatttgtttatagatgcagggtcagatgtggatgtaagtctagtgatgccacagaatataatgaactccctgaggaaatatgactggggtgcattgtcatttgacatcaaagtgtgtaagacaaaccttccgagcagaacgtctttgagggcacccggtgaagtacaaggttcatacattgctgaatccattattgagaacgtagcatcttccctgaagatggacgtggatgttgtgagaaggataaatcttcatacgtacgaaagcctccgcaagttttataagcaagctgctggtgagcctgatgaatatactttgcctttattgtgggacaaattggaggtatctgcagatttcaggcgaagggctgaatctgtgaaagagtttaaccgatgtaacatatggcgcaaaagggggatttctcgagtaccaatcatccatctagttatacataggccaactccaggaaaagtaagcattttgaatgatggttcagttgcggttgaggttgcagggattgaggtgggacaagggttatggacaaaggtacaacagatggttgcttatggtcttggtatgataaaatgcgagggaagtgatgatctgcttgaaagaatacggcttcttcagactgacacgctcagtatgtctcaaagcagttacactgcgggtagcacaacatcagagaactgttgtgaagcagtgaggctttgctgcggtatcttggtggagaggctgagacctaccatgaatcagattctggagaatgctcgatccgtgacatgggacatgctcattcaacaggcgaatgctcaatctgtggacctatcagctcgaaccttttataagccagagtcctcttctgcagaatatctcaactatggagttggagcgagtgaggtggaggttgaccttgtgacaggaagaacagaaattataagatcagatattatctatgactgtggaaaaagccttaatcctgctgttgatttaggacagattgaaggagcgtttgttcaaggaatcggatttttcatgtatgaggagtacacgacaaatgaaaacgggcttgtgaatgaagaaggtacatgggactacaaaatacctacaatagacacaattcccaaacaattcaacgttcagattctcaacagtggtcatcacaagaaccgcgttctctcctctaaagcttcaggtgagcctccgttgcttgtggcggcttcagtgcactgtgcaacaagatcagccattagagaagctcgaaaacagtacctatcatggaattgcattgatgatgatcatagagaaagatgtgatcttggttttgagttaccggttccagcgactatgccggtggtgaagcagctttgtggccttgaaagcatagagaagtacttagaatggaaaacatatccttaa

SEQ ID NO: 7060 - protein, 1337 aa, Arabidopsis thaliana
MAGDDLVFAVNGEKFEVLSVNPSTTLLEFLRSNTCFKSVKLSCGEGGCGACIVILSKYDPVLDQVEEYSINSCLTLLCSLNGCSITTSDGLGNTEKGFHPIHKRFAGFHASQCGFCTPGMCISLYSALSKAHNSQSSPDYLTALAAEKSIAGNLCRCTGYRPIADACKSFASDVDIEDLGFNSFWRKGESREEMLKKLPPYNPEKDLITFPDFLKEKIKCQHNVLDQTRYHWSTPGSVAELQEILATTNPGKDRGLIKLVVGNTGTGYYKEEKQYGRYIDISHIPEMSMIKKDDREIEIGAVVTISKVIDALMEENTSAYVFKKIGVHMEKVANHFIRNSGSIGGNLVMAQSKSFPSDITTLLLAADASVHMINAGRHEKLRMGEYLVSPPILDTKTVLLKVHIPRWIASSTTGLLFETYRAALRPIGSALPYINAAFLAVVSHDASSSGIIVDKCRLAFGSYGGYHSIRAREVEDFLTGKILSHSVLYEAVRLLKGIIVPSIDTSYSEYKKSLAVGFLFDFLYPLIESGSWDSEGKHIDGHIDPTICLPLLSSAQQVFESKEYHPVGEAIIKFGAEMQASGEAVYVDDIPSLPHCLHGAFIYSTKPLAWIKSVGFSGNVTPIGVLAVITFKDIPEVGQNIGYITMFGTGLLFADEVTISAGQIIALVVADTQKHADMAAHLAVVEYDSRNIGTPVLSVEDAVKRSSLFEVPPEYQPEPVGDISKGMAEADRKIRSVELRLGSQYFFYMETQTALALPDEDNCLVVYSSTQAPEFTQTVIATCLGIPEHNVRVITRRVGGGFGGKAIKSMPVATACALAAKKMQRPVRIYVNRKTDMIMAGGRHPLKITYSVGFRSDGKLTALDLNLFIDAGSDVDVSLVMPQNIMNSLRKYDWGALSFDIKVCKTNLPSRTSLRAPGEVQGSYIAESIIENVASSLKMDVDVVRRINLHTYESLRKFYKQAAGEPDEYTLPLLWDKLEVSADFRRRAESVKEFNRCNIWRKRGISRVPIIHLVIHRPTPGKVSILNDGSVAVEVAGIEVGQGLWTKVQQMVAYGLGMIKCEGSDDLLERIRLLQTDTLSMSQSSYTAGSTTSENCCEAVRLCCGILVERLRPTMNQILENARSVTWDMLIQQANAQSVDLSARTFYKPESSSAEYLNYGVGASEVEVDLVTGRTEIIRSDIIYDCGKSLNPAVDLGQIEGAFVQGIGFFMYEEYTTNENGLVNEEGTWDYKIPTIDTIPKQFNVQILNSGHHKNRVLSSKASGEPPLLVAASVHCATRSAIREARKQYLSWNCIDDDHRERCDLGFELPVPATMPVVKQLCGLESIEKYLEWKTYP

SEQ ID NO: 7061 - DNA, 2724 bp, Desulfovibrio gigas
  CDS (1)..(2724): transl_table=11
atgattcaaaaagtaatcaccgtcaacggcatcgagcagaatctgttcgtggacgccgaagccctgctgtctgacgtgctgcgtcagcaactcgggctcaccggcgtcaaggtgggctgcgaacagggccagtgcggcgcctgctccgtcatcctggatggcaaagtggtgcgcgcctgcgtcaccaaaatgaagcgcgtggccgacggcgcgcagatcaccaccatcgaaggcgtgggccagccggagaacctgcatccgttgcagaaagcctgggtgctgcacggcggcgcgcaatgcggcttctgctcccccggcttcatcgtctccgccaagggcctcctggacaccaacgccgacccctctcgcgaagacgtgcgtgattggttccagaagcatcgcaatgcttgccgttgcaccggctacaagccgctggtggacgccgtgatggacgccgccgcggtcatcaatggcaagaagcccgaaaccgacctggaattcaagatgcccgccgacggccgcatctggggctccaaatacccccgccccacggccgtggccaaggtcaccggcacgctggactacggcgcggacctgggcctgaaaatgcccgctggcaccctgcacttggccatggtccaggccaaggtgtcccacgccaacatcaagggcatcgacacctccgaagccctcaccatgcccggcgtccacagcgtcatcacgcacaaggacgtcaagggcaagaaccgcatcaccggcctcatcaccttccccaccaacaagggtgacggctgggatcgtcccatcctgtgcgacgaaaaggtcttccagtacggcgactgcatcgccctggtctgcgccgactccgaagccaacgcccgcgccgcggccgaaaaggtgaaggtggacctggaagaactgcccgcgtacatgagcggccctgccgctgcggccgaggatgccattgagatccatcccggcacgcccaacgtgtactttgaacagcccatcgtcaagggcgaagacaccggccccatcttcgcctcggccgacgtcaccgtggaaggcgacttctacgtgggccgccagccgcacatgcccatcgaaccagacgtagcctttgcctacatgggcgacgacggcaagtgctacatccactccaagtccatcggcgtgcacctgcacctgtacatgatcgcccccggcgtgggcctggaacccgatcagctggtgctggtggccaaccccatgggcggcaccttcggctacaagttcagccccacctccgaagccctggtggccgtggcggccatggccacgggccgccccgtgcacctgcgctacaactatcagcagcagcagcagtacaccggcaagcgctccccgtgggaaatgaacgtcaagttcgcggccaagaaagacggcacgctcctggccatggaatccgactggctggtggaccacggcccctactcggaattcggcgacctcctgaccctgcgcggcgcacagttcatcggcgccggctacaacatccccaacatccgcggcctcggtcgcactgtggccaccaaccacgtctggggctctgccttccgcggctacggtgcgcctcagtccatgttcgcctccgaatgtctcatggacatgctggcggaaaagctgggcatggacccgctggaactgcgctacaagaacgcctaccgccccggcgacaccaaccccaccggccaggaacctgaagtcttcagcctgccggacatgatcgaccagctgcggcccaagtatcaggctgctctggaaaaggcccaaaaggaatccaccgccacccataagaagggcgtgggcatctccatcggcgtgtacggcagcggcctggacggccctgacgcctccgaagcctgggccgagctcaatgccgacggcaccatcaccgtgcatacggcctgggaagaccatggccagggcgcggacatcggctgcgtgggcacggcgcacgaagccctgcgtcccatgggcgtggctccggaaaagatcaagttcacctggcccaacaccgccaccacccccaactccggcccctccggaggctcccgccagcaggtgatgaccggcaacgccatccgcgtggcctgtgaaaacctcctcaaggcctgtgaaaagcccggcggcggctactacacctacgacgaactgaaagccgcggacaagcccaccaagatcaccggcaactggaccgccagcggggccacccactgcgacgccgtgaccggccttggcaagccctttgtggtgtacatgtacggcgtgttcatggccgaagtgaccgtggacgtggccaccggccagaccaccgtggacggcatgaccctcatggccgacctcggcagcctctgcaaccagctggccaccgacgggcagatctacggcggcctggcccagggcatcggcctggccctgtccgaggacttcgaggacatcaagaagcacgccaccctcgtgggcgcgggcttcccgttcatcaagcagatcccggacaagctggacatcgtgtacgtgaaccatccgcgtccggacggccccttcggcgcttccggtgtgggcgaactgcccctgaccagcccgcacgcggccatcatcaacgccatcaagagcgccactggcgtgcgcatctaccgcctcccggcctacccggaaaaggtgctggaagccttgaaggcctaa

SEQ ID NO: 7062 - protein, 907 aa, Desulfovibrio gigas
MIQKVITVNGIEQNLFVDAEALLSDVLRQQLGLTGVKVGCEQGQCGACSVILDGKVVRACVTKMKRVADGAQITTIEGVGQPENLHPLQKAWVLHGGAQCGFCSPGFIVSAKGLLDTNADPSREDVRDWFQKHRNACRCTGYKPLVDAVMDAAAVINGKKPETDLEFKMPADGRIWGSKYPRPTAVAKVTGTLDYGADLGLKMPAGTLHLAMVQAKVSHANIKGIDTSEALTMPGVHSVITHKDVKGKNRITGLITFPTNKGDGWDRPILCDEKVFQYGDCIALVCADSEANARAAAEKVKVDLEELPAYMSGPAAAAEDAIEIHPGTPNVYFEQPIVKGEDTGPIFASADVTVEGDFYVGRQPHMPIEPDVAFAYMGDDGKCYIHSKSIGVHLHLYMIAPGVGLEPDQLVLVANPMGGTFGYKFSPTSEALVAVAAMATGRPVHLRYNYQQQQQYTGKRSPWEMNVKFAAKKDGTLLAMESDWLVDHGPYSEFGDLLTLRGAQFIGAGYNIPNIRGLGRTVATNHVWGSAFRGYGAPQSMFASECLMDMLAEKLGMDPLELRYKNAYRPGDTNPTGQEPEVFSLPDMIDQLRPKYQAALEKAQKESTATHKKGVGISIGVYGSGLDGPDASEAWAELNADGTITVHTAWEDHGQGADIGCVGTAHEALRPMGVAPEKIKFTWPNTATTPNSGPSGGSRQQVMTGNAIRVACENLLKACEKPGGGYYTYDELKAADKPTKITGNWTASGATHCDAVTGLGKPFVVYMYGVFMAEVTVDVATGQTTVDGMTLMADLGSLCNQLATDGQIYGGLAQGIGLALSEDFEDIKKHATLVGAGFPFIKQIPDKLDIVYVNHPRPDGPFGASGVGELPLTSPHAAIINAIKSATGVRIYRLPAYPEKVLEALKA

SEQ ID NO: 7063 - DNA, 2871 bp, Escherichia coli O157
  CDS (1)..(2871): transl_table=11
  misc_feature (1695)..(1695): y is t or c
atgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaatcatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgccctgatatctactataccccggggggtcagagcgcaccggaaccgtcaccgcttgaccgccgtatgttcggcaaaaaaatgcgtcacgtcggcgatcgcgttgctgcggtggtcgctgaaagtgaagaaattgcgctcgaagcattgaaactcatcgaggttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgctagtattcatggtcatattggcgatatggacaaaggctttgccgatgccgatgtgatcattgagcgaacctataactcaacgcaggcgcagcagtgcccgactgaaacacatatctgctttacccggatggacggcgatcgtctggttatccacgcctccacccaggtaccatggcacttacgccgccaggtcgcgcgcctcgtggacatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaayttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgcgcactggaagagatcctgcgtcaggggcgcgagatgatccaatggtcttcaccaaaaccacaaaatggtgactggcacatcggtcgtggtgtcgccattatcatgcagaaatcagggatcccggatatcgatcaggctaactgcatgatcaaactggaatcagacggtacctttatcgttcattctggcggtgcggatattggtactggtctggataccgtggtgacgaaactggcagcagaagtgctgcactgcccaccgcaggacgtgcatgttatctccggtgataccgatcatgcgttgtttgataaaggcgcatatgcctcgtccggtacttgcttctcgggtaacgcggcgcgtttggcagcggaaaatctgcgggagaaaattctgttccacggcgcgcaaatgttgggtgagccagtggcagatgttcaactagcaacgccgggcgtcgtgcgcggcaagaaaggcgaagttagtttcggggatattgcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgctaccctgcgagctatcggccacagtatgagcgaagagatcatttatgacgccgaaggtcacccgttaacgcgtgatttacgcagctacggcgcaccgaaaattggtgacattccgcgtgatttccgcgcagtgctggtgccgagcgacgataaagtcggcccgttcggggcgaaatcgatctcggaaatcggtgtaaatggcgcagctccggcgattgctaccgcaattcacgatgcatgcggcatctggttacgcgaatggcatttcacaccggagaaaatactcaccgcgctggaaaagatataa

SEQ ID NO: 7064 - protein, 956 aa, Escherichia coli O157
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIAAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEEIALEALKLIEVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVDMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRVHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEPVADVQLATPGVVRGKKGEVSFGDIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACGIWLREWHFTPEKILTALEKI

SEQ ID NO: 7065 - DNA, 4008 bp, Drosophila melanogaster
  CDS (1)..(4008)
atgtctaactcggttttggtgtttttcgtgaatggaaagaaggtgaccgaagtgtcgcctgatccggagtgcacgctcctcacattcctgcgcgaaaagctgcggctgtgcggaacgaagttgggatgtgcggaaggcggatgcggcgcctgcaccgtgatggtgtcccgcctagaccgtcgggccaacaagatacgtcacctggcggtcaacgcctgcctgacgccagtgtgctcgatgcacggatgtgcggtgaccactgtggagggtatagggagcaccaaaacgcgtctgcatccggtgcaggagcgactggccaaggcgcacggatcccagtgcggcttctgcacgccgggcattgtgatgtccatgtacgcacttctgcggaacgcggagcaaccctctatgcgagacttggaggtggcattccaaggtaacctgtgccgctgcaccggctatcgacccattctcgagggctacaagacgttcaccaaggagtttgcctgcggaatgggcgagaagtgctgcaaagttagtgggaaaggatgcggaaccgatgcggagaccgatgacaagctcttcgagcgcagcgaattccagcccttggatcccagccaggaacccatcttcccaccggaacttcagctgagtgacgccttcgattctcagagtttgatctttagttcggatagggtgacctggtatcgtcccaccaatctggaggagctgcttcagctgaaggccaaacatccggctgccaagctggtcgtgggcaatacggaagtgggcgttgaggttaagttcaagcacttcctctacccgcacctcattaatcccacccaggtgaaggagctgctggagatcaaagagaaccaggatggcatttacttcggtgcggctgtcagtttgatggagatcgatgcgcttctgcggcagagaatcgagcagctgccggaatcggagaccagattgttccagtgcaccgtggatatgcttcactactttgccggcaagcagatccgcaacgtcgcctgtttgggtggaaacatcatgaccggtagtcccatttccgatatgaatcctgtgctctcggcagcaggagctcaactggaggtggccagttttgtggatggaaagctccaaaagagatcagttcacatgggaactgggttcttcactggctatcgcaggaatgttatcgaagcccacgaggtgctgctgggcatccactttcggaagaccactccggaccagtatatcgttgcttttaagcaggccaggagaagggatgatgacatagccatcgtaaatgccgcaataaacgttcgctttgaggaaaaatccaacattgtggcggagatctcgatggcttttggtggaatggcaccaaccacagtgctcgctcctcgaacttcccaactgatggttgggcaggagtggagccaccagctcgtggagcgcgtggcggagagcttgtgcacggagctgcctttggctgcctccgctccgggtggcatgatcgcctatcgtcgagctctggtggtgagcctgttcttcaaggcctatctggccatttccctgaagctgagcaagtcagggatcacatcttccgatgctctgccatcggaggagcgaagtggtgccgagacattccacacaccagtactcaaaagtgcccagctcttcgagcgcgtctgcagcgatcaacccatctgtgatcccattgggagaccaaaagttcatgcggctgctttgaaacaggccactggtgaagctatctacacagatgacattccccgcatggatggtgaagtttatctggcctttgtccttagtaccaagccacgtgccaagatcaccaagctggatgccagtgaagctctggccctggacggagtgcatcagttcttttgctacaaggacttaacggagcacgagaacgaagtgggacccgtctttcatgatgagcacgtctttgctgctggagaagtgcattgctatggtcagatagtgggcgccatagctgccgataataaggcgttggcccaaagagccgctcggctagtgaaagtggagtacgaggagctgagcccggttatcgtgaccatagagcaggccatcgagcacaagtcctatttcccggactaccctcgattcgtgaccaagggcaatgtggaggaggctttagcccaggcggatcacactttcgagggcacctgtcgaatgggcggacaggagcacttctatctggagacccatgctgcattggcggtacctcgtgacagcgatgagctggaactcttttgctccacgcagcatccctcggaggtgcagaagctagtggcccatgtaaccgcacttcctgcccaccgtgtcgtctgtcgtgccaagcgtttgggaggcggtttcggcggcaaggagtccagaggcatctccgtggccctacccgttgccctggccgcctatcgaatgggtcgtcctgtgcgctgtatgttggatcgcgatgaggacatgcttatcaccggcaccaggcatcccttcctcttcaaatacaaagtgggcttcaccaaggagggtctgatcactgcctgcgacattgagtgctacaacaatgccggttggtccatggatctgtcattttcggttcttgagcgcgccatgttccactttgagaattgctacaggattcccaacgttcgcgtgggtggatgggtctgcaagacgaacctgccctcgaatacggccttccgtggatttggaggaccacaaggcatgtacgccggtgagcatatcatccgggatgtggcccggatagtgggtcgcgatgtggtggatgtgatgcggctgaacttctacaagactggagactacacacactaccaccagcagctggagcacttccccatcgagcggtgtctggaggattgcttgaagcagtcgagatacgacgagaagcggcaggagattgctcgattcaatcgggagaatcgctggcggaaacgcggcatggcggtggtgcctaccaagtatggaatcgcatttggagtgatgcacttgaaccaagcgggatcgctgatcaacatctatggtgatggatccgtgttgctttcgcacggaggagttgagatcggacaaggtctgaataccaagatgattcagtgcgccgccagggctctggggattccttcggaactgattcacatttcggaaacggccacggataaagtacccaacacttcacccacggcggcgagtgtgggatccgatttgaacggaatggccgtactggatgcgtgtgaaaagttgaacaaaagactggcgcccatcaaggaggcattgcctggaggcacctggaaggagtggatcaacaaggcgtatttcgatcgggtcagcctctcggccacaggattctatgccatgcccgggattggatatcacccggaaacgaatcccaatgcccgcacctatagctactacacgaatggcgtgggagtcactgtggtagagatcgattgcctgactggcgaccatcaggtgctcagcacagacatcgtaatggacatcggttccagcctgaatccggctattgacattggtcagatcgagggagcattcatgcagggctatggactgttcactttggaggaactcatgtactcaccacaaggcatgctttactccagaggtccgggcatgtataagctgccaggatttgccgacattcccggggagttcaatgtcagcctactgaccggtgcccccaatccacgggcagtctactcttccaaggcagtgggtgaacctccgctcttcattggatcatctgcattctttgccattaaggaggccattgcagctgctcgcgaggatcagggcttgagtggtgacttcccactggaggcgccttccacatcggcacgcattcgaattgcttgtcaggataagttcacggaactgcttgaaatacccgaaccaggatcatttacgccatggaacattgtgccttaa

SEQ ID NO: 7066 - protein, 1335 aa, Drosophila melanogaster
MSNSVLVFFVNGKKVTEVSPDPECTLLTFLREKLRLCGTKLGCAEGGCGACTVMVSRLDRRANKIRHLAVNACLTPVCSMHGCAVTTVEGIGSTKTRLHPVQERLAKAHGSQCGFCTPGIVMSMYALLRNAEQPSMRDLEVAFQGNLCRCTGYRPILEGYKTFTKEFACGMGEKCCKVSGKGCGTDAETDDKLFERSEFQPLDPSQEPIFPPELQLSDAFDSQSLIFSSDRVTWYRPTNLEELLQLKAKHPAAKLVVGNTEVGVEVKFKHFLYPHLINPTQVKELLEIKENQDGIYFGAAVSLMEIDALLRQRIEQLPESETRLFQCTVDMLHYFAGKQIRNVACLGGNIMTGSPISDMNPVLSAAGAQLEVASFVDGKLQKRSVHMGTGFFTGYRRNVIEAHEVLLGIHFRKTTPDQYIVAFKQARRRDDDIAIVNAAINVRFEEKSNIVAEISMAFGGMAPTTVLAPRTSQLMVGQEWSHQLVERVAESLCTELPLAASAPGGMIAYRRALVVSLFFKAYLAISLKLSKSGITSSDALPSEERSGAETFHTPVLKSAQLFERVCSDQPICDPIGRPKVHAAALKQATGEAIYTDDIPRMDGEVYLAFVLSTKPRAKITKLDASEALALDGVHQFFCYKDLTEHENEVGPVFHDEHVFAAGEVHCYGQIVGAIAADNKALAQRAARLVKVEYEELSPVIVTIEQAIEHKSYFPDYPRFVTKGNVEEALAQADHTFEGTCRMGGQEHFYLETHAALAVPRDSDELELFCSTQHPSEVQKLVAHVTALPAHRVVCRAKRLGGGFGGKESRGISVALPVALAAYRMGRPVRCMLDRDEDMLITGTRHPFLFKYKVGFTKEGLITACDIECYNNAGWSMDLSFSVLERAMFHFENCYRIPNVRVGGWVCKTNLPSNTAFRGFGGPQGMYAGEHIIRDVARIVGRDVVDVMRLNFYKTGDYTHYHQQLEHFPIERCLEDCLKQSRYDEKRQEIARFNRENRWRKRGMAVVPTKYGIAFGVMHLNQAGSLINIYGDGSVLLSHGGVEIGQGLNTKMIQCAARALGIPSELIHISETATDKVPNTSPTAASVGSDLNGMAVLDACEKLNKRLAPIKEALPGGTWKEWINKAYFDRVSLSATGFYAMPGIGYHPETNPNARTYSYYTNGVGVTVVEIDCLTGDHQVLSTDIVMDIGSSLNPAIDIGQIEGAFMQGYGLFTLEELMYSPQGMLYSRGPGMYKLPGFADIPGEFNVSLLTGAPNPRAVYSSKAVGEPPLFIGSSAFFAIKEAIAAAREDQGLSGDFPLEAPSTSARIRIACQDKFTELLEIPEPGSFTPWNIVP

SEQ ID NO: 7067 - DNA, 4035 bp, Drosophila subobscura
  CDS (1)..(4035)
atgtccggccagcagcaagccacttcggtgttggtgttttttgtgaatgggaagaaggtaacggacacaaatcccgatccggaatgcaccctcctcacgtatctgcgggacaagctgcgcctgtgcggcacgaagctgggatgtgccgagggcggctgcggcgcctgcacggtgatgatctcccgcatggatcgtggccagcataagatcagacatctggcagtcaatgcctgcctcacgcccgtgtgtgccatgcatgggtgtgccgtgaccacggtggagggcatcggcagcaccagaactcggctgcacccggtgcaggagcggctggccaaggcgcacggatcgcagtgtggtttctgcacgccgggcatagtgatgtccatgtacgcgctgctgcgaaatgccgaacaaccttcgatgcgggatctggaggtggcgtttcagggcaatctttgccgctgcaccggctaccggcccatactcgagggctacaagaccttcaccaaggagttcctgtgcggcatgggcgagaagtgctgcagagtcaatggcaagggatgtggaggaggcgatgatcccgaatccgtgacggatgacactctgttcgagcgcagcaagttccagcctttggatgccagccaggagcccattttcccacccgaactgcagctgagcaacgcctatgacagcgagagtttggtcttcagctcggagcgtgtcacctggtaccgtccgacgacgctgcaggagctgctccagctgaaggccgctcatccagcggccaagctggtggtgggcaacacggaggtcggcgtggaggtcaagttcaagcattttctctacccgcacctgatcaatcccacgctggtggcggagctgcaggaggtgcgcgagtcggaggagagcatttactttggggctgccgtcagcctgatggagattgacgcgctgctccggcaacgcatcgaggagctgccggaggcgcagacacgcctcttccagtgcaccgtggacatgctgcactactttgccggcaagcagatccgcaacgtggcctgtctgggtggcaacatcatgacgggcagccccatttcggacatgaatcccgtgctgacagccgccggcgctcgcctggaggtggccagcatcgtggagggtaaaataagccagcggactgtccacatgggcacgggcttcttcaccggctatcggcgcaatgtcatcgagccgcaggaggttttgctgggcattcacttccagaagacgacgccggatcagcatgtggtggccttcaagcaggcgcgccgacgcgacgatgacattgccattgtcaatgcggcagtcaatgtccgctttgagcccaagtccaatgtggtggcggagatttccatggcattcggcggcatggcacccacaacggtgctggcacctcgcacctcccaattgatggtcaagcagccactggatcatcagctgctggagcgcgtggcggagagtctgtgtggggagctaccactggcggcttccgcaccgggcggcatgattgcctatcgccgcgctctggtggtcagcctgatcttcaaggcttacctcgccatcagtagcaagctgagcgaagcgggcatcatagccggcgacgccattcccccgaaggagcgcagcggcgccgagcttttccacactcccacgctgcgtagtgcgcagctgttcgagcgcgtctgcagcgatcagcccgtgtgtgatcccattggcaggccggaggtgcatgccgctgccctgaagcaggccacaggtgaggccatctacacggatgacattccacgcatggatggcgaactctatctgggtttcgtgctgagcacaaagcccagggccaagataaccaaactggatgccagcgctgcgctggcgctggagggcgtgcacgcattcttcagccacaaggatctgacggtgcacgagaacgaggtgggtccggtgttccacgatgagcacgtgttcgcggccggagaggtgcactgctacggccagatcgtgggcgccgtggcggcggacaacaaggcgctggcacagcgtgcgtcgcggctcgtgcgtgtggagtacgaagacctttcgccggtgattgtcaccattgagcaggccattgagcatggctcctactttcccgactatccgcgctacgtgaccaagggcaatatggcagaggcctttgcgcaggcggagcacacctacgagggcagctgtcgcatgggtggccaggagcacttctatctggagactcacgcggctgtggccgtgcctcgtgacagcgacgagctggagcttttctgctccacccagcatccgtcggaggtgcagaagctggtggctcacgtgacctcgctgcccgcacaccgcgtggtgtgccgtgccaagcgtctgggtggtggcttcggcggcaaggagtcgcgtggcatatccgtggctctgcccgtggccttggctgcctatcgactgcgtcgccccgtgcgctgcatgctggaccgcgacgaggatatgctgatcactggcacacgccatcccttccttttcaagtacaaggtggcgttcagcagcgacggcctcatcacagcctgcgacattgagtgctacaacaatgccggctggtccatggatttgtcgttttcggtcttggagcgtgccatgtaccactttgagaactgctaccacatacccaatgtgcgcgttgggggctgggtctgcaaaacgaatctgccctcgaacacggccttcagaggatttggtggaccgcagggcatgtttgccggcgagcacatcatcagggacgtcgcgcgaatcgtgggccgcgatgtgctggatgtgatgcgtctgaatttctacagaacgggcgacaccacgcactacaaccagcagctggagcactttcccatcgaacgctgcctcgatgactgcctcacgcagtcgcgctaccacgagaggcgtgcggagattgcaaaattcaatcgggagaaccgatggcgcaagcgcggagtggccgtgattcccaccaagtatggcattgcctttggggtgatgcatctgaaccaggcgggtgccctgctcaatgtctatggcgatggctcggtgctgctgtcgcacggcggcgtcgagattggccagggcctcaacaccaagatgattcagtgtgctgcccgtgcgctgggcataccctcggagctgattcacatttcagagacggccacggacaaggtgcccaacacctcacccacggcggccagtgttggctcggacatcaatggcatggccgtgctggacgcctgcgagaagctcaacaagcgtctggcgccgatcaaggaagccctgccacaggcgacatggcaggagtggatcaacaaggcgtactttgatcgggttagcctctcggccacgggcttctatgccatgcccggcattggctaccatccggagacgaatcccaatgcacgcacctacagctactacaccaacggcgtgggcatcagcgtcgtggagattgactgcctgacgggcgatcaccaagtgctcagcacggacattgtcatggacatcggttcgagcatcaatccggccattgacattggccagatcgagggcgccttcatgcagggctacgggctgttcacgctcgaggagctcatgtactcgccgcagggcatgctctactcgcgcggtcctggcatgtacaagctgcccggctttgccgacattcccggcgagtttaatgtcagcctgctcacaggcgctcccaatccgcgtgctgtctactcctccaaggccgttggggagccaccgctcttcatcggcgcctcagcattctttgccatcaaggaggccattgccgccgctcgccaggagcacggcctgactggggactttccgctggaggcgccctccacctctgcccgcatacgcatggcctgccaggataaatttactaatctgctggaagtacccgaggcaggcagctttacaccttggaatattgtgccataa

SEQ ID NO: 7068 - protein, 1344 aa, Drosophila subobscura
MSGQQQATSVLVFFVNGKKVTDTNPDPECTLLTYLRDKLRLCGTKLGCAEGGCGACTVMISRMDRGQHKIRHLAVNACLTPVCAMHGCAVTTVEGIGSTRTRLHPVQERLAKAHGSQCGFCTPGIVMSMYALLRNAEQPSMRDLEVAFQGNLCRCTGYRPILEGYKTFTKEFLCGMGEKCCRVNGKGCGGGDDPESVTDDTLFERSKFQPLDASQEPIFPPELQLSNAYDSESLVFSSERVTWYRPTTLQELLQLKAAHPAAKLVVGNTEVGVEVKFKHFLYPHLINPTLVAELQEVRESEESIYFGAAVSLMEIDALLRQRIEELPEAQTRLFQCTVDMLHYFAGKQIRNVACLGGNIMTGSPISDMNPVLTAAGARLEVASIVEGKISQRTVHMGTGFFTGYRRNVIEPQEVLLGIHFQKTTPDQHVVAFKQARRRDDDIAIVNAAVNVRFEPKSNVVAEISMAFGGMAPTTVLAPRTSQLMVKQPLDHQLLERVAESLCGELPLAASAPGGMIAYRRALVVSLIFKAYLAISSKLSEAGIIAGDAIPPKERSGAELFHTPTLRSAQLFERVCSDQPVCDPIGRPEVHAAALKQATGEAIYTDDIPRMDGELYLGFVLSTKPRAKITKLDASAALALEGVHAFFSHKDLTVHENEVGPVFHDEHVFAAGEVHCYGQIVGAVAADNKALAQRASRLVRVEYEDLSPVIVTIEQAIEHGSYFPDYPRYVTKGNMAEAFAQAEHTYEGSCRMGGQEHFYLETHAAVAVPRDSDELELFCSTQHPSEVQKLVAHVTSLPAHRVVCRAKRLGGGFGGKESRGISVALPVALAAYRLRRPVRCMLDRDEDMLITGTRHPFLFKYKVAFSSDGLITACDIECYNNAGWSMDLSFSVLERAMYHFENCYHIPNVRVGGWVCKTNLPSNTAFRGFGGPQGMFAGEHIIRDVARIVGRDVLDVMRLNFYRTGDTTHYNQQLEHFPIERCLDDCLTQSRYHERRAEIAKFNRENRWRKRGVAVIPTKYGIAFGVMHLNQAGALLNVYGDGSVLLSHGGVEIGQGLNTKMIQCAARALGIPSELIHISETATDKVPNTSPTAASVGSDINGMAVLDACEKLNKRLAPIKEALPQATWQEWINKAYFDRVSLSATGFYAMPGIGYHPETNPNARTYSYYTNGVGISVVEIDCLTGDHQVLSTDIVMDIGSSINPAIDIGQIEGAFMQGYGLFTLEELMYSPQGMLYSRGPGMYKLPGFADIPGEFNVSLLTGAPNPRAVYSSKAVGEPPLFIGASAFFAIKEAIAAARQEHGLTGDFPLEAPSTSARIRMACQDKFTNLLEVPEAGSFTPWNIVP

SEQ ID NO: 7069 - DNA, 4059 bp, Zea mays
  CDS (1)..(4059)
atggggaagcaggcggcggtggtgctggccgtgaacggcaagcggtacgaggccgccggcgtggacccgtcgatgacgctgctagagtacctgcgcaccgagacgcccgtcaggggccccaagctcggctgcggcgaaggtggctgcggtgcatgtgtcgtccttgtctccaagtatgacccggccaccgacgaggtgaccgagttctcagcgagctcctgcctgacgcttctccacagcgtggaccgctgctcggtgaccaccagcgagggcattggcaacaccaaggatggctaccaccctgtgcagcagcgcctctccggcttccacgcctcgcagtgcgggttctgcacgcccggcatgtgcatgtccatcttctccgcccttgtcaaggccgacaacaagtccgatcgcccggaccctcctgctggcttctccaagatcactacctcggaggcagagaaggctgtctcgggcaacctttgtcgttgcaccggatacagacccattgttgacacctgcaaaagctttgcctctgatgttgacctcgaggacctaggcctcaactgtttctggaagaagggcgaagaacctgcagaagtcagcaggctgccggggtacaacagcggtgccgtctgcacctttccagagtttctcaaatccgaaatcaagtctactatgaagcaggtgaacgatgtccccattgcagcctcaggtgatggctggtaccatcctaagagcattgaagagcttcacaggttgtttgattccagctggtttgatgacagttctgtgaagattgttgcttcaaacactgggtctggagtgtacaaggatcaggacctctacgacaagtacattgacatcaaaggaatcccagagctttcagtcatcaataaaaacgacaaagcaattgagcttggatcagttgtgtccatctctaaagctattgaagtgctgtcagatggaaatttggtcttcagaaagattgctgatcacctcaacaaagtggcttcaccgtttgttcggaacactgcaaccataggaggaaacataatgatggcacaaaggttgccatttgaatcggatgttgcaaccgtgctcctagctgcgggttcgacagtcacagtccaggtggcttccaaaaggctgtgcttcactctggaggaattcttggaacaacctccatgtgattctaggaccctgctgctgagcatatttatcccagaatggggttcagactatgtcacctttgagactttccgagccgccccacgaccatttggaaatgctgtctcttatgtaaactctgctttcttggcaaggacatcaggcagccttctaattgaggatatatgcttggcatttggtgcctacggagtcgatcatgccatcagagctaagaaggttgaagatttcttgaagggaaaatcgctgagctcatttgtgatacttgaagcaattaaactactcaaagataccgtttcaccatcagaaggcactacacatcatgaatacagggtcagcttggctgtcagtttcttgttcagtttcttatcttcccttgccaacagttcgagtgcaccatcaaatattgatactcccaatgggtcatatactcatgaaactggtagcaatgtggactcacctgagaggcatattaaggttgacagcaatgatttgccaattcgttcaagacaagaaatggttttcagcgatgagtacaagcctgttggcaagccgatcaagaaagtcggggcagagatccaagcatcaggggaggctgtgtacgttgatgatatccctgctcccaaggattgcctctatggagcatttatctacagcacccatcctcatgctcatgtgaggggtatcaactttaaatcatctttggcttcgcagaaggtcatcacagttatcaccgcaaaggatattcccagtggtggagaaaatattggttgcagcttcctgatgctgggagaagcactatttgcagatccaatcgctgaatttgctggtcaaaatattggtgtcgtgattgctgaaacacaaagatatgctaatatggctgcaaagcaagctgttgttgagtatagcacagaaaatctgcagccaccaattctgacaatagaagatgccatccaaagaaacagctacatccaaattcccccatttttagctccaaagccagttggtgactacaacaaagggatggctgaagcagaccacaagattctatcagcagaggtaaaacttgaatcccagtactacttctacatggagactcaagtggcgctagctattcctgatgaagataactgtataaccatctattcttcgacacaaattcctgaggtcacacaaaatttggttgcaaggtgtcttggcattccatttcacaatgtccgtgtcatcagcagaagagtcggaggaggctttggtggaaaggcaatgaaagcaatgcatgttgcatgtgcatgtgcggttgctgccttcaagctgcggcgtccagttcggatgtacctggatcgcaagacggacatgataatggctggcggtcggcatcctatgaaggtgaagtactctgttgggttcaagtcagatggcaagatcacagccttgcaccttgatcttgggatcaatgctggaatatcaccggatgtgagtccattgttgccacgtgctatcataggtgctctcaaaaagtacaactggggcactcttgcatttgataccaaggtctgcaagacaaatgtctcatcaaagtcagcaatgcggggtcctggagatgttcagggctctttcatcgctgaagccatcattgagcatgttgcctcagcactttcactagacactaacaccgtcaggaggaagaaccttcatgattttgaaagccttgaagttttctatggagaaagtgcaggtgaagcttctacatacagcctggtttccatgtttgacaagctggccttgtctccagaataccagcacagggctgcaatgattgagcagttcaatagcagcaacaaatggaagaaacgcggcatttcttgtgtgccagccacttatgaggttaatcttcgaccaactccaggcaaggtgtcaatcatgaatgatggttccatcgctgtcgaggttggaggaattgagataggtcaaggattgtggactaaagtgaagcagatgacggcctttggactgggacagctgtgtcctgatggtggcgaatgccttctggacaaggttcgggttatccaggcagacacattaagcctgatccaaggaggtatgactgctgggagcaccacttctgaaactagctgtgaagcagttcggcaatcgtgtgttgcacttgttgagaggctgaagcctatcaaggagagtctcgaagctaagtccaacacagtggaatggagtgccttgattgctcaggcaagcatggcgagtgtgaacctatcagcacaggcgtactggactcctgatccatctttcaagagctacttgaactacggagctggcaccagtgaggtggaagttgatatcctaacaggagcaaccacaattctgcgaagcgacctggtgtatgactgcgggcagagcctaaaccctgctgtagacttgggccagatcgagggctgctttgtccaaggaatagggttcttcacgaacgaggactacaagacgaattccgacggcttggtcatccacgacggcacatggacgtacaagatccccacggtggataatatcccgaaggagttcaatgttgagatgtttaacagcgcccctgacaagaagcgtgtcctatcttccaaagcgtcgggcgagccgccgctggttctcgcagcctcggtgcactgcgcgatgagggaggccatcagggcggcgaggaaggagttctcggtcagcaccagccccgcgaaatccgccgtcacattccagatggacgtgccggcgacgatgcccgtcgtcaaggagctctgcggcctcgacgtcgtggagaggtacctcgagaacgtgtctgccgccagtgccggcccaaacacagcgaaagcatag

SEQ ID NO: 7070 - protein, 1352 aa, Zea mays
MGKQAAVVLAVNGKRYEAAGVDPSMTLLEYLRTETPVRGPKLGCGEGGCGACVVLVSKYDPATDEVTEFSASSCLTLLHSVDRCSVTTSEGIGNTKDGYHPVQQRLSGFHASQCGFCTPGMCMSIFSALVKADNKSDRPDPPAGFSKITTSEAEKAVSGNLCRCTGYRPIVDTCKSFASDVDLEDLGLNCFWKKGEEPAEVSRLPGYNSGAVCTFPEFLKSEIKSTMKQVNDVPIAASGDGWYHPKSIEELHRLFDSSWFDDSSVKIVASNTGSGVYKDQDLYDKYIDIKGIPELSVINKNDKAIELGSVVSISKAIEVLSDGNLVFRKIADHLNKVASPFVRNTATIGGNIMMAQRLPFESDVATVLLAAGSTVTVQVASKRLCFTLEEFLEQPPCDSRTLLLSIFIPEWGSDYVTFETFRAAPRPFGNAVSYVNSAFLARTSGSLLIEDICLAFGAYGVDHAIRAKKVEDFLKGKSLSSFVILEAIKLLKDTVSPSEGTTHHEYRVSLAVSFLFSFLSSLANSSSAPSNIDTPNGSYTHETGSNVDSPERHIKVDSNDLPIRSRQEMVFSDEYKPVGKPIKKVGAEIQASGEAVYVDDIPAPKDCLYGAFIYSTHPHAHVRGINFKSSLASQKVITVITAKDIPSGGENIGCSFLMLGEALFADPIAEFAGQNIGVVIAETQRYANMAAKQAVVEYSTENLQPPILTIEDAIQRNSYIQIPPFLAPKPVGDYNKGMAEADHKILSAEVKLESQYYFYMETQVALAIPDEDNCITIYSSTQIPEVTQNLVARCLGIPFHNVRVISRRVGGGFGGKAMKAMHVACACAVAAFKLRRPVRMYLDRKTDMIMAGGRHPMKVKYSVGFKSDGKITALHLDLGINAGISPDVSPLLPRAIIGALKKYNWGTLAFDTKVCKTNVSSKSAMRGPGDVQGSFIAEAIIEHVASALSLDTNTVRRKNLHDFESLEVFYGESAGEASTYSLVSMFDKLALSPEYQHRAAMIEQFNSSNKWKKRGISCVPATYEVNLRPTPGKVSIMNDGSIAVEVGGIEIGQGLWTKVKQMTAFGLGQLCPDGGECLLDKVRVIQADTLSLIQGGMTAGSTTSETSCEAVRQSCVALVERLKPIKESLEAKSNTVEWSALIAQASMASVNLSAQAYWTPDPSFKSYLNYGAGTSEVEVDILTGATTILRSDLVYDCGQSLNPAVDLGQIEGCFVQGIGFFTNEDYKTNSDGLVIHDGTWTYKIPTVDNIPKEFNVEMFNSAPDKKRVLSSKASGEPPLVLAASVHCAMREAIRAARKEFSVSTSPAKSAVTFQMDVPATMPVVKELCGLDVVERYLENVSAASAGPNTAKA

SEQ ID NO: 7071 - DNA, 4050 bp, Zea mays
  CDS (1)..(4050)
atggagatggggaaggcggcggcggtggtgctggcggtgaacggcaagcggtacgaggccgccggcgtggacccgtcgacgacgctgctggagttcctgcgcacccacacgcccgtcagggggcccaagctcggctgcggcgaaggtggctgcggtgcatgcgttgtgcttgtctcgaagtacgacccagccaccgacgaggtgaccgagttctcagcgagctcctgcctgacgctgctccatagcgtggaccgctgctcggtgaccaccagcgagggcattggcaacaccaaggatggctaccaccctgtgcagcagcgcctctccggcttccacgcctcccagtgcggtttctgcacgcccggcatgtgcatgtccatcttctctgcgcttgtcaaagccgacaaggcggccaaccggccagccccaccggccggcttctccaagctcacttcctcggaggctgagaaggctgtctctggcaacctgtgccgctgcacagggtacaggcccatcgtcgacgcctgtaagagcttcgcagccgatgttgatcttgaggacctgggcctcaactgcttctggaagaagggtgatgagcctgcagatgtcagcaagctgccaggctacaacagtggtgacgtctgcactttccctgactttctcaaatctgagatgaagtcctcaattcagcaggctaacagcgctccagttcctgtttctgacgacggctggtaccgtcctaggagcattgacgagcttcacaggttgtttcaatctagctccttcgatgaaaattccgtgaagatagtggcttcaaacactgggtctggagtgtacaaggatcaggacctttatgacaagtacattgacatcaaaggaatcccagagctttcagtcatcaacagaaacgacaaaggaattgagcttggatcagttgtgtccatctctaaagctattgaggtgctgtcagatggaaatctcgtcttcagaaagattgctggtcacctgaacaaagtggcttcaccgtttgttcggaacactgcaaccataggtggaaacatagtcatggcacaaagattgccattcgcatcggacattgcaaccatactactagctgcaggttcaacagtcacaatccaggtggcttccaaaaggctgtgcttcactctggaggagttcttgcagcagcctccatgcgattctaggaccctgctgctgagcatatttatcccggaatggggctcaaatgatgtcacctttgagactttccgagcagcacctcgtccacttggcaatgctgtctcatatgtcaattcagctttcttggcaaggacttcattggatgcagcatcaaaggaccatctcatcgaggatatatgtctggcgttcggtgcttatggagctgatcatgctattagagctagaaaggttgaggattacctgaagggcaaaacagtgagctcgtctgtcatacttgaagctgttcggttgcttaaagggtctattaaaccatcagaaggctcaacacatcctgagtatagaattagcttggctgtcagtttcttgtttaccttcctatcctcccttgccaacagcttgaatgaatctgcaaaggttagtggtaccaacgagcactcaccagagaagcaactcaagttggacatcaatgatttgccaatacgatcaagacaagaaatatttttcactgatgcatataagccagttggcaaagcaattaagaaagctggggtagagatccaagcttcaggggaagctgtgtacgttgatgatatccccgctcccaaagattgcctctatggagcatttatctacagcacccaccctcatgcccatgtaaaggctatcaactttaaatcatctttggcttcgcagaaggtcatcacagttatcaccgcaaaggatattcccagtggtggacaaaatattggttccaccttcccgatgatgggagacgaagcactttttgcagatccagttactgaatttgctggtcagaatattggtgttgtgattgctgaaacacagaagtatgcctacatggctgcaaagcaagccattattgagtatagcacagaaaatctgcagccaccaattctgacaatagaagatgcaattgaacgaagcagcttcttccaaacccccccatttgtagctcctaagccagttggtgattacaacaaagggatggctgaagctgatcaaaagattctatcagcagaggtaaaaattgaatcccaatactatttctacatggagacacaagtggcgctagctattcctgatgaagataactgcataaccatctattcttcgacacaaatacccgaggccacacaaaatgtggttgcaaagtgccttggcattccatttcacaatgtccgcctaatcaccagaagagtcggaggaggctttggtggaaaagcaatgaaagcaatacatgttgcatgtgcatgtgcagttgctgcattcaagctacaacgtccagttcggatgtacctcgatcgcaagacagacatgataatggcaggcgggcggcatcctatgaaggtgaagtactctgttgggttcaagtcaaacggcaagatcacagccttacacattgatcttgggatcaatgctggaatatcaccagatatgagcccaatgatgccaccacctatcataggtgctctcaaaaagtacaactggggcaatcttgcatttgacaccaaggtctgcaaaacaaatgtctcatcaaaatcagcaatgagagctcctggagatgcgcagggctctttcatcgctgaagccatcatcgagcatgttgcctcagcactttcagccgacactaacaccataaggagaaagaaccttcatgactttgagagccttgcagtgttcttcgaagatactgcaggtgaagcttctacatacagcctagtcaccatgttcgataaactggcctcctctccagaataccagcaccgagctgaaatggtggaacaattcaacagaagcaacaagtggaagaagcgtggcatttcttgtgtgccaataacatatgaggtcaagcttcggccaactccaggaaaggtgtctatcatgaatgatggttccatcgctgttgaggtcggaggggttgagataggccaagggttgtggacaaaagtgaagcagatgacggcattcggactaggacagctgtgccctgacggcggcgaaagcctcctagacaaggtccgggtcatccaggccgacacattgagcatgatccaaggaggggtcaccggtgggagcaccacttctgaaactagctgcgaagcagttcgaaagtcgtgtgttgcactcgtcgagagactgaagccaatcaaggagaatctggaagctaaaacaggcacagtggaatggagtgccttgattgcacaggcaagtatggcgagcgtgaacttatcggcacatgcatactggaccccagatccaactttcacaagctatttaaactacggagccggcactagcgaggtggaaattgatgtcctgacaggagcaacaacaattctaaggagtgaccttgtctacgattgcgggcaaagcttgaaccctgctgtcgacttgggccaggtggaaggcgcattcatacaaggagtaggcttcttcacaaacgaggagtacacaacaaactctgacgggttggtcatccacgatggcacatggacgtacaagatccccacggtcgacaccatcccaaagcagttgaacgttgagctgatcaacagcgcccgtgaccagaagcgtgtcctctcttccaaagcatccggcgagcctccgcttcttctagctgcctcggtgcactgcgcaatgagggaggccatcagagccgccaggaaggaattctcggtctgcactggtccagcaaactctgccatcacgttcgagatggacgtgccggcgacgatgcccatcgtcaaggagctctgcggcctggatgttgtggagaggtacctggagagcatgtccactgccggaccaacaaccactgccaaagcatag

SEQ ID NO: 7072 - protein, 1349 aa, Zea mays
MEMGKAAAVVLAVNGKRYEAAGVDPSTTLLEFLRTHTPVRGPKLGCGEGGCGACVVLVSKYDPATDEVTEFSASSCLTLLHSVDRCSVTTSEGIGNTKDGYHPVQQRLSGFHASQCGFCTPGMCMSIFSALVKADKAANRPAPPAGFSKLTSSEAEKAVSGNLCRCTGYRPIVDACKSFAADVDLEDLGLNCFWKKGDEPADVSKLPGYNSGDVCTFPDFLKSEMKSSIQQANSAPVPVSDDGWYRPRSIDELHRLFQSSSFDENSVKIVASNTGSGVYKDQDLYDKYIDIKGIPELSVINRNDKGIELGSVVSISKAIEVLSDGNLVFRKIAGHLNKVASPFVRNTATIGGNIVMAQRLPFASDIATILLAAGSTVTIQVASKRLCFTLEEFLQQPPCDSRTLLLSIFIPEWGSNDVTFETFRAAPRPLGNAVSYVNSAFLARTSLDAASKDHLIEDICLAFGAYGADHAIRARKVEDYLKGKTVSSSVILEAVRLLKGSIKPSEGSTHPEYRISLAVSFLFTFLSSLANSLNESAKVSGTNEHSPEKQLKLDINDLPIRSRQEIFFTDAYKPVGKAIKKAGVEIQASGEAVYVDDIPAPKDCLYGAFIYSTHPHAHVKAINFKSSLASQKVITVITAKDIPSGGQNIGSTFPMMGDEALFADPVTEFAGQNIGVVIAETQKYAYMAAKQAIIEYSTENLQPPILTIEDAIERSSFFQTPPFVAPKPVGDYNKGMAEADQKILSAEVKIESQYYFYMETQVALAIPDEDNCITIYSSTQIPEATQNVVAKCLGIPFHNVRLITRRVGGGFGGKAMKAIHVACACAVAAFKLQRPVRMYLDRKTDMIMAGGRHPMKVKYSVGFKSNGKITALHIDLGINAGISPDMSPMMPPPIIGALKKYNWGNLAFDTKVCKTNVSSKSAMRAPGDAQGSFIAEAIIEHVASALSADTNTIRRKNLHDFESLAVFFEDTAGEASTYSLVTMFDKLASSPEYQHRAEMVEQFNRSNKWKKRGISCVPITYEVKLRPTPGKVSIMNDGSIAVEVGGVEIGQGLWTKVKQMTAFGLGQLCPDGGESLLDKVRVIQADTLSMIQGGVTGGSTTSETSCEAVRKSCVALVERLKPIKENLEAKTGTVEWSALIAQASMASVNLSAHAYWTPDPTFTSYLNYGAGTSEVEIDVLTGATTILRSDLVYDCGQSLNPAVDLGQVEGAFIQGVGFFTNEEYTTNSDGLVIHDGTWTYKIPTVDTIPKQLNVELINSARDQKRVLSSKASGEPPLLLAASVHCAMREAIRAARKEFSVCTGPANSAITFEMDVPATMPIVKELCGLDVVERYLESMSTAGPTTTAKA

SEQ ID NO: 7073 - DNA, 26 bp, Artificial sequence
  primer
atgatcatccactttactttaaatgg

SEQ ID NO: 7074 - DNA, 25 bp, Artificial sequence
  primer
ttatattttttccagcgcagtgagt

SEQ ID NO: 7075 - protein, 1609 aa, Artificial sequence
  consensus sequence
  Variant (2)..(4): Xaa in position 2 to 4 is any amino acid
  Variant (7)..(11): Xaa in position 7 to 11 is any amino acid
  Variant (12)..(14): Xaa in position 12 to 14 is any or no amino acid
  Variant (16)..(16): Xaa in position 16 is any amino acid
  Variant (17)..(17): Xaa in position 17 is any or no amino acid
  Variant (19)..(20): Xaa in position 19 to 20 is any amino acid
  Variant (22)..(22): Xaa in position 22 is any amino acid
  Variant (23)..(40): Xaa in position 23 to 40 is any or no amino acid
  Variant (45)..(45): Xaa in position 45 is any amino acid
  Variant (47)..(49): Xaa in position 47 to 49 is any amino acid
  Variant (50)..(78): Xaa in position 50 to 78 is any or no amino acid
  Variant (81)..(88): Xaa in position 81 to 88 is any amino acid
  Variant (89)..(93): Xaa in position 89 to 93 is any or no amino acid
  Variant (95)..(95): Xaa in position 95 is any amino acid
  Variant (98)..(98): Xaa in position 98 is any amino acid
  Variant (100)..(102): Xaa in position 100 to 102 is any amino acid
  Variant (103)..(105): Xaa in position 103 to 105 is any or no amino acid
  Variant (107)..(115): Xaa in position 107 to 115 is any amino acid
  Variant (116)..(118): Xaa in position 116 to 118 is any or no amino acid
  Variant (127)..(130): Xaa in position 127 to 130 is any amino acid
  Variant (131)..(168): Xaa in position 131 to 168 is any or no amino acid
  Variant (170)..(171): Xaa in position 170 to 171 is any amino acid
  Variant (181)..(181): Xaa in position 181 is any amino acid
  Variant (183)..(206): Xaa in position 183 to 206 is any amino acid
  Variant (207)..(703): Xaa in position 207 to 703 is any or no amino acid
  Variant (705)..(709): Xaa in position 705 to 709 is any amino acid
  Variant (711)..(713): Xaa in position 711 to 713 is any amino acid
  Variant (715)..(716): Xaa in position 715 to 716 is any amino acid
  Variant (718)..(723): Xaa in position 718 to 723 is any amino acid
  Variant (724)..(728): Xaa in position 724 to 728 is any or no amino acid
  Variant (730)..(735): Xaa in position 730 to 735 is any amino acid
  Variant (737)..(740): Xaa in position 737 to 740 is any amino acid
  Variant (742)..(751): Xaa in position 742 to 751 is any amino acid
  Variant (752)..(757): Xaa in position 752 to 757 is any or no amino acid
  Variant (759)..(765): Xaa in position 759 to 765 is any amino acid
  Variant (767)..(767): Xaa in position 767 is any amino acid
  Variant (769)..(788): Xaa in position 769 to 788 is any amino acid
  Variant (789)..(800): Xaa in position 789 to 800 is any or no amino acid
  Variant (802)..(808): Xaa in position 802 to 808 is any amino acid
  Variant (810)..(814): Xaa in position 810 to 814 is any amino acid
  Variant (816)..(817): Xaa in position 816 to 817 is any amino acid
  Variant (819)..(825): Xaa in position 819 to 825 is any amino acid
  Variant (827)..(837): Xaa in position 827 to 837 is any amino acid
  Variant (838)..(840): Xaa in position 838 to 840 is any or no amino acid
  Variant (842)..(856): Xaa in position 842 to 856 is any amino acid
  Variant (857)..(900): Xaa in position 857 to 900 is any or no amino acid
  Variant (903)..(946): Xaa in position 903 to 946 is any amino acid
  Variant (947)..(950): Xaa in position 947 to 950 is any or no amino acid
  Variant (952)..(952): Xaa in position 952 is any amino acid
  Variant (954)..(954): Xaa in position 954 is any amino acid
  Variant (956)..(978): Xaa in position 956 to 978 is any amino acid
  Variant (979)..(988): Xaa in position 979 to 988 is any or no amino acid
  Variant (990)..(990): Xaa in position 990 is any amino acid
  Variant (998)..(1008): Xaa in position 998 to 1008 is any amino acid
  Variant (1009)..(1010): Xaa in position 1009 to 1010 is any or no amino acid
  Variant (1012)..(1016): Xaa in position 1012 to 1016 is any amino acid
  Variant (1020)..(1024): Xaa in position 1020 to 1024 is any amino acid
  Variant (1026)..(1033): Xaa in position 1026 to 1033 is any amino acid
  Variant (1034)..(1034): Xaa in position 1034 is any or no amino acid
  Variant (1038)..(1044): Xaa in position 1038 to 1044 is any amino acid
  Variant (1046)..(1049): Xaa in position 1046 to 1049 is any amino acid
  Variant (1051)..(1053): Xaa in position 1051 to 1053 is any amino acid
  Variant (1055)..(1061): Xaa in position 1055 to 1061 is any amino acid
  Variant (1063)..(1063): Xaa in position 1063 is any amino acid
  Variant (1065)..(1083): Xaa in position 1065 to 1083 is any amino acid
  Variant (1084)..(1084): Xaa in position 1084 is any or no amino acid
  Variant (1086)..(1097): Xaa in position 1086 to 1097 is any amino acid
  Variant (1098)..(1098): Xaa in position 1098 is any or no amino acid
  Variant (1101)..(1104): Xaa in position 1101 to 1104 is any amino acid
  Variant (1105)..(1105): Xaa in position 1105 is any or no amino acid
  Variant (1107)..(1107): Xaa in position 1107 is any amino acid
  Variant (1109)..(1110): Xaa in position 1109 to 1110 is any amino acid
  Variant (1112)..(1113): Xaa in position 1112 to 1113 is any amino acid
  Variant (1115)..(1119): Xaa in position 1115 to 1119 is any amino acid
  Variant (1121)..(1126): Xaa in position 1121 to 1126 is any amino acid
  Variant (1128)..(1129): Xaa in position 1128 to 1129 is any amino acid
  Variant (1131)..(1140): Xaa in position 1131 to 1140 is any amino acid
  Variant (1142)..(1188): Xaa in position 1142 to 1188 is any amino acid
  Variant (1189)..(1223): Xaa in position 1189 to 1223 is any or no amino acid
  Variant (1225)..(1255): Xaa in position 1225 to 1255 is any amino acid
  Variant (1256)..(1271): Xaa in position 1256 to 1271 is any or no amino acid
  Variant (1273)..(1274): Xaa in position 1273 to 1274 is any amino acid
  Variant (1276)..(1276): Xaa in position 1276 is any amino acid
  Variant (1280)..(1281): Xaa in position 1280 to 1281 is any amino acid
  Variant (1283)..(1285): Xaa in position 1283 to 1285 is any amino acid
  Variant (1286)..(1288): Xaa in position 1286 to 1288 is any or no amino acid
  Variant (1290)..(1291): Xaa in position 1290 to 1291 is any amino acid
  Variant (1293)..(1294): Xaa in position 1293 to 1294 is any amino acid
  Variant (1296)..(1308): Xaa in position 1296 to 1308 is any amino acid
  Variant (1309)..(1318): Xaa in position 1309 to 1318 is any or no amino acid
  Variant (1320)..(1330): Xaa in position 1320 to 1330 is any amino acid
  Variant (1332)..(1339): Xaa in position 1332 to 1339 is any amino acid
  Variant (1341)..(1402): Xaa in position 1341 to 1402 is any amino acid
  Variant (1403)..(1444): Xaa in position 1403 to 1444 is any or no amino acid
  Variant (1446)..(1450): Xaa in position 1446 to 1450 is any amino acid
  Variant (1453)..(1463): Xaa in position 1453 to 1463 is any amino acid
  Variant (1465)..(1465): Xaa in position 1465 is any amino acid
  Variant (1467)..(1469): Xaa in position 1467 to 1469 is any amino acid
  Variant (1472)..(1475): Xaa in position 1472 to 1475 is any amino acid
  Variant (1478)..(1478): Xaa in position 1478 is any amino acid
  Variant (1481)..(1483): Xaa in position 1481 to 1483 is any amino acid
  Variant (1486)..(1486): Xaa in position 1486 is any amino acid
  Variant (1488)..(1491): Xaa in position 1488 to 1491 is any amino acid
  Variant (1494)..(1497): Xaa in position 1494 to 1497 is any amino acid
  Variant (1498)..(1506): Xaa in position 1498 to 1506 is any or no amino acid
  Variant (1508)..(1509): Xaa in position 1508 to 1509 is any amino acid
  Variant (1510)..(1516): Xaa in position 1510 to 1516 is any or no amino acid
  Variant (1518)..(1519): Xaa in position 1518 to 1519 is any amino acid
  Variant (1521)..(1525): Xaa in position 1521 to 1525 is any amino acid
  Variant (1527)..(1529): Xaa in position 1527 to 1529 is any amino acid
  Variant (1530)..(1557): Xaa in position 1530 to 1557 is any or no amino acid
  Variant (1559)..(1560): Xaa in position 1559 to 1560 is any amino acid
  Variant (1563)..(1572): Xaa in position 1563 to 1572 is any amino acid
  Variant (1573)..(1582): Xaa in position 1573 to 1582 is any or no amino acid
  Variant (1584)..(1587): Xaa in position 1584 to 1587 is any amino acid
  Variant (1588)..(1608): Xaa in position 1588 to 1608 is any or no amino acid
LXXXLRXXXXXXXXKXXCXXGXXXXXXXXXXXXXXXXXXXCGACXVXXXXXXXXXXXXXXXXXXXXXXXXXXXXXXXXCLXXXXXXXXXXXXXTXEGXGXXXXXXHXXXXXXXXXXXXQCGFCTPGXXXXXXXXXXXXXXXXXXXXXXXXXXXXXXXXXXXXXXXXXXGXXNLCRCTGYRXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXGXXXYXXDXXXXXXXXXXXLXXXXXXSXXXXAXXXXXXXXXXXXXXXXVXXXXXXXDXPXXXXXXXXXXXXXXXXXXXXXXXXXXXXXXXXGXXXXXXXAXXXXXAXXAXXXXXXXYXXXXXXXXXXXXXXAXXXXXXXXXXXXXXXXXXXXXXXXXXXXXXXXXXXXXXXXXXXXXXXXXXXXXXXXXXXGDXXXXXXXXXXXXXXXXXXXXXXXXXXXXXXXXXXXXXXXXXXXXXXXXSXQXPXXXXXXXXXXXXXXXXXXXXXXXXXXXXXXXXXRXGGGFGGKXXXXXXXXXXXXXAXXXXXRPVXXXXXRXXXXXXXXXRHPXXXXXXXGXXXXGXXXAXXXXXXXNXGXXXXXXXXXXXXXXXXXXXXYXXXXXXXXXXXXXTNXXXXXAXRXXGXXQXXXXXEXXXXXXAXXLXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXGXXEXGQGXXTXXXXXXQXXAXXLXXXXXXXXXXXXXXXXXXXXXXXTXXXXXXXXXXXSXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXTGXXXXXXXXXXXDXGXXXNPXXXXGQXEGXXXQGXGXXXXEEXXXXXXXXXXXXXGXXXXXXXXXYXXPXXXXXPXXXXXXXXXXXXXXXXXXXXXXXXXXXXXXXKXXGEXXXXXXXXXXXXXXXXXXXXRXXXXXXXXXXXXXXXXXXXXXXXXXP

SEQ ID NO: 7076 - protein, 11 aa, Artificial sequence
  protein pattern
  Variant (2)..(2): Xaa in position 2 is Ala, Gly or Thr
  Variant (3)..(3): Xaa in position 3 is any amino acid
  Variant (4)..(4): Xaa in position 4 is Asp or Glu
  Variant (5)..(5): Xaa in position 5 is Phe, Ile, Leu or Met
  Variant (7)..(7): Xaa in position 7 is Asn, Gln or Thr
  Variant (9)..(10): Xaa in position 9 to 10 is any amino acid
GXXXXGXGXXT

SEQ ID NO: 7077 - protein, 15 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (8)..(8): Xaa in position 8 is any or no amino acid
  Variant (11)..(11): Xaa in position 11 is Ala or Gly
  Variant (14)..(14): Xaa in position 14 is Gly or Ser
VXXXXRXXGGXFGXK

SEQ ID NO: 7078 - DNA, 702 bp, Escherichia coli
  CDS (1)..(702): transl_table=11
atgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgatagcgaaggcaatcatgttcaggccagcgccggagaggcgttgctgctctctacccagccgggtgtcagctatagcgaacacaatctcagcaaagacaaaccgttaacgcgaatgcagctttggctggacgcctgcccgcagcgagagaatccgctgattcaaaagctggcgcttaatatgggcaagcagcaattaatcgcctcgccagagggtgcgatgggaagcctgcaattacgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctaa

SEQ ID NO: 7079 - protein, 233 aa, Escherichia coli
MITTRTARQCGQADYGWLQARYTFSFGHYFDPKLLGYASLRVLNQEVLAPGAAFQPRTYPKVDILNVILDGEAEYRDSEGNHVQASAGEALLLSTQPGVSYSEHNLSKDKPLTRMQLWLDACPQRENPLIQKLALNMGKQQLIASPEGAMGSLQLRQQVWLHHIVLDKGESANFQLHGPRAYLQSIHGKFHALTHHEEKAALTCGDGAFIRDEANITLVADSPLRALLIDLPV

SEQ ID NO: 7080 - DNA, 705 bp, Yersinia pestis CO92
  CDS (1)..(705): transl_table=11
atgatcacatgcagaacagcagaacagtgcgggcaggctgactttggttggcttcaggcgcgttataccttctctttcggccactatttcgatcctacattattaggctatgcctcgttgcgggtcctaaaccaagaagtattagcacccggtgccgcattccaaccacggacttatccgcaagttgatattctcaacctgattttacaaggcgaagcagagtaccgggacagtctggggaatcatgtgcacgccaagacaggcgatgctctgttattttcgcctcagcaaggggtcagttacagtgagcacaatctgagtgccaataaatcattaacccgtattcagctatggcttaatgcctgccctgaacgggaaagtgctccaacgcagcaccagagattaagcactcgccctgtgcagttgctcgcctcaccagccggtgagcaaggtagcctacagctacgccagcaaatgtggatacatcacctggcattagcggctggagaacagcaaaagatgccactacacggccacagagcatacttacagtcgattcatgggacagtcgacgccactggcccgcaaacggggacatcacagcgcctaacttgtggtgatggggcctttgtggaagaagaacaacacctagtaattaaagcgataaccccactgcgcgccctcttgattgatttaccggtttag

SEQ ID NO: 7081 - protein, 234 aa, Yersinia pestis CO92
MITCRTAEQCGQADFGWLQARYTFSFGHYFDPTLLGYASLRVLNQEVLAPGAAFQPRTYPQVDILNLILQGEAEYRDSLGNHVHAKTGDALLFSPQQGVSYSEHNLSANKSLTRIQLWLNACPERESAPTQHQRLSTRPVQLLASPAGEQGSLQLRQQMWIHHLALAAGEQQKMPLHGHRAYLQSIHGTVDATGPQTGTSQRLTCGDGAFVEEEQHLVIKAITPLRALLIDLPV

SEQ ID NO: 7082 - DNA, 696 bp, Yersinia pestis CO92
  CDS (1)..(696): transl_table=11
atgatttttttacgtaaagcagacgatcgcggccatgctaatcacggttggctggatagctggcataccttctcattcgcagactattacgaccctgattttatgggtttttcagctttgcgagtcattaatgaagatgttatcgatgctggtcagggttttggtactcacccgcataaagatatggaaatcctgacgtatgtcttgtcaggcacggttgaacatcaggacagcatgggcaacaaagaacagatccatgcaggtgagttccagattatgagcgccggtacgggcattcgccattcagaatacaatggccgtgatgatcaaccgctgcatctgtaccaaatttggattattccaaacaagctaggtttggaaccccgttacgagcaacggatgtttgatctcccccaagggcggcagttggttttatcaccagatgcccgtgatggttcattgaaggtgttccaggatatgactctctggcgctgggcattgaatcgtacagcgcagtcaacgtatcagattcaggctgaacgccgtgtttggatccaagtggtgcgcggcaaggtttccatcaacggtcatcatggtggtgccagtgatgcattcgccatctgggatgaaacagcgctttctattcaagccgatgaagacagcgagatcctgttgtttgatttaccaccaatttaa

SEQ ID NO: 7083 - protein, 231 aa, Yersinia pestis CO92
MIFLRKADDRGHANHGWLDSWHTFSFADYYDPDFMGFSALRVINEDVIDAGQGFGTHPHKDMEILTYVLSGTVEHQDSMGNKEQIHAGEFQIMSAGTGIRHSEYNGRDDQPLHLYQIWIIPNKLGLEPRYEQRMFDLPQGRQLVLSPDARDGSLKVFQDMTLWRWALNRTAQSTYQIQAERRVWIQVVRGKVSINGHHGGASDAFAIWDETALSIQADEDSEILLFDLPPI

SEQ ID NO: 7084 - DNA, 696 bp, Salmonella enterica subsp. enterica serovar Typhi str. CT18
  CDS (1)..(696): transl_table=11
atgatctacttacgcaaagcaaacgaccgcggtcatgcgaatcatggctggcttgactcctggcataccttttcttttgccgattattacgatccgaactttatggggttctcggcgctacgtgtgattaacgacgatgtgatcgacgcaggccagggtttcggcacgcatccgcataaagacatggaaattttgacctatgtgctggaaggtgctgtagaacaccaggacagtatgggcaataaagaacaggttccggcaggtgaattccagattatgagcgccgggaccggcgttcgccactccgagtacaacccgagcaaaacggatcgtctgcggctgtaccagatctggatcattccgcaagaaacaggcatcacgccgcgctacgaacagcgccgcttcgacgccgcgcagggcaagcaactggtgctttcgccagatgctcgcgatggttcgctgaaggtccaccaggatatggagctgtaccgctgggcgctgctcaaagatgagcaatcggtgcatcagattgccgccgagcgccgcgtctggatacaggtggtaaaaggtaacgtgaccattaacggtaccaaagcgacgaccagcgacggcctggcgatttgggatgagcaggcaatctcgattcatgccgacagcgacagtgaagtgttactgtttgacctgccgccagtctaa

SEQ ID NO: 7085 - protein, 231 aa, Salmonella enterica subsp. enterica serovar Typhi str. CT18
MIYLRKANDRGHANHGWLDSWHTFSFADYYDPNFMGFSALRVINDDVIDAGQGFGTHPHKDMEILTYVLEGAVEHQDSMGNKEQVPAGEFQIMSAGTGVRHSEYNPSKTDRLRLYQIWIIPQETGITPRYEQRRFDAAQGKQLVLSPDARDGSLKVHQDMELYRWALLKDEQSVHQIAAERRVWIQVVKGNVTINGTKATTSDGLAIWDEQAISIHADSDSEVLLFDLPPV

SEQ ID NO: 7086 - DNA, 702 bp, Salmonella typhimurium LT2
  CDS (1)..(702): transl_table=11
atgattacgacccgaaccgccaaacaatgtggacaggcagactacggatggctacaggcccgctataccttctcctttggacactatttcgaccctacactgctaggctacgcgtcgttgcgcgtactgaaccaggaagtgctggcgccgggcgcctcttttcagcctcgaacttacccaaaggtggatattttaaacctgattctggacggcgaagcggaataccgcgacagcgacggcaaccatgtacaggctaaagcgggcgaagcgttactgctcgccgcgcagccgggcattagctacagcgaacataatatcagcaaagttaagccgttaacccgaatgcaactgtggcttgacgcctgtcctgaacgggaaaacacgctggtacaaaaaatcccactcctggcggcgcaacaacagcttcttgcctcgcccgacggtgagcaaaacagcttacaactgcgccaacaggtctgggtacatcatattacgctggagaaaggcgaatcgcttaatttccagcttcacgggccgcgcgcctatttgcagtcgattcacggtacgttccacgcgatgacgcacaacgaagaacgcgaggcgttaacctgcggagatggcgcatttattcgtgatgaacctaacattacgctggttgccgatacgccgctgcgcgcattactggtagatttaccggtgtag

SEQ ID NO: 7087 - protein, 233 aa, Salmonella typhimurium LT2
MITTRTAKQCGQADYGWLQARYTFSFGHYFDPTLLGYASLRVLNQEVLAPGASFQPRTYPKVDILNLILDGEAEYRDSDGNHVQAKAGEALLLAAQPGISYSEHNISKVKPLTRMQLWLDACPERENTLVQKIPLLAAQQQLLASPDGEQNSLQLRQQVWVHHITLEKGESLNFQLHGPRAYLQSIHGTFHAMTHNEEREALTCGDGAFIRDEPNITLVADTPLRALLVDLPV

SEQ ID NO: 7088 - DNA, 717 bp, Nostoc sp. PCC 7120
  CDS (1)..(717): transl_table=11
atgtctaaaaatacaatcaaccatctaattcatgatagaaatgcacgcggtcgtagtcaaacaggttggcttgatagttatcatacattttccttcagcagtttttatgatcccaaccggatgggattccgttccttacgagtaattaacgatgaccgcattgcacctggtgcaggatttcccactcatggacatcgtgatatggaaattctcacttatgtactctctggtgcagtagaacataaagacagtttgggtactggttcagttattcgtcctggtgatgtgcagattatgagtgctggtaaggggattcaacatagtgaatttaatcactcacgtaccgaaccattacatttactgcaaatctggattttacctgacgaaaaaggattagcacccagatacgaacagaaagcttttaccccagaagaaaaacgcggtcaactgcgtcttgtagctgctaaagatggacgtgatggtgctgtcactattcaccaaaatgttgatatctacgcctctattttagaaccaggtgatgtagtcaattatcacgtaaaaggcgatcgctatgcttggttgcaaattgctcaaggtgtcgtaaccttaaatggtacagaactcagagcaggtgatggcgtacaaatcaacggagaagagcaactgaaaatcagcactagcatcggtacagaattattgctgttcgatttagattga

SEQ ID NO: 7089 - protein, 238 aa, Nostoc sp. PCC 7120
MSKNTINHLIHDRNARGRSQTGWLDSYHTFSFSSFYDPNRMGFRSLRVINDDRIAPGAGFPTHGHRDMEILTYVLSGAVEHKDSLGTGSVIRPGDVQIMSAGKGIQHSEFNHSRTEPLHLLQIWILPDEKGLAPRYEQKAFTPEEKRGQLRLVAAKDGRDGAVTIHQNVDIYASILEPGDVVNYHVKGDRYAWLQIAQGVVTLNGTELRAGDGVQINGEEQLKISTSIGTELLLFDLD

SEQ ID NO: 7090 - DNA, 699 bp, Ralstonia solanacearum GMI1000
  CDS (1)..(699): transl_table=11
atgattgaaatccgaccctcccaggagcgcggttacgccgaccacggctggctccagtcgtaccacagcttctcgttcgccgagtacatggatccggaccacgtccacttcgggccgctgcgcgtcatcaacgaagaccgcgtcgcgcccggcatgggcttcggtacgcacggccatcgcgacatggagatcatcagctacgtgctcgacggtgaactggcgcacaaggacagcctcggcaacggcagcgtgctgcgcccgggcgacgtgcagcgcatgacggctgggaccggcgtgcgtcattccgagttcaaccatgcgccggaccagaccacgcacttcctgcagatctgggtgctgcctgcgcagcaggatctcgcgccgggctacgaggagcgccatttcgaggcgtcgcagaagcgtggcaggctgcgcctgatcgccagcgccgacggacgcgacgactcggtcagggtgcaccaggacatggccctgtacgccggccgtttcgatggcgccgaggccgccacgctgcccctcgccgacggtcgccgcgcctatgtgcacgtggtgcgcggcaaggtcgaggtcaacggcacgccgctgtcgggcggcgatgcggctaagctgacgcgggagccgaccgtcacgctgtcggggggcgagggcagcgaggtgctggtgttcgatctaccctga

SEQ ID NO: 7091 - protein, 232 aa, Ralstonia solanacearum GMI1000
MIEIRPSQERGYADHGWLQSYHSFSFAEYMDPDHVHFGPLRVINEDRVAPGMGFGTHGHRDMEIISYVLDGELAHKDSLGNGSVLRPGDVQRMTAGTGVRHSEFNHAPDQTTHFLQIWVLPAQQDLAPGYEERHFEASQKRGRLRLIASADGRDDSVRVHQDMALYAGRFDGAEAATLPLADGRRAYVHVVRGKVEVNGTPLSGGDAAKLTREPTVTLSGGEGSEVLVFDLP

SEQ ID NO: 7092 - DNA, 858 bp, Methanosarcina mazei Go1
  CDS (1)..(858): transl_table=11
atgttactgaatactattgctaaactctgtttccaaaggtatattctgttcatccatcaaaccttacttattattcaaatattcaaatattcgaataattacatgggaagaaagggatcttatatgctcagaattattccggcgggagccaggcattttgaggattcaggctggctaaaaagctacatgcttttttctttttcaaactattatgatcctcacaacgtccagtttggaaacctgcgcgcctttaatgatgataccgtccagccgggaaaggggttttcggctcacaggcactccgagatggaaattatatccgttgttcttgacggggaaataatgcatgaagacagtatggggaacaggggaacccttggaaaagaagaagtacagagcattaccgcaggtacagggatacttcattcagagtttaacagggataaggaaatcctgcacttttatcagatctggattttaccgtccagaagtggcctcgaaccttcttattctcaaaaaaagtttgaatgcatggaatggagaaatcagctgcttccggtcgcttctggacaggattttaaggacgccctgaagataaacgccgatgcaacagtttaccggtgcagcctcgaaaagggacatgttatccatttttacacactggataaccgccgaacattcatttatatgtctgtcggtgagctcaccgttaatggacagagaatagagcagggagatcaggctcgcattgaccttgagcaggtaatccacatggaatctgtttgtgcaggtcagcctgcagaatttatcctgattgatgtttccactcagggagcggaaatccataacaggaactga

SEQ ID NO: 7093 - protein, 285 aa, Methanosarcina mazei Go1
MLLNTIAKLCFQRYILFIHQTLLIIQIFKYSNNYMGRKGSYMLRIIPAGARHFEDSGWLKSYMLFSFSNYYDPHNVQFGNLRAFNDDTVQPGKGFSAHRHSEMEIISVVLDGEIMHEDSMGNRGTLGKEEVQSITAGTGILHSEFNRDKEILHFYQIWILPSRSGLEPSYSQKKFECMEWRNQLLPVASGQDFKDALKINADATVYRCSLEKGHVIHFYTLDNRRTFIYMSVGELTVNGQRIEQGDQARIDLEQVIHMESVCAGQPAEFILIDVSTQGAEIHNRN

SEQ ID NO: 7094 - DNA, 702 bp, Xanthomonas axonopodis pv. citri str. 306
  CDS (1)..(702): transl_table=11
atgttgaatgtccgcaagagcgaaacccgtggccgcgccgaacatggctggctgtcctcacgccacaccttctcctttgccagctatcacgacccgcgccacatgggcgttggcccgctgcgggtgatcaacgaggacaaggtgcagccaggcgaaggcttcggcacccacgcacaccgcgacatggagatcatttcctacgtgctgggcggcgcgctggagcacaaggacagcatgggcaccggctcggtcctgcattacggcgacgtgcagcgcatgagcgccggcagcggcgtgactcacagcgagttcaatcactcggccagcgagcccgtgcacttcctgcagatctgggtaatgcccgagcgtgccggcatcgagccgagctacgaagaaaagcacttcgatgccgacagcaagcgcaatcaactgcgcctgatcgcctcgccaggcggcgacaacggctccctgcgcctgcaccaggacgcacgtctgtatgcctcgatcctggatggccaggcgcgtctgcagcagccgctggccgaaggacgcatcggctacgtgcaggtggcgcgtggcagcctgagcgtcaatgggcaggcgctgtcggctggcgacgcggtgcagatcgtcggcgagccggaaatcgtgctggccgatgcacgcgatgccgaagtattggtgttcgacctgcccaagtaa

SEQ ID NO: 7095 - protein, 233 aa, Xanthomonas axonopodis pv. citri str. 306
MLNVRKSETRGRAEHGWLSSRHTFSFASYHDPRHMGVGPLRVINEDKVQPGEGFGTHAHRDMEIISYVLGGALEHKDSMGTGSVLHYGDVQRMSAGSGVTHSEFNHSASEPVHFLQIWVMPERAGIEPSYEEKHFDADSKRNQLRLIASPGGDNGSLRLHQDARLYASILDGQARLQQPLAEGRIGYVQVARGSLSVNGQALSAGDAVQIVGEPEIVLADARDAEVLVFDLPK

SEQ ID NO: 7096 - DNA, 702 bp, Shigella flexneri 2a str. 301
  CDS (1)..(702): transl_table=11
atgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgacagcgaaggcaatcatgttcaggccagcgccggagaggcgttgctgctctctacccagccgggtgtcagctatagcgaacacaatctcagcaaagacaaaccgttaacgcgaatgcagctttggctggatacctgcccgcagcgagagaatccgctgattcaaaagctggcgcttaatatggacaagcagcaattaatcgcctcgccagagggtgcgatgggaagcctgcaattacgccaacaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctaacctgcggtgatggggcgtttattcgtgacgaggctaacattacgctggttgccgattccccactgcgcgctttgctgatagatttgcctgtctag

SEQ ID NO: 7097 - protein, 233 aa, Shigella flexneri 2a str. 301
MITTRTARQCGQADYGWLQARYTFSFGHYFDPKLLGYASLRVLNQEVLAPGAAFQPRTYPKVDILNVILDGEAEYRDSEGNHVQASAGEALLLSTQPGVSYSEHNLSKDKPLTRMQLWLDTCPQRENPLIQKLALNMDKQQLIASPEGAMGSLQLRQQVWLHHIVLDKGESANFQLHGPRAYLQSIHGKFHALTHHEEKAALTCGDGAFIRDEANITLVADSPLRALLIDLPV

SEQ ID NO: 7098 - DNA, 696 bp, Shigella flexneri 2a str. 301
  CDS (1)..(696): transl_table=11
atgatctacttacgcaaagcaaatgaacgtggtcatgcaaatcatggctggctggactcctggcatactttctcttgtgccaactattacgatccgaactttatgggcttctccgcgctgcgcgtgattaacgacgacgtgattgaagcagggcagggcttcggcactcacccgcataaagatatggaaattttgacctacgtgctggaaggtactgttgagcatcaggacagcatgggcaataaagagcaggttccggcgggtgagttccagattatgagtgcgggtacgggtattcgtcactcagagtacaacccaagcagcaccgagcgtctgcatctgtatcagatctggatcatgcctgaagaaaatggcattacgccgcgttatgaacagcgtcgcttcgatgccgtgcagggcaaacagctggtgctctcgccggatgcgcgagatggttcgctgaaagtgcatcaggatatggaactgtatcgttgggcgttgctgaaagatgagcagtcggtgcatcagattgccgctgaacgccgcgtctggattcaggtggtaaaaggcaatgttaccattaacggcgtgaaagcctcgaccagcgatggtctggcaatctgggatgagcaggcaatctccatccatgcggatagcgacagcgaagtgttactgttcgatctgccgccggtttaa

SEQ ID NO: 7099 - protein, 231 aa, Shigella flexneri 2a str. 301
MIYLRKANERGHANHGWLDSWHTFSCANYYDPNFMGFSALRVINDDVIEAGQGFGTHPHKDMEILTYVLEGTVEHQDSMGNKEQVPAGEFQIMSAGTGIRHSEYNPSSTERLHLYQIWIMPEENGITPRYEQRRFDAVQGKQLVLSPDARDGSLKVHQDMELYRWALLKDEQSVHQIAAERRVWIQVVKGNVTINGVKASTSDGLAIWDEQAISIHADSDSEVLLFDLPPV

SEQ ID NO: 7100 - DNA, 699 bp, Pseudomonas putida KT2440
  CDS (1)..(699): transl_table=11
atgctgcaactgcgacccttcgaaagcctcggccacgccaaccatggctggctcgatgcccaccaccatttctcgtttgccgagtactacgacccggcacgcatgcactggggtaacctgcgggtttggaacgacgacctgatcgcagccggcagcggcttcccgccgcacccgcaccgcgacatggaaatcatcacttatgtgcgtgaaggcgcgatcagccaccaggacagcctgggcaacaagggccgtaccgaagccggtgatgttcaggtcatgagcgccggtaccggcatcgtgcacagcgagtacaacctggaagatatcgatacacgtattttccagatctggatcgtgccggagcgcaccggtgaagcaccgcagtggggtagccggccgttccccaaaggcgagcgcggtgagggcttcgtgaccttggccagcggccgcgcgggtgacgaggacagcctgcagatccgtaccgatgcccgcctggtggctgccaccctgcgagccggtgaaaccgccgagtaccgcttcgatgccgaacgccggggttacctggtgccggccaaggggctggtggagatcaacggattgcgggccaaggcgcgcgatggcgtggcgatcgagcaggaagcggtgctgcgggtgaccgccatcgaggacagcgagatcgtgctcgtggatgtggcctga

SEQ ID NO: 7101 - protein, 232 aa, Pseudomonas putida KT2440
MLQLRPFESLGHANHGWLDAHHHFSFAEYYDPARMHWGNLRVWNDDLIAAGSGFPPHPHRDMEIITYVREGAISHQDSLGNKGRTEAGDVQVMSAGTGIVHSEYNLEDIDTRIFQIWIVPERTGEAPQWGSRPFPKGERGEGFVTLASGRAGDEDSLQIRTDARLVAATLRAGETAEYRFDAERRGYLVPAKGLVEINGLRAKARDGVAIEQEAVLRVTAIEDSEIVLVDVA

SEQ ID NO: 7102 - DNA, 702 bp, Escherichia coli CFT073
  CDS (1)..(702): transl_table=11
atgattactacccgaactgccaggcagtgtggacaagcagactacggatggttgcaggcccggtatactttttcctttggacactacttcgacccgaaattgttaggctatgcctccctgcgcgtgcttaaccaggaagtgctggccccaggtgccgcctttcagccgcgaacctatcccaaagtcgatattttaaatgtgattctggatggagaagctgagtatcgcgacagcgaaggcaatcatgttcaggccagcactggtgaggtgttgctgctctctacccagccgggtgtcagctatagcgaacacaatctcagcaaagacaaaccgttaacgcgaatgcaactttggctggatgcctgcccgcagcgagagaatccgctgattcaaaagctggcgcttaatatgagcaagcagcaattaatcgcctcgccagaaggtgggatgggaagcctgctattgcgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctaacctgcggtgatggggcgtttattcgtgacgaggctaacattacgctggttgccgattccccactgcgcgctttgctgatagatttgcctgtctag

SEQ ID NO: 7103 - protein, 233 aa, Escherichia coli CFT073
MITTRTARQCGQADYGWLQARYTFSFGHYFDPKLLGYASLRVLNQEVLAPGAAFQPRTYPKVDILNVILDGEAEYRDSEGNHVQASTGEVLLLSTQPGVSYSEHNLSKDKPLTRMQLWLDACPQRENPLIQKLALNMSKQQLIASPEGGMGSLLLRQQVWLHHIVLDKGESANFQLHGPRAYLQSIHGKFHALTHHEEKAALTCGDGAFIRDEANITLVADSPLRALLIDLPV

SEQ ID NO: 7104 - DNA, 699 bp, Bradyrhizobium japonicum USDA 110
  CDS (1)..(699): transl_table=11
atgatcgaactcagacctttcgcaaagctcggcggcgccgaccacggctggctcaaggccaagcatcacttctccttcgctagccactacgacccgaacaacatgggtcacggctccttaagggtgtggaacgacgacgagatcgcgccgaacacgggctttcccgcccatccccatgccaacatggaaatcatcacctatgtgcgcgagggcgcgatcacccaccaggacaacctcggcaacgagggacgcaccgaggcgggcgacgtgcaggtgatgagcgccggcagcggcatccgtcactccgagtacaatctcgagccgagcaagacccggatcttccagatctggatcgagcctgtggcgcgcggcggccagccgacctggggctcgaagccgttcccgaaaggggatcgctccggcaagctcgtcaccatcgcgagcggcttcaaggacgacacggaagcactgccgatccgcgccgatgcgcgggtgctcgccaccacgttgaaggccggcgaaagcgcggagtacgagccgcagaagttgcggcatctctacctcgtgcccgcggcaggctcggtcgagatcaacggcgtgcgcgtcaacgcccgcgacggcgccgcgatccgcgacgagagcaggttgaagatcacggcgctcgaagattccgagctcgtgctcgtcgacgcggcctag

SEQ ID NO: 7105 - protein, 232 aa, Bradyrhizobium japonicum USDA 110
MIELRPFAKLGGADHGWLKAKHHFSFASHYDPNNMGHGSLRVWNDDEIAPNTGFPAHPHANMEIITYVREGAITHQDNLGNEGRTEAGDVQVMSAGSGIRHSEYNLEPSKTRIFQIWIEPVARGGQPTWGSKPFPKGDRSGKLVTIASGFKDDTEALPIRADARVLATTLKAGESAEYEPQKLRHLYLVPAAGSVEINGVRVNARDGAAIRDESRLKITALEDSELVLVDAA

SEQ ID NO: 7106 - DNA, 723 bp, Pseudomonas syringae pv. tomato str. DC3000
  CDS (1)..(723): transl_table=11
atgctgactcttcgcaaagcttccgatcgtggcgcagctgatcatggctggttgaaatcctttcataccttttcctttgccagctaccgcaacgcgcaggaacagggcttttccgatctgctggtcattaatgacgaccgcgtaaccgccggtaagggtttcggccagcatccgcaccgcgacatggaaatcttttcctacgtgctggagggtgcgctggagcacaaagacacgctgggtaccggctcggtgattcgcccaggcgacgtgcaattgatgagtgccggcagcggcgtggcgcacagtgagttcaatcactcgcagaccgaaggtgtgcatttcctgcaaatctggatcgtacccaacgttgcaggcgccacgccgaattaccagcaggagcatttcagcgctgagcagaaacgcggtcgcctgcaactgattatctcgcctgaaggcgaggacggttcgctgaaggttcgtcaggacgcccgcgtgtacgccggcctgttcgagggtgatgaaaccgcaacgctggaactggcagccaaccgctacgcctacgtgcatgtcgcccgtggcagcgtggtactcaatggcgagcaactgggcgaaggggacggcgtgcgcgtgcgcagcgaacagttgatcagcctgaaagacggggtggacgcagaagtgctggtgtttgacatgcgccctaatgaaacgccgcagatgccttga

SEQ ID NO: 7107 - protein, 240 aa, Pseudomonas syringae pv. tomato str. DC3000
MLTLRKASDRGAADHGWLKSFHTFSFASYRNAQEQGFSDLLVINDDRVTAGKGFGQHPHRDMEIFSYVLEGALEHKDTLGTGSVIRPGDVQLMSAGSGVAHSEFNHSQTEGVHFLQIWIVPNVAGATPNYQQEHFSAEQKRGRLQLIISPEGEDGSLKVRQDARVYAGLFEGDETATLELAANRYAYVHVARGSVVLNGEQLGEGDGVRVRSEQLISLKDGVDAEVLVFDMRPNETPQMP

SEQ ID NO: 7108 - DNA, 696 bp, Vibrio parahaemolyticus RIMD 2210633
  CDS (1)..(696): transl_table=11
atgatcaccgtaagacacgcagaagaccgaggtcgagcaaactttggctggctagacagcaaacacacgttttcttttggtagctattacgaccccaaacacatgggcttttctgaactgcgagtcatcaacgatgacctagttcaacccaacgcaggctttgatactcatggtcaccgcgacatggagatcatcagttatgtgctagaaggtgttattgcgcacaaagacagtgaaggcaatgtacaaacgttacctgcgggggagtttcagctgatgtcggcaggtaaaggcatttaccacagcgaatataacgcatcagaaacagaccctttacgctttttgcaaatttggattcaacctaacacctttgggaataaaccgggctaccagcaaaaagattttggacgtaatgcagggttaaccaccattgcaaccccaacgggagagagtggcacactgcacatcaaacaagatgcgtatttgtatcaattgattttggagccgaatcgcgaactcgccttcgacatccactctggaagaaatgtttacgttcatcaagtatcgggagagctgcatgtcgacaacaccctgctaacgggcggtgatggcgctaaaatcgaagcacagagcaaggtgacatttcgtaacctgaccaatcaatcagttactgcgctaatctttgacttgccgtaa

SEQ ID NO: 7109 - protein, 231 aa, Vibrio parahaemolyticus RIMD 2210633
MITVRHAEDRGRANFGWLDSKHTFSFGSYYDPKHMGFSELRVINDDLVQPNAGFDTHGHRDMEIISYVLEGVIAHKDSEGNVQTLPAGEFQLMSAGKGIYHSEYNASETDPLRFLQIWIQPNTFGNKPGYQQKDFGRNAGLTTIATPTGESGTLHIKQDAYLYQLILEPNRELAFDIHSGRNVYVHQVSGELHVDNTLLTGGDGAKIEAQSKVTFRNLTNQSVTALIFDLP

SEQ ID NO: 7110 - DNA, 705 bp, Bacteroides thetaiotaomicron VPI-5482
  CDS (1)..(705): transl_table=11
atgaaaaaagtaatcgacagagcttcatcaagaggctattttaatcatggctggctcaaaacccaccacacattcagttttgctaactattacaatccggaaagaatccatttcggagccttgcgagtgctgaatgatgacagtgtagacccgtcgatgggatttgatactcatccacataaaaatatggaagtaatttccattccgttgaaagggtatctgagacatggcgacagtgtacaaaatacgaaaacgattactcccggtgatatccaagtgatgagtacgggcagtggtatctatcatagtgagtataacgacagcaaggaagaacaattggaattcctgcaaatatgggtattcccccgaatcgagaatacgaaacccgaatataacaatttcgatatacgtccgctgctgaaaccgaacgagttatctctgttcatttcaccgaacggcaagacaccggcctccatcaaacaggatgcctggttctctatgggagacttcgatacggaaagaaccatcgaatattgtatgcatcaggaaggtaacggagcttatctgtttgtgatagaaggagagatcagcgtggccgatgaacatctggccaaacgtgacggcatcggaatatgggataccaaaagcttctctatccgtgctactaaagggaccaaacttctggtaatggaagtacccatgtaa

SEQ ID NO: 7111 - protein, 234 aa, Bacteroides thetaiotaomicron VPI-5482
MKKVIDRASSRGYFNHGWLKTHHTFSFANYYNPERIHFGALRVLNDDSVDPSMGFDTHPHKNMEVISIPLKGYLRHGDSVQNTKTITPGDIQVMSTGSGIYHSEYNDSKEEQLEFLQIWVFPRIENTKPEYNNFDIRPLLKPNELSLFISPNGKTPASIKQDAWFSMGDFDTERTIEYCMHQEGNGAYLFVIEGEISVADEHLAKRDGIGIWDTKSFSIRATKGTKLLVMEVPM

SEQ ID NO: 7112 - DNA, 705 bp, Bacteroides thetaiotaomicron VPI-5482
  CDS (1)..(705): transl_table=11
atgaagaaagtaatacataaagcagatacaagaggacattcccaatatgactggctggatagttaccataccttcagtttcgacgaatacttcgattctgaccgtataaacttcggtgccctccgcgtattgaatgacgacaaagtcgcccccggagaagggttccaaacccatccgcataaaaatatggagattatctccattccattgaaaggacatctgcaacatggtgacagcaagaaaaacagccgtatcatcactgtcggagagattcagacgatgagtgccggaacgggtattttccacagtgaagtgaatgccagccctgtagagccggtagaattcctgcaaatatggattatgccgagagagcggaatacacatcctgtctacaaggatttcagcatcaaagagctggaacgaccgaacgaactggcagtgattgtatcgcccgacggcagtactcccgcttcacttctacaagacacctggttttctatcggaaaggtggaagccggaaagaaactcggttatcacttgcaccaaagtcatggcggcgtatacattttcctgatcgaaggagaaatcgtagtagacggagaagtactgaaacgtcgcgacggaatgggcgtctatgatacgaaaagtttcgaactcgaaacattgaaggactcacatatcttattgatagaagtaccgatgtag

SEQ ID NO: 7113 - protein, 234 aa, Bacteroides thetaiotaomicron VPI-5482
MKKVIHKADTRGHSQYDWLDSYHTFSFDEYFDSDRINFGALRVLNDDKVAPGEGFQTHPHKNMEIISIPLKGHLQHGDSKKNSRIITVGEIQTMSAGTGIFHSEVNASPVEPVEFLQIWIMPRERNTHPVYKDFSIKELERPNELAVIVSPDGSTPASLLQDTWFSIGKVEAGKKLGYHLHQSHGGVYIFLIEGEIVVDGEVLKRRDGMGVYDTKSFELETLKDSHILLIEVPM

SEQ ID NO: 7114 - DNA, 699 bp, Bordetella parapertussis 12822
  CDS (1)..(699): transl_table=11
atgcttaccctgcgtcgcagcgccgaacgcggccatgccaaccacggctggctcgatacgcaccatacgttttccttcgccaattactatgatccggcccatatgggcttcgggccgctgcgtgtgatcaacgatgaccgcatcgccgccggccggggcttcggtacgcacggccaccgggacatggaaatcatcacctatgtgctggacggcgcgatcgcgcacaaggacagcatgggcagcggctcgaccatccgccccggcgatgtgcagcgcatgagcgccggccgcggcgtgatgcattcggagttcaacccgcagccggatgccgcgacccatatgctgcagatctggatcgagcccgatgtggcgggcattgcgcccgagtacgaagagaagcgttttcccgaggctgacaagcgcggccggctgcgccagctggtttcccccgacggcgccgacggatcgctgcgcatccaccaggatgcgcgcctgtacgcgggcctgttcgacggcacggaaagcgccgagctgccgttggcggccggacgccgctcgtgggtgcacgtggcgcgcggcagcctggtcgtcaatggccagaggctgggcgcgggcgatggcctggcgctgcaggacgaggccgcggtgcggctgggcgacggcgaaggcgccgaagtcctggtattcgatttgccgtaa

SEQ ID NO: 7115 - protein, 232 aa, Bordetella parapertussis 12822
MLTLRRSAERGHANHGWLDTHHTFSFANYYDPAHMGFGPLRVINDDRIAAGRGFGTHGHRDMEIITYVLDGAIAHKDSMGSGSTIRPGDVQRMSAGRGVMHSEFNPQPDAATHMLQIWIEPDVAGIAPEYEEKRFPEADKRGRLRQLVSPDGADGSLRIHQDARLYAGLFDGTESAELPLAAGRRSWVHVARGSLVVNGQRLGAGDGLALQDEAAVRLGDGEGAEVLVFDLP

SEQ ID NO: 7116 - DNA, 702 bp, Chromobacterium violaceum ATCC 12472
  CDS (1)..(702): transl_table=11
atgatcgaacgccgccccttcgccagcttgggcgcagcccaacacggatggctggacgccaagcaccatttctccttcgccgactaccgcgatccggcgcgcatgcactggggcgcgctgcgggtgtggaacgacgacaccatcgccgccggcagcggcttcgcaccgcatccgcacgccgacatggagatcatcacctatgtccgcgagggcgcgatcagccaccaggacaacctgggcaaccgcggccgcaccgaggccggcgacgtgcaggtgatgagcgccggcagcggcatcgtccattccgaatacaacctggagcctgtcgccacccgcatcttccagatctggatctatccggacagccgcggcggcgagccgtcttggggcagcaagccttttcccaaggccgaccgctccggcgccttcgtcgcgctggccagcggcatggatggtgacgacggcgcgctgccgatacgcgccgacgcccgggtgctgggcgccacgctgaaggcaggcgaaagcgccgactaccggctgggcgccggccgccgcggctatctggtgctgtcggccggatcggcccgggtgaacggcgtggcgctggagaccggcgacggcgcggccatccgccatgaagacctggtccgcgtcgaggccggcgaggatgccgaactgatcctggtggacacccgggaatga

SEQ ID NO: 7117 - protein, 233 aa, Chromobacterium violaceum ATCC 12472
MIERRPFASLGAAQHGWLDAKHHFSFADYRDPARMHWGALRVWNDDTIAAGSGFAPHPHADMEIITYVREGAISHQDNLGNRGRTEAGDVQVMSAGSGIVHSEYNLEPVATRIFQIWIYPDSRGGEPSWGSKPFPKADRSGAFVALASGMDGDDGALPIRADARVLGATLKAGESADYRLGAGRRGYLVLSAGSARVNGVALETGDGAAIRHEDLVRVEAGEDAELILVDTRE

SEQ ID NO: 7118 - DNA, 699 bp, Gloeobacter violaceus PCC 7421
  CDS (1)..(699): transl_table=11
atgatcacattgcgagcgagcgagaagcgcggccgtgccgagcacggctggttggacagccgccacactttttcttttgccgactactacgacccccagcacatgggttttcggtccctgcgggtgatcaacgaggaccgggtggcccccggacaaggctttggcacccattcccaccgcgacatggagattatcacctacgtgctcgaaggcgccctggagcacaaagacagcctgggcaacggctcggtgatgcgtcccggcgacgtgcagcgcatgagtgccggtaccggagtggcccacagcgagttcaaccacagcaagggtgagccggtccattttctgcagatctggatcctgccgtccgagcggggagtgatccccggctacgagcaaagccacttcgacgcggccagtaagcaaggccggttggtgccggtggtggcgggcgacggccgcgaaggggcgctggcagtccaccaggacatggtgctctatgccggtttgttgggcgcgggtgagcgggcggagcacacccttgccccgggccgccaggcctgggtgcaggtggcacgcggtgcaatcaccctgaacggcaaaaccctgacagcgggcgacggcgcggcggtaaccgacgagtcgcttgtcgaactggtaggggtcgaaccgtccgaagttctgctgttcgatctggcgtaa

SEQ ID NO: 7119 - protein, 232 aa, Gloeobacter violaceus PCC 7421
MITLRASEKRGRAEHGWLDSRHTFSFADYYDPQHMGFRSLRVINEDRVAPGQGFGTHSHRDMEIITYVLEGALEHKDSLGNGSVMRPGDVQRMSAGTGVAHSEFNHSKGEPVHFLQIWILPSERGVIPGYEQSHFDAASKQGRLVPVVAGDGREGALAVHQDMVLYAGLLGAGERAEHTLAPGRQAWVQVARGAITLNGKTLTAGDGAAVTDESLVELVGVEPSEVLLFDLA

SEQ ID NO: 7120 - DNA, 696 bp, Photorhabdus luminescens subsp. laumondii TTO1
  CDS (1)..(696): transl_table=11
atgatccatttacgcaaagcatcagatcgcggccatgccgatcatggctggttaactagctggcataccttctcatttgccagctattacgatactaattttatgaatttctcagcattgagagtcattaatgaagatttcatcgaagcaggtcaaggttttggtacccatccgcataaagatatggaaatactgacctatgttctttccggtaccgttgaacaccaggatagtataggaaataaagagcgggtacctgctggtgaattccaaattatgagcgcaggtactggcattcgccattcagaatacaatccgaacagtgattgccaattacatctatatcaaatttggatcatcccaagtaaaacgggtttaacaccgcgctatgaacaacgtcgctttgatgatgtacaaagccgccaactggtgctctcgcctgatgcacgggatggttcactgaaagtatttcaggatatgactttatggcgttggatacttaaggatcacgaaaccgccgaatatgtcgcagaaaaaggccgttatatttggatacaagtcattcgtggcgaagtgacggttaatggtgtcaaagccaccaccagcgatggtctggctatccgagatgaaatcaatcttcaacttagcagcagcaacgatagtgaaatattgttgtttgaccttcctccgacataa

SEQ ID NO: 7121 - protein, 231 aa, Photorhabdus luminescens subsp. laumondii TTO1
MIHLRKASDRGHADHGWLTSWHTFSFASYYDTNFMNFSALRVINEDFIEAGQGFGTHPHKDMEILTYVLSGTVEHQDSIGNKERVPAGEFQIMSAGTGIRHSEYNPNSDCQLHLYQIWIIPSKTGLTPRYEQRRFDDVQSRQLVLSPDARDGSLKVFQDMTLWRWILKDHETAEYVAEKGRYIWIQVIRGEVTVNGVKATTSDGLAIRDEINLQLSSSNDSEILLFDLPPT

SEQ ID NO: 7122 - DNA, 702 bp, Photorhabdus luminescens subsp. laumondii TTO1
  CDS (1)..(702): transl_table=11
atgattataaatagaacagcaaaacaatgtgggaaagctgactatggttggctacaagctcgttatacattttcatttggtcactattttgacccaaagtttttaggttatggcgcgctacgtgtactcaatcaagaagtcattgcccccaaagccgctttccaacctaaatcctatccacatgtggatatattgaatattattctacaaggtgaagcagaataccgtgacagcgaaggcaactatatcagagcccgtaaaggagaatgtttactattttctacccgtcaaggcatcagctacagtgaacataatgccagtattaataagccactaacgcgcttgcagctttggctgaatgcctttcctcagcaggaaagcttaccattgcaacgaatggaattaccagaacaaccactggctatgctagcttctccaaccgcagaagatggcagtatgcaattacgtcaacaagtgtgggtaaatcatatttcccttaataaaaatcaatctcatcatctgcaattgaaaggaaaaaatgcctatctgcaatctctaaacggaaatataaaaataagaggcaattctaaggataacaatttaattaaatgcggagatggcgcttttattcatgaagaaagtcgtctggttttaaaagcagatacggaattccaaggactgttaattgatctggctgcttaa

SEQ ID NO: 7123 - protein, 233 aa, Photorhabdus luminescens subsp. laumondii TTO1
MIINRTAKQCGKADYGWLQARYTFSFGHYFDPKFLGYGALRVLNQEVIAPKAAFQPKSYPHVDILNIILQGEAEYRDSEGNYIRARKGECLLFSTRQGISYSEHNASINKPLTRLQLWLNAFPQQESLPLQRMELPEQPLAMLASPTAEDGSMQLRQQVWVNHISLNKNQSHHLQLKGKNAYLQSLNGNIKIRGNSKDNNLIKCGDGAFIHEESRLVLKADTEFQGLLIDLAA

SEQ ID NO: 7124 - DNA, 699 bp, Rhodopseudomonas palustris CGA009
  CDS (1)..(699): transl_table=11
atgattgaactccgtcccttcgaccggctcggcggcgccgaccatggctggctcaaggccaagcatcacttctcgttcgccagctactacgaccccaacaacatgggccacggcgccctaagggtctggaacgacgacgagatcgccccggataccggcttcccgccgcatccgcatcgcgacatggagatcatcacctatgtgcgcgacggcgcaatcacccaccaggactcactgggcaacaagggccgcacccaagccggcgacgtccaggtgatgagtgcgggttcgggcgtccggcactccgaatacaacctcgagcctgagaccacccggatcttccagatctggatcgagccgacgcaaggcggcggccagccgacctggggctccaagccgttcccgaaggcggaccgctccggcaagctcgtcaccatcgcgtcgggctttgcgtccgacatcgacgcactgccgatccgcgccgacgcccgggtgctggcgacgacgctgaaggctggcgagaccgccacctacgacgctgagaaggcgcgccacctctatctggtcccggccgtcggcagcgtcgaagtcaacggcgtccgcgtcaacgcgcgcgacggcgctgcgatccacggcgaaacaaagctgaccatcacggcgctcgcagacgccgagctggtgctggtcgacgcggcgtaa

SEQ ID NO: 7125 - protein, 232 aa, Rhodopseudomonas palustris CGA009
MIELRPFDRLGGADHGWLKAKHHFSFASYYDPNNMGHGALRVWNDDEIAPDTGFPPHPHRDMEIITYVRDGAITHQDSLGNKGRTQAGDVQVMSAGSGVRHSEYNLEPETTRIFQIWIEPTQGGGQPTWGSKPFPKADRSGKLVTIASGFASDIDALPIRADARVLATTLKAGETATYDAEKARHLYLVPAVGSVEVNGVRVNARDGAAIHGETKLTITALADAELVLVDAA

SEQ ID NO: 7126 - DNA, 699 bp, Bdellovibrio bacteriovorus HD100
  CDS (1)..(699): transl_table=11
atgatgtatcaacgcaaatccgaggacagaggctatgcagagttcggtggctggctgaaatccatgcacacgttttctttcgccgactactacgatccaaagttcatgggttaccgggacttgcgtgtgatcaatcaggactggattgccaaatcctccggattccctgcgcacccgcaccgtgacatggagatcatcacttatgtgctgaaaggcgccgtggagcacagagacagtctgggcaacgtcggtcagattaaagccggagaaattcaaacgatgcacgccggaaccggtatgcgccacagcgaatacaatccgtccgagacggaggatcttcagctgttccagatctggatcatgcctgacgtggttggagcgactccgggttacacccagcagtccttcacccgtgaacagaaactgaatcagttcaaactgatcgtttccaaagacggccgcgagggcagtcagaagatcaaccaggatgcggatctgtatgcgtcggtctttaccgaagggtatgagcaggaattcgctttgcgttccaaacggggagcctggctgcaattggccgaaggtgaactggacgtgaacggtcaaattctgaaatcaggggatgccctggtcgtcgaggaagagaacctgaagatcaaagccttgaaggaaaccgaattcctactatttgacttgcgctag

SEQ ID NO: 7127 - protein, 232 aa, Bdellovibrio bacteriovorus HD100
MMYQRKSEDRGYAEFGGWLKSMHTFSFADYYDPKFMGYRDLRVINQDWIAKSSGFPAHPHRDMEIITYVLKGAVEHRDSLGNVGQIKAGEIQTMHAGTGMRHSEYNPSETEDLQLFQIWIMPDVVGATPGYTQQSFTREQKLNQFKLIVSKDGREGSQKINQDADLYASVFTEGYEQEFALRSKRGAWLQLAEGELDVNGQILKSGDALVVEEENLKIKALKETEFLLFDLR

SEQ ID NO: 7128 - DNA, 699 bp, Bdellovibrio bacteriovorus HD100
  CDS (1)..(699): transl_table=11
atgattcaggtaagaaaatccaacgaacgcggtctggcacaacacggatggctgaactccaaacacactttctcttttgctgaatactatgacgaaaacttcatgggctacggcccgcttcgcgtgatcaacgaagaccgcattcagggcggcacgggtttcgacacccatcctcaccgtgacatggaaatcatttcctatgtgatcgacggagaactggcccacaaagactctatgggtaacgtggccgtgatcaaaccgggcgaagtgcaacgcatgagtgcaggcacgggggttcgtcactctgaatacaacaacattccgggcaaagaaactcacttcctgcaaatctggatcaagccggataagatcggtgtggagcctggctatgcacagaaaaactttgctgacagcttcggttgcagtgatttgattctggtggcttcgcacaaaggccgtggtggttccatcacgttgaatcaggatgtcgacatgtatgtggcgaaagcccaggatgccggtgaaaaaaatcacaagacctatccgcacagacatttgtgggtgcaggtgatcaaaggcgacgtgcaggtggactccaattccctgacagcgggtgacggggctgcgatcacggacgttgaggcactgaagctttcctggggcaaaggggctgaattcattctgttcgacatgccttaa

SEQ ID NO: 7129 - protein, 232 aa, Bdellovibrio bacteriovorus HD100
MIQVRKSNERGLAQHGWLNSKHTFSFAEYYDENFMGYGPLRVINEDRIQGGTGFDTHPHRDMEIISYVIDGELAHKDSMGNVAVIKPGEVQRMSAGTGVRHSEYNNIPGKETHFLQIWIKPDKIGVEPGYAQKNFADSFGCSDLILVASHKGRGGSITLNQDVDMYVAKAQDAGEKNHKTYPHRHLWVQVIKGDVQVDSNSLTAGDGAAITDVEALKLSWGKGAEFILFDMP

SEQ ID NO: 7130 - DNA, 699 bp, Bacillus cereus ATCC 10987
  CDS (1)..(699): transl_table=11
atgtttagaaaagttgatcataaaaatatgggaagagcaaatcacggttggttaaatacacattttcatttttcatttgcaaattattataatcctaataacatgaacttcggtgcattacgtgtaattaatgatgacttagtagcaccgcaaactggttttgatatgcatccccaccgcgatatggaaatcatttcgtacgttgtagacggtgctttaacacatgaagatagcatggggaaccgcggaacaattgagcgtggacatgttcaatatatgagtgcgggtacgggtgtatttcatagtgagcataatttaggaaatgaaacattacgtttactacaaatttggattttaccagatcgcgcggaccataaaccaaactatggtgagtttaaatttgattggagcaagcgtgaaaatgaatggtttcatatggtatctcaagtagaaggcggggcaccaattcaaattcatcaagatgcgaatttatatgctttatcgttacatgctggaaaagaaattcattttccagtgaaagaaggccgtcaattgtatcttgtacaaattgaaggtagtagtgtaatcaatggtgagacacttgttatgcgtgatgcggcagaagcgatagaagaagatattcatattgtagcgaaagagcaatctcactatttagcaattgaattgaaaaaacaataa

SEQ ID NO: 7131 - protein, 232 aa, Bacillus cereus ATCC 10987
MFRKVDHKNMGRANHGWLNTHFHFSFANYYNPNNMNFGALRVINDDLVAPQTGFDMHPHRDMEIISYVVDGALTHEDSMGNRGTIERGHVQYMSAGTGVFHSEHNLGNETLRLLQIWILPDRADHKPNYGEFKFDWSKRENEWFHMVSQVEGGAPIQIHQDANLYALSLHAGKEIHFPVKEGRQLYLVQIEGSSVINGETLVMRDAAEAIEEDIHIVAKEQSHYLAIELKKQ

SEQ ID NO: 7132 - DNA, 702 bp, Herminiimonas arsenicoxydans
  CDS (1)..(702): transl_table=11
atgcttgaaattagaaaaagtgaagatcgcggtcatgcaaaccatagctggctggattcttatcacagcttctcgtttgccgaatactatgatgaaaagcacatgggtttcggccctttgcgggtgatcaatgaagatcgtgttcatgccggtggcggcttcggcacccacggccatcgcgacatggaaatcatcagctatgtgctggaaggcgagctggcgcataaagacagcatgggcaccggcagcgtgattcgtcccggtgatgtgcaaagaatgagtgcgggcactggcgtgcgccattcggaattcaatcatgcgaaagatcagaccacgcatttcctgcaaatctggatccagccgaacgtgaatggcatcccacccagctatgaagagaaaaatttttcggcggaagaaaaacgcggtcgcttgcgcctgattgccagctcggatggtgcagatggttccgtgctgattcatcaggatgcaaaactgtatgccggtttgtttgatggtgctgaaacagcatctctgccgattgctgttggccgtctggcctatgtacacgttgcacggggtgcggtgacagtgaatggtgttgagctgaaaactggtgatgccgtgaaattatcggatgtcacgactgtcgatatcagtgatggtcagcaggcagaagtgctggtgtttgatctggttcgttag

SEQ ID NO: 7133 - protein, 233 aa, Herminiimonas arsenicoxydans
MLEIRKSEDRGHANHSWLDSYHSFSFAEYYDEKHMGFGPLRVINEDRVHAGGGFGTHGHRDMEIISYVLEGELAHKDSMGTGSVIRPGDVQRMSAGTGVRHSEFNHAKDQTTHFLQIWIQPNVNGIPPSYEEKNFSAEEKRGRLRLIASSDGADGSVLIHQDAKLYAGLFDGAETASLPIAVGRLAYVHVARGAVTVNGVELKTGDAVKLSDVTTVDISDGQQAEVLVFDLVR

SEQ ID NO: 7134 - DNA, 726 bp, Burkholderia vietnamiensis G4
  CDS (1)..(726): transl_table=11
atgatcgagactcgtgcagcaaaccaacgtggccgtgccgagcatggctggctcagctcccgtcacacgttttcgttcgcgaattactacgatccgaagcaagtcggcttctccgacctgctggtgatcaacgacgaccgcgtcgcgccgggccgcggcttcggcacccacccgcaccgcgacatggaaatcctgtcgtacgtgctcgaaggcgcgctggagcacaaggattcgatgggcaccgggtcggtgatcgtgccgggcgacgtgcagctgatgagcgccggcaccggcgtgcgtcacagcgagttcaaccactcgccggaaacgcccgtgcacttcctgcagatctgggtcgggcctgccgagaagggcgccgagccgcgctatcagcagaccaatatcgcggcagcggacaagcgcggcaagctcacgccgatcgtgtcgcccaacggtgatgccggttcgctgaagatccggcaggacacgcggatctacgcgggcctgttcgacggcgacgagcgcgcgacgctcgaactcgcgccggaccgctatgcgtacgtccacgtggcgcgcggcagcgtgacggtcaacggcgtgacgctcggcgaaggcgacggcgcgcgcatccgcgacgaacggacgctgacgttcgccgacggtcacgacgccgaggtgctggtattcgacctgcgcccggtcgaagtgacggccgactgggcatga

SEQ ID NO: 7135 - protein, 241 aa, Burkholderia vietnamiensis G4
MIETRAANQRGRAEHGWLSSRHTFSFANYYDPKQVGFSDLLVINDDRVAPGRGFGTHPHRDMEILSYVLEGALEHKDSMGTGSVIVPGDVQLMSAGTGVRHSEFNHSPETPVHFLQIWVGPAEKGAEPRYQQTNIAAADKRGKLTPIVSPNGDAGSLKIRQDTRIYAGLFDGDERATLELAPDRYAYVHVARGSVTVNGVTLGEGDGARIRDERTLTFADGHDAEVLVFDLRPVEVTADWA

SEQ ID NO: 7136 - DNA, 699 bp, Bradyrhizobium sp. ORS278
  CDS (1)..(699): transl_table=11
atgatcgaactcaagccctttgcggcgctgggcggcgccgaccacggctggctgaaggccaggcaccacttctctttcgcgagctattacgaccccagcaacatgggccatggcgcgctgcgcgtctggaacgacgacgagatcgcgccgaacaccggcttcccggcgcatccccatcgcaacatggaaatcatcacctatgtccgtgaaggcgcgatcacgcaccaggacagcctcggcaacaagggccgcaccgaagccggcgacgttcaggtgatgagcgcaggcagcggcatccgccactccgaatacaatctcgagccgaccacgacgcgaattttccagatctggatcgagccgaccaccgatggcggccagcccacctggggcgccaagccgttcccgaagtccgaccgctccggcaagctggtcacgctcgcctcgggattcgctgatgacgccgatgcgctgccgatccgcgccaaggcgcgcgtgctcggcaccacgctgagggccggcgaaaccgccgaatacagtgccgacaaagcgcggcatatctatctcgtgcccgccgccggcagcgtcgaagtcaacggcgtccgagtcaacgcccgggacggcgccgccatccgcgacgaggccacgctcaagatcaccgcgctcgaggattccgagctggtgctggtggacgccgcttaa

SEQ ID NO: 7137 - protein, 232 aa, Bradyrhizobium sp. ORS278
MIELKPFAALGGADHGWLKARHHFSFASYYDPSNMGHGALRVWNDDEIAPNTGFPAHPHRNMEIITYVREGAITHQDSLGNKGRTEAGDVQVMSAGSGIRHSEYNLEPTTTRIFQIWIEPTTDGGQPTWGAKPFPKSDRSGKLVTLASGFADDADALPIRAKARVLGTTLRAGETAEYSADKARHIYLVPAAGSVEVNGVRVNARDGAAIRDEATLKITALEDSELVLVDAA

SEQ ID NO: 7138 - DNA, 702 bp, Klebsiella pneumoniae subsp. pneumoniae MGH 78578
  CDS (1)..(702): transl_table=11
atgattactacccgaacagccaaacaatgcggacaagcagacttcggctggctgcaggcccgctacaccttctcctttggccactacttcgacccgaaattactgggcttcgcatccttgcgcgtcctcaaccaggaagtgctggcgcccggcgcttccttccaggccagaacgtacccaaaagtcgatatcctgaacctgattctggaaggcgaagcggagtatcgcgacagcgacggcaaccacgtgcaggccaaagccggtgaagcgctgctgatcgccacccagcctggcgtgagctatagcgagcataatctgagtaaagagcagtcgttaacgcgaatgcaactttggcttgatgcctgcccgcagcgggaaaacccgctgcagcagaaaatcaatgtcgcagacgcgacgctgcagctgctggcctctccggagggcggggataacagcctccagcttcgccaacaggcctgggtctaccatatcgcgctggagaaaggtgagcagatcaacgtgcaattacatggtccacgcgcctacctgcagtcgattcacggctccgtccatgccgtcgcacaggaacagcaaaagcaggctctcacctgcggtgacggcgcatttattcgtgacgaagctaacattaccctcgtcgccgatacgccgctgcgcgctttgctgatagatttaccggtgtaa

SEQ ID NO: 7139 - protein, 233 aa, Klebsiella pneumoniae subsp. pneumoniae MGH 78578
MITTRTAKQCGQADFGWLQARYTFSFGHYFDPKLLGFASLRVLNQEVLAPGASFQARTYPKVDILNLILEGEAEYRDSDGNHVQAKAGEALLIATQPGVSYSEHNLSKEQSLTRMQLWLDACPQRENPLQQKINVADATLQLLASPEGGDNSLQLRQQAWVYHIALEKGEQINVQLHGPRAYLQSIHGSVHAVAQEQQKQALTCGDGAFIRDEANITLVADTPLRALLIDLPV

SEQ ID NO: 7140 - DNA, 696 bp, Klebsiella pneumoniae subsp. pneumoniae MGH 78578
  CDS (1)..(696): transl_table=11
atgatctatttacgaaaagcgaacgaacgtggccacgctaaccatggctggctggattcctggcatactttctctttcgccaactattatgacccgaactttatgggcttctccgccctgcgggtgattaacgacgacgtcatcgacgccggtcagggcttcggtacccacccgcacaaagacatggagatcctgacctatgtgctggaaggggcggtggagcaccaggacagcatgggcaacaaagagcaggtgccggcgggcgagttccagatcatgagcgcgggtaccggggtgcgccactctgagtacaacccgagcaaaaccgatcgtctgcgtctgtatcagatctggattattccggaagaaaccggcattaccccgcgctacgagcagcgccgcttcgacgccgcccagggcaaacagctggtgctgtcgccggatgcgcgagatggctcgctgaaggtgtaccaggatatggaactctatcgctgggcgctgctgaaagatgagcagtcggttcaccagattgccgcggaacgccgcgtgtggatccaggtggtcaaaggcgaagtgaccatcaacggtaccaaagccaccaccagcgacggtttggccatctgggacgagcaggcgatttcggttcatgccgacagcgatagcgagatcctgctgttcgatctgccgccggtttga

SEQ ID NO: 7141 - protein, 231 aa, Klebsiella pneumoniae subsp. pneumoniae MGH 78578
MIYLRKANERGHANHGWLDSWHTFSFANYYDPNFMGFSALRVINDDVIDAGQGFGTHPHKDMEILTYVLEGAVEHQDSMGNKEQVPAGEFQIMSAGTGVRHSEYNPSKTDRLRLYQIWIIPEETGITPRYEQRRFDAAQGKQLVLSPDARDGSLKVYQDMELYRWALLKDEQSVHQIAAERRVWIQVVKGEVTINGTKATTSDGLAIWDEQAISVHADSDSEILLFDLPPV

SEQ ID NO: 7142 - DNA, 699 bp, Xanthobacter autotrophicus Py2
  CDS (1)..(699): transl_table=11
atgatcgagcatcgccccttcgacagcctcggcaaggccaaccacggctggctcaacgcccggcaccacttctccttcgccaattatttcgatcccgcccgccagagccacggcaagctccgggtgtggaacgacgacgagatcgcgccgggatcgggctttccgccccacccgcacgccaacatggaaatcatcacctatgtccgcgagggcgccatcacccacgaggacagcctgggcaaccgcggccgcaccgtggccggcgacatccaggtgatgagcgcggggcgcggcatccgccactccgaatacaatctggaaagcggacccacgcgcatcttccagatctggatcgagccggatcaggccggcggcgcacccacctggggcacccgccccttccccaagaccgaccgctcgggccgcttcgtggccctggcgagcggcatcgcgggggatggggacgccctgcccatccgcgcccatgcccgggtgctcggcgccacgctgaaggcgggcgagaccatcgactacgcccctttgagcggcctcaacacctatctggtgccggccaccggcgcggtggaggtcaacggcctgcgcctcgacacccgtgacggcgcggccatctcgaacgagcccatcctcaccatcacggctctggaagacagcgagctggtgctggtggaagcggcctga

SEQ ID NO: 7143 - protein, 232 aa, Xanthobacter autotrophicus Py2
MIEHRPFDSLGKANHGWLNARHHFSFANYFDPARQSHGKLRVWNDDEIAPGSGFPPHPHANMEIITYVREGAITHEDSLGNRGRTVAGDIQVMSAGRGIRHSEYNLESGPTRIFQIWIEPDQAGGAPTWGTRPFPKTDRSGRFVALASGIAGDGDALPIRAHARVLGATLKAGETIDYAPLSGLNTYLVPATGAVEVNGLRLDTRDGAAISNEPILTITALEDSELVLVEAA

SEQ ID NO: 7144 - DNA, 690 bp, Acinetobacter sp. ADP1
  CDS (1)..(690): transl_table=11
atgaatgcatatctacatcgtagtgaaaatcgtggtcatgtaaaagcaggctggttaaatacctatcatagtttttcatttggtagctggtataacccgaaatacatgggttttggtccacttcgcgtgattaatgatgacaccatcgctgcaaataatggctttggtactcacccacatgacaatatggaaatcctgacctatgttactgatggtcgtctgactcaccgtgacagtatgggcaatgaagaatatattcatgctggcgaatggcaattgatgagtgctggtacaggtgtcgcacacagtgaaatcaataatacggatgaagctgtgcatttgtttcaaatctggattcagcccaatatccgtgatgctgaaccaacttatcaacaaattaagcttaatcctcacgatgaaccaaacaaatggcatctgattgttgggccaaatgacaatgcacccatgtttatccgtcaaaatgcagaagtcaaagcggctgtattggaagaaggtaaaacgttagacattgccaccactcaaaagcacaattatgtgcatgtggtaaaaggccaaattatgattgaaaatcaaattgtgaaagcgggtgatgctttattatttgatgaaaaaacttcaatcaaggcacttgaagatagtgaaatgatctggtttgacctacccgcataa

SEQ ID NO: 7145 - protein, 229 aa, Acinetobacter sp. ADP1
MNAYLHRSENRGHVKAGWLNTYHSFSFGSWYNPKYMGFGPLRVINDDTIAANNGFGTHPHDNMEILTYVTDGRLTHRDSMGNEEYIHAGEWQLMSAGTGVAHSEINNTDEAVHLFQIWIQPNIRDAEPTYQQIKLNPHDEPNKWHLIVGPNDNAPMFIRQNAEVKAAVLEEGKTLDIATTQKHNYVHVVKGQIMIENQIVKAGDALLFDEKTSIKALEDSEMIWFDLPA

SEQ ID NO: 7146 - DNA, 699 bp, Erwinia carotovora subsp. atroseptica SCRI1043
  CDS (1)..(699): transl_table=11
atgatcacacgaagagcagcagggcaatgcggtcaagccgactatggctggttgcaggcacgctatacattctctttcggtcactattttgacccacagttactgggctacgcttctcttcgcgtgctcaatcaggaagtgttagcgccgggagcctcattccagcctcgaacctacccacgtgtagatatcctgaatattattcttcagggcgaagcggaataccgcgacagcaacggctgccatattcaggctaaagctggagatgtgctattgctcgccactcagccgaacgtcagctatagcgaacataacaccaatgccagtaagccactgacacgtctgcaattatggctgaatgcttgccagacccgagaaaacagcccgctgcagcgcatggggctgagttcatcaagccacacgctgcttgcctcaccggaaggcgagcaggatagtctgcaactgcgccagcaggtctggatccatcatgtcgatctccagccgaatgagcaaagcacgatcgccctacagggaaatcaggcttacctccagttgatccacggttcaatggcggtgaaaggcagccagcacagtgaaacattacactgcggcgacggagccttcatcaaggaagaaacgacgttgacgctccaggcagaatcgccgttgcgggcactgctcatcgatctggtcgtgtag

SEQ ID NO: 7147 - protein, 232 aa, Erwinia carotovora subsp. atroseptica SCRI1043
MITRRAAGQCGQADYGWLQARYTFSFGHYFDPQLLGYASLRVLNQEVLAPGASFQPRTYPRVDILNIILQGEAEYRDSNGCHIQAKAGDVLLLATQPNVSYSEHNTNASKPLTRLQLWLNACQTRENSPLQRMGLSSSSHTLLASPEGEQDSLQLRQQVWIHHVDLQPNEQSTIALQGNQAYLQLIHGSMAVKGSQHSETLHCGDGAFIKEETTLTLQAESPLRALLIDLVV

SEQ ID NO: 7148 - DNA, 696 bp, Erwinia carotovora subsp. atroseptica SCRI1043
  CDS (1)..(696): transl_table=11
atgatctatttacgtcaagcgcaagatcgcggacatgcgaatcacggctggctcgacagttggcatacgttctcattcgccgattattacgatcctgatttcatgggattctcagcacttcgcgtgattaacgaagactttatcgatggcggtcagggcttcggcacgcacccgcacaaagatatggaaattttgacctatgtcttgtctggtgcggttgagcatcaggacagtatgggaaataaagagcaggtgccagcgggcgaattccagattatgagcgcaggaacgggcattcgtcattctgagtacaatgccagcaaagacgaacagctgcacctgtatcaaatctggattatcccggaaaaaaccgggctgacaccgcgctacgagcagaagcgttttgatgtgcttcaagggcgtcaactggtgctgtcaccggatgcgcgtgaaggctcgctgaaagtctttcaggacatgacgctgtggcgctgggcgctgaaagcgcaggaacaatcggtgtatcagattcaggctgatcgtcgcgtttgggttcaggttgtgcgcggcagtgtagagattaacggccagaaagcggaaaccagcgatgcgttcgctgtttgggacgaaacggctatttccgtacacgccagcgaagacagtgaaattctgctgtttgatttgccgccagtataa

SEQ ID NO: 7149 - protein, 231 aa, Erwinia carotovora subsp. atroseptica SCRI1043
MIYLRQAQDRGHANHGWLDSWHTFSFADYYDPDFMGFSALRVINEDFIDGGQGFGTHPHKDMEILTYVLSGAVEHQDSMGNKEQVPAGEFQIMSAGTGIRHSEYNASKDEQLHLYQIWIIPEKTGLTPRYEQKRFDVLQGRQLVLSPDAREGSLKVFQDMTLWRWALKAQEQSVYQIQADRRVWVQVVRGSVEINGQKAETSDAFAVWDETAISVHASEDSEILLFDLPPV

SEQ ID NO: 7150 - DNA, 690 bp, Mannheimia succiniciproducens MBEL55E
  CDS (1)..(690): transl_table=11
atgttacaattaagaaaatccaacgagcgcggacatgcaaatcacggttggttagatagctaccatactttctcttttgccgattatttcgaccgcaatcatatgcatttttccgacttgcgcgtgatcaatgaagatttcattcagccgaccatggggttcggcacccatccgcacaaggatatggagattctgacctatgtgctgcaaggcgccattgcgcacaaagacagcatgggcaatgtgaaaacctttactgccggcgaatttcaaattatgtctgccggtaccggtatctatcattcggaatttaacccgagcgaaagcgagcttttgcaccttctgcaaatctggattatgccgaacgaacttggcgttagccctcgttacgatcaaaaacagtttgccgataaagaaggggcaacgttgattttatcgcccgatgcggaaggcgaatcgttcaaagtctatcaggatatgaaactttggcgtcaccaatataaagcacaccaaaaagtggagcttgggttaaattcccgcagaaattactggctgcaggtggtaaaaggtaatttaacggttaatgatatcgcacttgcaacttccgatgcgctgggtataagcgcggaagagctggcaactatcgaaacctcggacgaggtggaatttttgttgttcgatttacgataa

SEQ ID NO: 7151 - protein, 229 aa, Mannheimia succiniciproducens MBEL55E
MLQLRKSNERGHANHGWLDSYHTFSFADYFDRNHMHFSDLRVINEDFIQPTMGFGTHPHKDMEILTYVLQGAIAHKDSMGNVKTFTAGEFQIMSAGTGIYHSEFNPSESELLHLLQIWIMPNELGVSPRYDQKQFADKEGATLILSPDAEGESFKVYQDMKLWRHQYKAHQKVELGLNSRRNYWLQVVKGNLTVNDIALATSDALGISAEELATIETSDEVEFLLFDLR

SEQ ID NO: 7152 - DNA, 699 bp, Burkholderia pseudomallei K96243
  CDS (1)..(699): transl_table=11
atgttcgagatccgccgcgcgggcgatcgcggccacgccgatcatggctggctcgatacccatcacagcttttcgttcgccgactatcgcgatccggagcacatgcatttcggcgcgctgcgcgtgctgaacgacgatcgcatcgcgccgacgcgcggcttcggcatgcatccgcatcgcgacatggagatcgtcacgtacgtgctcgaaggcgcgctcgcgcaccgcgacagcatgggcaacggctcgatcgtccgcgcgggcgacgtgcagcggatgagcgcgggcacggggatcgtgcacagcgagtacaacgcgtcgcgcgacgcgccgctgcatctgctgcagatctggctgctgccggtcgagccgggcggccggccgggctaccaggaggcgcgtttcaccgacgccgacaagcgcggccggctgcggctcgtcgcgtcgccggacgggcgcgacggcgcggtgacggtgcgcgcggacgcgtcgatctacgcgggcctcgtcgacggcgacgagcgcgcggagttcgcgctgccggccgggcggcgcgcgtacgtgcacgtcgcgcgcgggtgcgtggtggtcaacggcgagatgctcgcggccggcgacggcgcgcggatcgccgaggtcgggcgcgtcgtgttcgagcgcggcgagcgcgcggaggtgttgctgttcgatctcgcgtga

SEQ ID NO: 7153 - protein, 232 aa, Burkholderia pseudomallei K96243
MFEIRRAGDRGHADHGWLDTHHSFSFADYRDPEHMHFGALRVLNDDRIAPTRGFGMHPHRDMEIVTYVLEGALAHRDSMGNGSIVRAGDVQRMSAGTGIVHSEYNASRDAPLHLLQIWLLPVEPGGRPGYQEARFTDADKRGRLRLVASPDGRDGAVTVRADASIYAGLVDGDERAEFALPAGRRAYVHVARGCVVVNGEMLAAGDGARIAEVGRVVFERGERAEVLLFDLA

SEQ ID NO: 7154 - DNA, 708 bp, Methylococcus capsulatus str. Bath
  CDS (1)..(708): transl_table=11
atgatccggatcaggcacagccaggagcgcggccactccagccacggctggctcgacagccgtcacaccttttcctttggggactactacgatccgcgccacacgggattttccagcctgcgcgtgatcaacgacgaccgcgtgctgccggcggcgggcttccccacccatccgcaccgcgacatggagatcattacctacatgctggaaggcgcgctcgcgcacaaggacagcatgggaaacggctcggtgctccgcgccggcgaggtacaacgcatgacggccgggaccgggatcactcacagcgaattcaatgcctcggatgccgacggtgtgcacttcctgcagatatggatcctgccggaccggcgtggctacacacccggctaccaacaggcgcgcttcagcgcgcaggacaaggccggtcgcctgtgtctcgtggcctcgccggacgggcgtagcggctcgctgacaatccaccaggatgcgctgctctacgccaccgtcctggacgcggacgaggccgtgcagcatacgctcgcgcccggccgctgcgcctatgtgcacgtggcgcgcggagaaatacggctgaatggcacgagattgaccgacggcgatggcgcggcgatggtcgatgaagccctgctccacctgagtaccgacagcgtgggcgaggcgctgctgtttgacctcgccgcccaggagtag

SEQ ID NO: 7155 - protein, 235 aa, Methylococcus capsulatus str. Bath
MIRIRHSQERGHSSHGWLDSRHTFSFGDYYDPRHTGFSSLRVINDDRVLPAAGFPTHPHRDMEIITYMLEGALAHKDSMGNGSVLRAGEVQRMTAGTGITHSEFNASDADGVHFLQIWILPDRRGYTPGYQQARFSAQDKAGRLCLVASPDGRSGSLTIHQDALLYATVLDADEAVQHTLAPGRCAYVHVARGEIRLNGTRLTDGDGAAMVDEALLHLSTDSVGEALLFDLAAQE

SEQ ID NO: 7156 - DNA, 705 bp, Bacteroides fragilis NCTC 9343
  CDS (1)..(705): transl_table=11
atgaaaaaagtagttcaccgctcagatacccgcggacgatccgtatatgactggctcgacagccatcacagtttcagctttgacgaatattacaatcccgaacgggttcatttcggtgctctgagggtactgaacgatgaccgggtagccccgggtgaaggttttcagacccatccccataaaaatatggaaatcgtctccatacctttaaagggtcttctggcacatggcgacagtaaaaagaacagtcgtaccattactgtaggcgatattcaggtgatgagtgccggtacaggcatttatcatagcgagatgaacggcagcaaatcggaaccggtggaatttctgcaaatatggatcataccgaaagaacggaacactcatcccctctatcaggattatgacatccggggattactgaaaaaagacgaactggccttcatactatcacctgacggaagtacacctgccaaactattgcaggacacctggttctcgatgggtgagataggagccggaaagacagttgaatatacactgcatgggacggatatgggagtctacgttttcctgatcgaaggagaagtaaagatagatgatgtgatcctgactcgccgcgacggattgggaatatccgaaatcaagaattttgagatagaaactctgaaagactctaaaatactactgatagaagtaccgatgtaa

SEQ ID NO: 7157 - protein, 234 aa, Bacteroides fragilis NCTC 9343
MKKVVHRSDTRGRSVYDWLDSHHSFSFDEYYNPERVHFGALRVLNDDRVAPGEGFQTHPHKNMEIVSIPLKGLLAHGDSKKNSRTITVGDIQVMSAGTGIYHSEMNGSKSEPVEFLQIWIIPKERNTHPLYQDYDIRGLLKKDELAFILSPDGSTPAKLLQDTWFSMGEIGAGKTVEYTLHGTDMGVYVFLIEGEVKIDDVILTRRDGLGISEIKNFEIETLKDSKILLIEVPM

SEQ ID NO: 7158 - DNA, 723 bp, Pseudomonas syringae pv. syringae B728a
  CDS (1)..(723): transl_table=11
atgctgactcttcgcaaagcctctgatcgtggcgcagccgatcatggctggttgaaatcctttcacaccttttcctttgccggctaccgcaacccgcaggaacaaggcttttccgacctgctggtgatcaacgacgaccgtgtcagtgcaggcaaaggtttcggccagcatcctcaccgggacatggagatcttttcctatgtgctggaaggcgcgctggaacacaaggatacgctgggcaccggctcggtgattcgtcccggtgacgtgcaattgatgagcgccggcaccggtgtggcacacagcgagttcaaccattcgcacaccgagggcgtgcattttctgcagatctggatcgtgccgaatgttgcaggcgcggcgcccaactaccaggagaagcactttagccccgagcagaaacgcggtcgcttgcagttgatcatttcgccggaaggcgagaacggtgcgctcaaggtgcgccaggacgctcgggtgtatgccggcctgttcgatggcgatgaaaccgcgacgctggagctggcggccaaccgctacgcctacgtgcacgttgcgcgtggcagcgtggtgctcaatggcgagcaactgggcgaaggggatggcgtgcgtgtccgcgacgaacagacgctgagcctgagcgcaggggttgacgcagaggtgttggtgttcgacatgcggccaaacgaattgccgcagatgccttga

SEQ ID NO: 7159 - protein, 240 aa, Pseudomonas syringae pv. syringae B728a
MLTLRKASDRGAADHGWLKSFHTFSFAGYRNPQEQGFSDLLVINDDRVSAGKGFGQHPHRDMEIFSYVLEGALEHKDTLGTGSVIRPGDVQLMSAGTGVAHSEFNHSHTEGVHFLQIWIVPNVAGAAPNYQEKHFSPEQKRGRLQLIISPEGENGALKVRQDARVYAGLFDGDETATLELAANRYAYVHVARGSVVLNGEQLGEGDGVRVRDEQTLSLSAGVDAEVLVFDMRPNELPQMP

SEQ ID NO: 7160 - DNA, 696 bp, Pseudomonas fluorescens Pf-5
  CDS (1)..(696): transl_table=11
atgcttgaactcagacctttcagctccctgggcggcgcgcaccacggctggctggatgcccaccaccatttttccttcgccgagtaccatgaccccaagcgcatgcactggggcaacctgcgggtctggaacgatgatgtgatcgcccctggcaccggcttcccccagcacccgcaccgggacatggaaatcatcacctacgttcgcgaaggggccatcagccaccaggacaacctgggcaacaagggccgcaccgaagccggtgatgtgcaggtgatgagcgccggcaccgggatcgcccacagcgagtacaacctggaagccacgccaaccaagatcttccagatctggatcatccccaaccaggcaggctccgcgccttcctggggtgccaagccttttcccaagggccagcgtgaaggtttcgtgaccctggccagtggcaaggctggcgatgaggaaagcctgcggattcgcgccgatgcgcggctggtggcggccaacctgaaggccggggaaacggccgagtatcacctggacgacgggcgccgggcttacctggttccggcgaccggcgcgattgaagtcaacggcttgcgcgccgaagctcgagatggcgtcgcggttgagaatgagccggtgctgcgggtgacggcgttgcaggacagcgagatcgtgctggtggatctggcgtga

SEQ ID NO: 7161 - protein, 231 aa, Pseudomonas fluorescens Pf-5
MLELRPFSSLGGAHHGWLDAHHHFSFAEYHDPKRMHWGNLRVWNDDVIAPGTGFPQHPHRDMEIITYVREGAISHQDNLGNKGRTEAGDVQVMSAGTGIAHSEYNLEATPTKIFQIWIIPNQAGSAPSWGAKPFPKGQREGFVTLASGKAGDEESLRIRADARLVAANLKAGETAEYHLDDGRRAYLVPATGAIEVNGLRAEARDGVAVENEPVLRVTALQDSEIVLVDLA

SEQ ID NO: 7162 - DNA, 711 bp, Psychrobacter arcticus 273-4
  CDS (1)..(711): transl_table=11
atgcaaacgatctatcatgcagcagattctcgtggcgatgccgaccatggctggttaaaaagcaagcatacttttagctttgccaattaccataatccagagcgtatgggttttggcgccctacgtgttattaatgatgacttcgtgatcggtggtcaaggcttcggtaagcattcgcaccgcgatatggaaattatcagtattccgttatatggtaagctcggtcacggtgataacatcggtaataatggcattatcgaaaccggtgaaatccaagttatgtcagcaggtaccggtatcattcatagcgagatgaatggccatgacaaagaagatgtgaagttcctacagatttgggttatgccaaaccaaatgaacgtagcgcctcgttaccagcaagtatgcatggatgacatcatgcagccaaacaagtttaaccaaatactttcaccaaaccctaacgatgcaggtgtatggattcatcaagatgcttggtttagcatgggtgattttgataaaggtatcatccagacttaccagctaaaagaccctaacaatggcgtttatatctttgtcattagcggtaaagtcgttgtaaacggtaacactctggatacccgcgatggtcttggcatctgggatactaagagctttacgatggacatcatcgatgatgctaaagtcctatcaatggaagtaccaatgagctaa

SEQ ID NO: 7163 - protein, 236 aa, Psychrobacter arcticus 273-4
MQTIYHAADSRGDADHGWLKSKHTFSFANYHNPERMGFGALRVINDDFVIGGQGFGKHSHRDMEIISIPLYGKLGHGDNIGNNGIIETGEIQVMSAGTGIIHSEMNGHDKEDVKFLQIWVMPNQMNVAPRYQQVCMDDIMQPNKFNQILSPNPNDAGVWIHQDAWFSMGDFDKGIIQTYQLKDPNNGVYIFVISGKVVVNGNTLDTRDGLGIWDTKSFTMDIIDDAKVLSMEVPMS

SEQ ID NO: 7164 - DNA, 708 bp, Colwellia psychrerythraea 34H
  CDS (1)..(708): transl_table=11
atgatcaaacattatccctataaaagtcttggtggcgctaatcacggttggctcaaatctaagcatcactttagttttgctaattactataatcctacccgcatgggttttggaaagttacgtgtaatcaatgatgactgggttgagccaggtatgggctttccttcgcacccacaccgaaatatggaaattattagttttattcgttcaggtgaaattacccatcaagatagtacgggtaataaaggcataactaaaacaggtgaagtgcaagtgatgagtgccggaaaaggtattgtgcattcagaatataaccgcaccaaagatccgttaaccttttatcaaatttggcttgaaaccaataaaaatgacgtgacgcctcgttgggaaagcaaaaagttccccactaagcaggcagctgtacttactttattagcatcaggttatccagaagataaggataaagccctttttatcaaccaagaagcacgcatctatggtggtaaattagctaaaggtactctgattgagcaagacattagacatcaagcttacatattagcctctgatggtatgttcaaagttgaggacagctccgcaaatataacgatgaacaaaggtgatggtgccgaaatcagtcaatcaagttcaatacgattgagagcaactacagattgtgaaattattattatcgacaccataaaatag

SEQ ID NO: 7165 - protein, 235 aa, Colwellia psychrerythraea 34H
MIKHYPYKSLGGANHGWLKSKHHFSFANYYNPTRMGFGKLRVINDDWVEPGMGFPSHPHRNMEIISFIRSGEITHQDSTGNKGITKTGEVQVMSAGKGIVHSEYNRTKDPLTFYQIWLETNKNDVTPRWESKKFPTKQAAVLTLLASGYPEDKDKALFINQEARIYGGKLAKGTLIEQDIRHQAYILASDGMFKVEDSSANITMNKGDGAEISQSSSIRLRATTDCEIIIIDTIK

SEQ ID NO: 7166 - DNA, 723 bp, Pseudomonas syringae pv. phaseolicola 1448A
  CDS (1)..(723): transl_table=11
atgctgactcttcgtaaagcttccgaccgcggcgctgccaaccatggctggttgaaatcctttcataccttttcctttgccggttatcgcaaccctcaggagcagggcttttccgatctgctggtgatcaacgacgaccgcgtgattgcgggcaaaggtttcggccagcacccacaccgtgacatggaaatcttttcctacgtgctggaaggtgcgctggagcacaaggatacgctgggcaccgggtcggtgattcgccctggcgacgtgcaattgatgagtgccggcagcggcgtggcgcacagcgagttcaaccattcgcacaccgagggcgtgcattttctgcagatatggatcgtgccgaatgttgcaggctcaaccccgaactaccagcaggagcatttcagcgctgaacagaaacgcggtcatttgcagctgatcatttcgccagaaggcgagaacggtgcgctcaaggtccgtcaggacgctcgtgtgtatgccggtctgttcaatggcaatgaaactgcgaccctggaactggctgccaaccgatatgcctacgtgcatgtggcccgtggcagtgtggtgctcaatggtcagccgcttgacgaaggtgacggggtgcgtttgcgcaacgaacaggtcattagcctgagcgaaggcgttgacgcagaagtgttggtctttgacatgcggcccaatgaactgccacaaatgccctga

SEQ ID NO: 7167 - protein, 240 aa, Pseudomonas syringae pv. phaseolicola 1448A
MLTLRKASDRGAANHGWLKSFHTFSFAGYRNPQEQGFSDLLVINDDRVIAGKGFGQHPHRDMEIFSYVLEGALEHKDTLGTGSVIRPGDVQLMSAGSGVAHSEFNHSHTEGVHFLQIWIVPNVAGSTPNYQQEHFSAEQKRGHLQLIISPEGENGALKVRQDARVYAGLFNGNETATLELAANRYAYVHVARGSVVLNGQPLDEGDGVRLRNEQVISLSEGVDAEVLVFDMRPNELPQMP

SEQ ID NO: 7168 - DNA, 708 bp, Dechloromonas aromatica RCB
  CDS (1)..(708): transl_table=11
atgatccaagtccgcccttctgccgagcgaggttatgccgatcatggctggctgcgtgccaggcacagtttctcgtttgccgattattacgatccggccgaaatgggctggggcgtgctgcgcgtcatcaacgaagaccgtgtggcgcccggcaagggtttcggcacgcatggccaccgcgacatggaaattgtcacctacatcctgtccggggcactggagcacaaggacagtcttggccacggcggcgtcattcggcgtggcgaggtgcagcgcatgagtgccggtacgggcatccggcacagcgagttcaacccgctgccggatcaggaaacccatttgctgcaaatctggatcgagccgtcgcaacatggcacaccggccagttacgagcagcaggcgctgccaattgaggaattgcgcggtcgctggcggctggtggcctcgcctgacggggcggaggggagcacgacgatcggtcaggacgcccgcttgtgggcgagcgttctggttcccggcgaagcggccgagtaccgcttggcggccggtcggctggcctatgtgcaggtggtcagtggccaattgtcggtcaacgggcaacgcctcgtcgctggtgacggcgccaagattgccgatgaaacccaacttgaatttctggccggcgaagaagcggaaatcctgcttttcgacctgccgcctgttgcataa

SEQ ID NO: 7169 - protein, 235 aa, Dechloromonas aromatica RCB
MIQVRPSAERGYADHGWLRARHSFSFADYYDPAEMGWGVLRVINEDRVAPGKGFGTHGHRDMEIVTYILSGALEHKDSLGHGGVIRRGEVQRMSAGTGIRHSEFNPLPDQETHLLQIWIEPSQHGTPASYEQQALPIEELRGRWRLVASPDGAEGSTTIGQDARLWASVLVPGEAAEYRLAAGRLAYVQVVSGQLSVNGQRLVAGDGAKIADETQLEFLAGEEAEILLFDLPPVA

SEQ ID NO: 7170 - DNA, 699 bp, Ralstonia eutropha JMP134
  CDS (1)..(699): transl_table=11
atgattgaaatcagaaagtctgaagaacgcggttacgcagatcatggctggctgaagtcgtatcactcgttctcctttgccgactactacgatccgcagcacatccagttcgggccgctgcgcgtgatcaatgaggaccgggtcgcgccgggcatgggtttcggcacccatggccatcgcgacatggaaatcatcagctacgtgctggaaggcgagcttgcgcacaaggacagcatgggcaacggcagcgtgatccgcccgggcgatgtgcagcgcatgagcgccggtaccggcgtgcggcattcggagtacaaccatgccgcgcacgacaccacgcacttcctgcagatctggatcatgccggaccgcaccggcatcgaacccggctatgaggaaaagcgcttcgaggcagccgacaagcgtggccgcctgcgcctggtggcgagcagcgacggcgccgacggttcggtcgtggtgcatcaggacgtgcgcctgtatgccggcctgttcgacggtgacgagtccgccacgctggcgctggctccgggacgtcgtgcctatgtgcacgtggcacgcggccgggtcgtggtcaatggcaagccgctggaggccggcgatgcggccaagctcgagtccgtggatgccgtagcgctgacgcagggagaaggcgctgaagtgctggtgtttgacctgtcctga

SEQ ID NO: 7171 - protein, 232 aa, Ralstonia eutropha JMP134
MIEIRKSEERGYADHGWLKSYHSFSFADYYDPQHIQFGPLRVINEDRVAPGMGFGTHGHRDMEIISYVLEGELAHKDSMGNGSVIRPGDVQRMSAGTGVRHSEYNHAAHDTTHFLQIWIMPDRTGIEPGYEEKRFEAADKRGRLRLVASSDGADGSVVVHQDVRLYAGLFDGDESATLALAPGRRAYVHVARGRVVVNGKPLEAGDAAKLESVDAVALTQGEGAEVLVFDLS

SEQ ID NO: 7172 - DNA, 717 bp, Anabaena variabilis ATCC 29413
  CDS (1)..(717): transl_table=11
atgtctcaaaatacaatcaacaatctcattcatgatagaaatgcacggggtcgtagtcaaacaggttggcttgatagttatcacaccttttctttcagcagtttttatgatcccaaccgtatgggattccgttccttacgagtcatcaatgacgaccgcattgcacctggtgcaggatttcccactcatggacatcgtgatatggaaattctcacttatgtactctcaggtgcagtagagcataaagacagtttgggtactggttcagttattcgtcctggcgatgtgcagattatgagtgctggtacgggaattcaacatagtgaatttaaccactcacgcaccgaagcattacatttactgcaaatctggattttacctgacgaacaaggattagcacccagataccaacagaaagctttcaccccagaagaaaaacgcggtcaactgcgtcttgtagctgctaaagacggacgtgatggtgctgtcactattcaccaaaatgttgatatctacgcctctattttaaaaccaggtgatgtagtcaattatcacgtaaaaggcgatcgctatgcttggttgcaaatcgctcaaggtgtcgccactttaaatggtgaagaactcagagcaggtgatggcgtacaaatcaacacagaagagcaactgaaaatcagtacaagcgtcggtacagagttattgctgttcgatttagcctga

SEQ ID NO: 7173 - protein, 238 aa, Anabaena variabilis ATCC 29413
MSQNTINNLIHDRNARGRSQTGWLDSYHTFSFSSFYDPNRMGFRSLRVINDDRIAPGAGFPTHGHRDMEILTYVLSGAVEHKDSLGTGSVIRPGDVQIMSAGTGIQHSEFNHSRTEALHLLQIWILPDEQGLAPRYQQKAFTPEEKRGQLRLVAAKDGRDGAVTIHQNVDIYASILKPGDVVNYHVKGDRYAWLQIAQGVATLNGEELRAGDGVQINTEEQLKISTSVGTELLLFDLA

SEQ ID NO: 7174 - DNA, 723 bp, Pseudomonas fluorescens PfO-1
  CDS (1)..(723): transl_table=11
atgctgacccttcgcaaagcttccgaccgtggtctggccaatcatggctggttgaagtcgttccacaccttttccttcgccagctaccgtgacccgcgtgaacagggtttctccgacctgctggtcatcaacgatgaccgcgtcgccgctggcaaaggcttcggccagcacccgcaccgtgacatggagattttctcctatgtgctcgaaggtgcgctggaacacaaggacaccctcggcaccggttcggtgatccgccccggcgatgtgcaactgatgagcgccggcagcggcgtggcccacagcgagttcaaccactcggcaaccaagccggtgcactttctgcagatctggatcgtgccggacgtcagcggcgcgaaaccgcgttaccagcaagagcacttcagcgaacagaaaaaacgcggtcgcctgcaactgatcatttcgcccgaaggcagccacggctcgctgaaagtacggcaggacgcacgggtgtatgccggactgttcgatggccaggaaagcgcgacactcgaactgcccgccaaccgctacgcctatgtgcacgttgctcgcggcagcgttgaactgaacggcatgcagttgaaggaaggcgacggcgtaagggttcgtgaagaacaggcactgaccctgagcaatggccaggatgccgaagtcctggtgtttgacctgcggccgcaggaactgccggaaatgccatga

SEQ ID NO: 7175 - protein, 240 aa, Pseudomonas fluorescens PfO-1
MLTLRKASDRGLANHGWLKSFHTFSFASYRDPREQGFSDLLVINDDRVAAGKGFGQHPHRDMEIFSYVLEGALEHKDTLGTGSVIRPGDVQLMSAGSGVAHSEFNHSATKPVHFLQIWIVPDVSGAKPRYQQEHFSEQKKRGRLQLIISPEGSHGSLKVRQDARVYAGLFDGQESATLELPANRYAYVHVARGSVELNGMQLKEGDGVRVREEQALTLSNGQDAEVLVFDLRPQELPEMP

SEQ ID NO: 7176 - DNA, 696 bp, Pseudomonas fluorescens PfO-1
  CDS (1)..(696): transl_table=11
atgcttgaactcagacccttcagctcgctgggcggcgcccatcacggctggttggatgcccatcaccatttttcgttcgccgagtactacgatccgcaacgcatgagctggggcaacctgcgcgtgtggaacgacgacatcattgccgccggcacgggcttccctactcacccgcaccgcgacatggaaatcatcacgtacgtgcgtgaaggtgcgatcagccaccaagacaacctgggcaacaagggccgcaccgaggctggcgacgtgcaggtcatgagcgccggcaccggaatcgcccacagcgaatacaacctggaagccacggacaccaagatcttccagatctggattctgccgaccgaaaccggcgcaccgccgtcctggggcgccaaaccgttcccgaaaggcaaccgcgaaggtttcgtgaccctcgccagcggcaaggacggtgacgatcaaagcctgcgcatccgcgccgacgcacgtttggtggcggccaatatcaaggccggggaaaccgctgaataccgtctcgatgccggacgtcgggcgtatctggttcccgctacgggtgtcattgaagtcaacggcttgcgcgcacaagctcgagacggtgtggcggtggccgatgaacaggtgttgaccgtcactgcgctggaagacagtgaaatcgtgttggtggatctggcctga

SEQ ID NO: 7177 - protein, 231 aa, Pseudomonas fluorescens PfO-1
MLELRPFSSLGGAHHGWLDAHHHFSFAEYYDPQRMSWGNLRVWNDDIIAAGTGFPTHPHRDMEIITYVREGAISHQDNLGNKGRTEAGDVQVMSAGTGIAHSEYNLEATDTKIFQIWILPTETGAPPSWGAKPFPKGNREGFVTLASGKDGDDQSLRIRADARLVAANIKAGETAEYRLDAGRRAYLVPATGVIEVNGLRAQARDGVAVADEQVLTVTALEDSEIVLVDLA

SEQ ID NO: 7178 - DNA, 726 bp, Burkholderia sp. 383
  CDS (1)..(726): transl_table=11
atgatcgaaatccgtgcagcaaaccaacgtggccgtgcggagcatggctggctcagctcccgtcattcgttttcgttcgcgaattactacgatccgaagcaagtcggcttctccgacctgctggtgatcaacgacgaccgcgtcgccccgggccgcggcttcggcacgcacccgcaccgtgacatggagatcatgtcgtacgtgctcgacggcgcgctggaacacaaggactcgatgggcactggttcggtgatcgtgccgggcgacgtgcagctgatgagcgccggcaccggcgtacgtcacagcgagttcaaccactcgccggaactgccggtccacttcctgcagatctgggtcgggccgtcggaaaagggggccgagccgcgttatcagcagaccaatgtcacggccggcgacaagcgcggcaagctcgcgctcgtcgtctcgccgaccggcgacgccggttcgctgaagatccggcaggacacgcggatctacgcgggcctgttcgacggcgatgaacgcgcgacgctggaactggcgccgaaccgctttggatacgtgcacgtggcacgcggcagcgtgacggtcaacggcgtgacgctcggcgaaggcgacggcgtgcgcatccgcgacgaacaggcgctgacgttcgccgacgggaaggatgccgaagtgctggtgttcgacctgcgtccggtcgaagtaacggccgagtgggcatga

SEQ ID NO: 7179 - protein, 241 aa, Burkholderia sp. 383
MIEIRAANQRGRAEHGWLSSRHSFSFANYYDPKQVGFSDLLVINDDRVAPGRGFGTHPHRDMEIMSYVLDGALEHKDSMGTGSVIVPGDVQLMSAGTGVRHSEFNHSPELPVHFLQIWVGPSEKGAEPRYQQTNVTAGDKRGKLALVVSPTGDAGSLKIRQDTRIYAGLFDGDERATLELAPNRFGYVHVARGSVTVNGVTLGEGDGVRIRDEQALTFADGKDAEVLVFDLRPVEVTAEWA

SEQ ID NO: 7180 - DNA, 696 bp, Burkholderia sp. 383
  CDS (1)..(696): transl_table=11
atgttccagatccgccgcgccgccgatcgcgaccagcgcagccaaggctggcacgaattccttcacagctttccttgcgcgtccggccggagcgggccgccggtgttcggcgcgttgcgcgaactgaacgaggaatgcatcgcaccgacccgcggctacgggatgcggccgtaccgcgacgcggaaatcgtcacctatgtgctcgacggcgcgctcgcgcatcgcgacagcctcggcaacggggcgattgtccgtgcgggcggcctgcagcgcatgagtgccggcaccggcgtcatgctgagcgaaaccaacgcgtcgtgtgacgagccgctgcgcctgctgcggatctggctcgcgccggccggggcggctggccggcccggctacgtgcaggcgcgctttgccgacgacgagaaacgcgggcggctgcggctggtggcggccccggacggtggcgacggcgcgctgcagatgggggcggacgcacgcatcttcgcggggctgatcgacggcgatgaagcggcggcgttcgacgtgccggccgggcgccgcgcgtacgtgcacgtggtgcgcggtgacgtcgaggtgaacggccgcgcgctgactgcgggcgacggcgcgcggatcagcggcgtggacgcggtggcgttcgggcgcggccgggcggccgaggtgctgctgttcgacgtcgcctga

SEQ ID NO: 7181 - protein, 231 aa, Burkholderia sp. 383
MFQIRRAADRDQRSQGWHEFLHSFPCASGRSGPPVFGALRELNEECIAPTRGYGMRPYRDAEIVTYVLDGALAHRDSLGNGAIVRAGGLQRMSAGTGVMLSETNASCDEPLRLLRIWLAPAGAAGRPGYVQARFADDEKRGRLRLVAAPDGGDGALQMGADARIFAGLIDGDEAAAFDVPAGRRAYVHVVRGDVEVNGRALTAGDGARISGVDAVAFGRGRAAEVLLFDVA

SEQ ID NO: 7182 - DNA, 756 bp, Synechococcus sp. CC9605
  CDS (1)..(756): transl_table=11
atgtcccggacggccccgccaccacgtcaacacgacaccacgtcaaccgtgatcctgcgacccgcagaccagcgctttcgcagccagctggactggctcgattcctggcacagcttcagcttcggcagccatcaggatccgaactggatgggcttcggccccttgcaggtgatcaacgacgacaccattgctgcaggccaggggttcggcatgcacccccaccgcgacatggaaatcatcacggtgatggtggatggggccctgacccatgccgactcgatgggcaacagcgcggtgctgcacgccggcgaagtgcagcggatgagtgccggcagcggcatcgtgcacagcgagatcaaccagaccggcgagccctgcaggctgctgcagatctggattgagccagcacagctggacatccagcctgcctaccagcagaaacccttcgcgatcggcgagggctggacgcccctgattgagcccggcgcatccggcgaggcgatggccattgaacgtcgtgtgcggctctggcgtgctcagccgctacaccaacagcagttgcccttgccccccgccgaagagcagttgctctggattcaggtgattgatggggagctgacgctcaacagtgagggctcccccaagcagtcgctgcggcggggcgatgggctgggcctgatccaggacgcagccacccaaggtgagctgatcggcctcagtgaacgcgccgacgtgctgctgtttgccctggcgtga

SEQ ID NO: 7183 - protein, 251 aa, Synechococcus sp. CC9605
MSRTAPPPRQHDTTSTVILRPADQRFRSQLDWLDSWHSFSFGSHQDPNWMGFGPLQVINDDTIAAGQGFGMHPHRDMEIITVMVDGALTHADSMGNSAVLHAGEVQRMSAGSGIVHSEINQTGEPCRLLQIWIEPAQLDIQPAYQQKPFAIGEGWTPLIEPGASGEAMAIERRVRLWRAQPLHQQQLPLPPAEEQLLWIQVIDGELTLNSEGSPKQSLRRGDGLGLIQDAATQGELIGLSERADVLLFALA

SEQ ID NO: 7184 - DNA, 696 bp, Rhodospirillum rubrum ATCC 11170
  CDS (1)..(696): transl_table=11
atgatcgagcttcgccccttcgccagccttggcaccctggatatcgactggctcaccgcccgctatcatttcagcttttcgcgttattacgatcccgcccgcatggggctgggcagcttgcgggtgtggaacgacgatcaagtgcgcgccggcaccggcttcgagccccatagccaccgcgacatggaaatcatcacctatgtccgcaagggcgcgatcacccacgaggacaacctgggcaacaagggccgcacggcggccggcgatgttcaggtgatgtgggcgggcagcggcatcacccatgccgaatacaaccgcgaaagcgaagataccttgctgttccagatctggatcgaaaccgcccggccgggcatcgctccgggctgggaagcccgggcctttcccaaggaaccgggccaagtgatcgctctcgcctcgggccgcgatctgcccgatcacgccggggccctgccgctccatcaggacgcggcgatcctcggcggcgtgctgaccccggggcagaccctgaccctgccgagcaagggccggaagctctatatcgtgccgaccaccggggccttgcgcgtcggcgatcacaccgcccgggcccgcgacggcgtggcgatctgggacgaggccgagatcaccctgacggccctggaagaaaccgaagtggtgatcgccgacgtggcctaa

SEQ ID NO: 7185 - protein, 231 aa, Rhodospirillum rubrum ATCC 11170
MIELRPFASLGTLDIDWLTARYHFSFSRYYDPARMGLGSLRVWNDDQVRAGTGFEPHSHRDMEIITYVRKGAITHEDNLGNKGRTAAGDVQVMWAGSGITHAEYNRESEDTLLFQIWIETARPGIAPGWEARAFPKEPGQVIALASGRDLPDHAGALPLHQDAAILGGVLTPGQTLTLPSKGRKLYIVPTTGALRVGDHTARARDGVAIWDEAEITLTALEETEVVIADVA

SEQ ID NO: 7186 - DNA, 726 bp, Burkholderia thailandensis E264
  CDS (1)..(726): transl_table=11
atgattgaagtcagagcagccaatcaacgcggccgcgccgagcacggctggctcagctcgcggcacacgttctcgttcgccgaatactacgatccggcgcaagtcggcttctcggatctgctcgtgatcaacgacgatcgcgtcgcgccgggccgaggcttcggcatgcatccgcaccgcgacatggagatcctgtcgtatgtgctcgaaggcgcgctcgagcatcgcgacacgatgggcacgggctcggtgatcgtgccgggcgacgtacagttgatgagcgcgggcaagggaatcgcgcacagcgaattcaaccattcagcgaccgaacccgtgcatttcctgcagatctggatcgggccgtcggtgcggggcgtcgagccgcgctatcaacaggcgcgcgtgagcgacggcgaaaagcgcgggcggttgcgtctcatcgcgtcgcccgaagggcaggacggttcggtgaagatccggcaggatgcgcgcgtctacgcgggcctcttcgacggcgatgcgagcgagcggttcgcgctgccgccgcagcgcttcgcgtatgtgcatgtcgcgcgcggatccgtgacggtcaacggcgtcgaactgcatgagggcgacggcgcgcggattcgcgacgaacatgcgctgcagatcgcgggcggcaagcaggcggaggtgctgctgttcgatctgcggccgatcgaagtcaccgccgaatgggcgtga

SEQ ID NO: 7187 - protein, 241 aa, Burkholderia thailandensis E264
MIEVRAANQRGRAEHGWLSSRHTFSFAEYYDPAQVGFSDLLVINDDRVAPGRGFGMHPHRDMEILSYVLEGALEHRDTMGTGSVIVPGDVQLMSAGKGIAHSEFNHSATEPVHFLQIWIGPSVRGVEPRYQQARVSDGEKRGRLRLIASPEGQDGSVKIRQDARVYAGLFDGDASERFALPPQRFAYVHVARGSVTVNGVELHEGDGARIRDEHALQIAGGKQAEVLLFDLRPIEVTAEWA

SEQ ID NO: 7188 - DNA, 699 bp, Burkholderia thailandensis E264
  CDS (1)..(699): transl_table=11
atgttcgagatccgccgcgcgggcgatcgcggccatgccaatcatggctggctcgatacttgccacagcttttcgttcgccgactatcgcgatcccgagcacgtgcacttcggcgcgctgcgcgtgctgaacgacgatcgcatcgcgccgacgcgcggcttcggcatgcatccgcaccgcgacatggagatcgtcacgtacgtgctcgaaggcgcgctcgcgcaccgcgacagcatgggcaacggctcgatcgtccgggcgggcgacgtgcagcggatgagcgcgggcacggggatcgtgcacagcgaatacaacgcgtcgcgggacgcgccgctgcatctgctgcagatctggctgctgccgaccgagccgggcggccggcccggctatcaggaggcgcgcttcgccgacgtcgacaaacgcggccggctgcggctcgtcgcgtcgcccgacgggcgcgacggggcggtgtcggtgcgctcggacgcgtcgatctatgcggcgctcgtcgacggcgccgagcgcgccgagttcgcgctgccggccggccggcgcgcgtacgtgcatgtcgcgcgcggcagcgtggaggtgaacggcgaggcgctcgcggcgggcgacggcgcgcggatcgccgacgtcgggaccgtcgtgttcgagcgcggcgagcatgcggaggtgttgctgttcgatctcgcgtga

SEQ ID NO: 7189 - protein, 232 aa, Burkholderia thailandensis E264
MFEIRRAGDRGHANHGWLDTCHSFSFADYRDPEHVHFGALRVLNDDRIAPTRGFGMHPHRDMEIVTYVLEGALAHRDSMGNGSIVRAGDVQRMSAGTGIVHSEYNASRDAPLHLLQIWLLPTEPGGRPGYQEARFADVDKRGRLRLVASPDGRDGAVSVRSDASIYAALVDGAERAEFALPAGRRAYVHVARGSVEVNGEALAAGDGARIADVGTVVFERGEHAEVLLFDLA

SEQ ID NO: 7190 - DNA, 768 bp, Methylobacillus flagellatus KT
  CDS (1)..(768): transl_table=11
atgcctattcagttcaatattattgaaggtcaagaaaggcacaccatgatcagtttgcgtaaagcccaggagcgcggccatgccaaccatggttggctcgacagctatcattcattttccttttccagctaccaggatcccgagcacatgcattactcggtactgcgtgtgatcaatgaggatgtgatcgcgcccggcatggggttcggcatgcacccgcaccgcgatatggaaatcatcacctacatgctcaaaggcgagttgcgccatgaggatagcctgggcaacggctcggtgattcgcgcgggcgacgtacagcgcatgagcgctggtaccggcatcgtgcacagcgaattcaacgcttctgaccgtagccaggcacatttgttgcagatatggctgttgcccgaagagggcgggatatcgcctgggtacgaggagaagcactttgccgccgaggagaagcgcgaccgctggtgcctggttgcgtcacgcgatggccgtgagggttcattgcgcattcaccaggatgttgccctgtatgcaacagtgctgtccgaaaaccagcgaatcgaatacagcatgcagcgaggacgcagcgtatacctgcatgtggtacgcggaagcctcattgtggatggattattgctggaggcgggcgatgctgccaaggtcgatgcccagcagcacattgaaatcacggcgggggaagcagcagaggtgctgttgttcgatctgccatctcatcattccgttaatcttgtgtaa

SEQ ID NO: 7191 - protein, 255 aa, Methylobacillus flagellatus KT
MPIQFNIIEGQERHTMISLRKAQERGHANHGWLDSYHSFSFSSYQDPEHMHYSVLRVINEDVIAPGMGFGMHPHRDMEIITYMLKGELRHEDSLGNGSVIRAGDVQRMSAGTGIVHSEFNASDRSQAHLLQIWLLPEEGGISPGYEEKHFAAEEKRDRWCLVASRDGREGSLRIHQDVALYATVLSENQRIEYSMQRGRSVYLHVVRGSLIVDGLLLEAGDAAKVDAQQHIEITAGEAAEVLLFDLPSHHSVNLV

SEQ ID NO: 7192 - DNA, 726 bp, Burkholderia xenovorans LB400
  CDS (1)..(726): transl_table=11
atgcttgaaatcagactcgccaatcaacgcggccgcgcggagcacggctggctcagttcgcgtcatacgttttccttcgcgaactatcacgacccgaagcagaacggcttttccgacctgctcgtcatcaacgacgaccgtgtcgcgccggcccagggtttcggcaagcacccgcaccgcgacatggaaatcttttcgtacgtgctggaaggcgcgctggaacacaaggacacgatgggcacgggctcggtgatcgtgcccggcgacatccagttgatgagcgcgggaaccggcgtcgcgcacagcgaatacaaccattcgaagagcgaaccggtgcacttcctgcaaatctggatcgcgccggggcaaaagggtacggcgccgcgttatcagcagcgccacttcggcgcggagcagaagcgcggcgtgttgcgcctcgtgctctcgccggacggcgcgaacgattcgctcgtgctgcaacaggacgcgcgcgtctatgctggcctgttcaacggcgacgagacagcgcggctcgaactggccagcaatcgctatgcttatgtacacgtggcacgcggcagcgtgagcgtgaacggcgtccagttcaacgaaggcgacggtgcacgtgtacgcggtgaagaagcgctgagcttcacgcaaggtcacgacgcagaagtgttggtgttcgacctgcgcgacatcgagatgtcggagttgtgggcctga

SEQ ID NO: 7193 - protein, 241 aa, Burkholderia xenovorans LB400
MLEIRLANQRGRAEHGWLSSRHTFSFANYHDPKQNGFSDLLVINDDRVAPAQGFGKHPHRDMEIFSYVLEGALEHKDTMGTGSVIVPGDIQLMSAGTGVAHSEYNHSKSEPVHFLQIWIAPGQKGTAPRYQQRHFGAEQKRGVLRLVLSPDGANDSLVLQQDARVYAGLFNGDETARLELASNRYAYVHVARGSVSVNGVQFNEGDGARVRGEEALSFTQGHDAEVLVFDLRDIEMSELWA

SEQ ID NO: 7194 - DNA, 711 bp, Burkholderia xenovorans LB400
  CDS (1)..(711): transl_table=11
atgttcgagattcgccgctcgcacgaacgcggccacgccaaccacggctggctcgactcgtatcacagcttttcgtttgccgactatcgcgatccccagcacgttcatttcggtccgctgcgggtcatcaacgaagaccggatcgccggcggccagggtttcggcacacatggccatcgcgatatggaaatcgtcacgtatgtgctcgaaggcgcgctggctcaccgtgacagcatgggcaacggctcgaccatccgtcccggcgacgtgcagcgcatgagcgccggcacgggcgtgcagcacagcgagttcaacgcatcgcaggatgaacccgtgcatctgctgcagatctgggtgattccgcaacgcgcgggcgaccagccgggctatgaggaaaaacgcttcgacgccgtcgacaagcgcggccgcctgcgcgtggtcgcttcgcccgatggccgcgagggctcggtgacgatccatgcggatgcgtcgatttacgcggcgctgatcgacggcgcggaaacggccacgttcgcgctgcccaaaggacggctcgcctatgtgcacatagcgcgcggcgcggtgacggtaaacggcgaggcgctccaggcgggcgacgccgcgaggctcagcgacacggatacggtgacgctggagaagggtgagaacgctgaagtgctgctgttcgatctgggtcaactcaacggctag

SEQ ID NO: 7195 - protein, 236 aa, Burkholderia xenovorans LB400
MFEIRRSHERGHANHGWLDSYHSFSFADYRDPQHVHFGPLRVINEDRIAGGQGFGTHGHRDMEIVTYVLEGALAHRDSMGNGSTIRPGDVQRMSAGTGVQHSEFNASQDEPVHLLQIWVIPQRAGDQPGYEEKRFDAVDKRGRLRVVASPDGREGSVTIHADASIYAALIDGAETATFALPKGRLAYVHIARGAVTVNGEALQAGDAARLSDTDTVTLEKGENAEVLLFDLGQLNG

SEQ ID NO: 7196 - DNA, 699 bp, Ralstonia metallidurans CH34
  CDS (1)..(699): transl_table=11
atgattgaaatccgtaaatctgaagaacgtgggtatgcggaccatggctggctcaagtcgtaccacagcttctcatttgctgattactacgacccacgccatgtccagttcaggtcgctgcgcgtgatcaacgaggaccgcgtggcgccgggcatgggcttcggcacccatgggcaccgggacatggagatcatcagctatgtgcttgaaggcgagctggcccacaaggacagcatgggcaacggcagcgtgatccgtccgggcgatgtgcagcgcatgagcgccggcacgggcgtgcgtcattcggaatacaaccacgcggcgcacgatacgacgcatttcctgcagatctggatcatgccgaacgagaccggcatcgaacccggctacgaggagaagcgcttcgaagccgccgacaagcgcggtcgcctgcgcctggtgggtagcccggacggcgccgaaggctcggtggtgatccatcaggatgtgcgcctgtacgctggcctgttcgatggcgatgaagctgccacgctgtcgttggcgccgggccgtcgcgcctatgtccacgtggcacgtgggcgtatcagcgtgaacggccaggtgctcgaggctggcgacgctgcgaagctggaagacgtggaaaccgtgaacctgtcgcaaggcagcggggccgaggtgctggtcttcgatctgtcctga

SEQ ID NO: 7197 - protein, 232 aa, Ralstonia metallidurans CH34
MIEIRKSEERGYADHGWLKSYHSFSFADYYDPRHVQFRSLRVINEDRVAPGMGFGTHGHRDMEIISYVLEGELAHKDSMGNGSVIRPGDVQRMSAGTGVRHSEYNHAAHDTTHFLQIWIMPNETGIEPGYEEKRFEAADKRGRLRLVGSPDGAEGSVVIHQDVRLYAGLFDGDEAATLSLAPGRRAYVHVARGRISVNGQVLEAGDAAKLEDVETVNLSQGSGAEVLVFDLS

SEQ ID NO: 7198 - DNA, 702 bp, Acidobacteria bacterium Ellin345
  CDS (1)..(702): transl_table=11
atgatcaccctacgccccgctgccgaacgcggccacaccaaccacggttggctcgaaacctaccacaccttctcgtttgctgattttcacgatccccggcgcatagggttccgcgagctgcgcgtcattaacgatgaccgtgtcgctgcgggcgagggcttcagcccgcactcgcatcgcgatatggagatcatcacctacatggtggaagggcaactcgaacaccgcgacaacctgggcaacggcgccgtcctcaagccgggcgatgtccagcacatgacagccggtaccggcgtggtccacagcgagttcaaccactcgcaagagaagccgctgcgcctgctccagatctggatcttcccggagaagaagggacttgtcccggattaccaggaccgtcacttcgatcctcaggaccgcgtggatcgtctgcgtctgattgcctcaaccgacggccgcgacaactcgctgatcatcaaccaggacgtggacctctatgacagctctctgacccatggcaccgaagtgcaactcgcgcttcgccccgagcgtcacgcgtggctccaggtcatcaacggcgaactggcactgaacggccaaacccttaagactggcgacggcgccgccatctccgccgaaaccgcgctcaaaatcaggggacagtcggaaaatgcagaattcctgctctttgacctgaaataa

SEQ ID NO: 7199 - protein, 233 aa, Acidobacteria bacterium Ellin345
MITLRPAAERGHTNHGWLETYHTFSFADFHDPRRIGFRELRVINDDRVAAGEGFSPHSHRDMEIITYMVEGQLEHRDNLGNGAVLKPGDVQHMTAGTGVVHSEFNHSQEKPLRLLQIWIFPEKKGLVPDYQDRHFDPQDRVDRLRLIASTDGRDNSLIINQDVDLYDSSLTHGTEVQLALRPERHAWLQVINGELALNGQTLKTGDGAAISAETALKIRGQSENAEFLLFDLK

SEQ ID NO: 7200 - DNA, 696 bp, Myxococcus xanthus DK 1622
  CDS (1)..(696): transl_table=11
atgattgccattcgcccctcggaagcccgcggtcacgccaaccacggttggctggactcccaccacaccttctccttcgccggttactacgacccggacttcatgggcttccgagccctgcgcgtcatcaacgaggaccgcgtcgcgccccatgagggcttcggtacgcaccctcaccgggacatggaaatcatcacctacccgctgagcggcgccattgcccaccgcgacagcacgggcggcgagggcctgctgcgcgccggtgaaatccagcggatgacggccggcaccggtgtgctgcacagcgagatgaacggcgcggatgagaacctccacttcctgcagatctggatcatcccggaccgcaagggcctgacgcctggctacgagcagaaggccttcccggaggccgagcgccagggccgctggcgggtggtggccagcccggacgcccgcgacggcagcctcacggtgcaccaggacgtggtgcttcacgcgacgctgctgggcacgggcgagcaggcgacgtacacgctcgctccgggccgccacgcctggctgcagttggcgcggggcaaggccacgctcaacggcgttgagttgaaggcgggggacggcgccgcggtggcggacgagtcgcagctcgtcctctccgccacggagccggtggaagcgctgctgttcgacctggcctga

SEQ ID NO: 7201 - protein, 231 aa, Myxococcus xanthus DK 1622
MIAIRPSEARGHANHGWLDSHHTFSFAGYYDPDFMGFRALRVINEDRVAPHEGFGTHPHRDMEIITYPLSGAIAHRDSTGGEGLLRAGEIQRMTAGTGVLHSEMNGADENLHFLQIWIIPDRKGLTPGYEQKAFPEAERQGRWRVVASPDARDGSLTVHQDVVLHATLLGTGEQATYTLAPGRHAWLQLARGKATLNGVELKAGDGAAVADESQLVLSATEPVEALLFDLA

SEQ ID NO: 7202 - DNA, 729 bp, Cytophaga hutchinsonii ATCC 33406
  CDS (1)..(729): transl_table=11
atgaacaaagaagcacatacacgaatacataaagcagacagcagaggagctgcagatcacgggtggttaaaagccagacacacattcagttttgccggttattatgatgaagaccgggagcagttcggtgcgttgcgtgtattgaatgatgacattattggggcgggttatggctttggaatgcatccgcataacaacatggaaattataaccattccgttggaaggcgcattacggcataaagatagtatggggcatacctcagttattaaagcaggggatgtgcaggttatgtctgcaggcaaaggtttaacacattcagagtataatgcatctgaaacggattccttaaatctgttacagatctggttgtttccgaaaagcagaaacatagagccccgttacggagaaaccacctttgatgtaacaaaaatggaaggtgaatggctgaatgtagtagcacctttgggagataaatctgatgcgttgcagatcaatcaggatgcctggttttcattgggaaaatttcaaaaaggaaaaacagtttcctattcaaaaaagcgtgcaggcaacggattatatgtttttgtaattgaaggagaagttactgttggagaagaggttctttcgcgtagagacgccattggaattacagagacagatagcattgaattaacggcagccgatcatgcttatgtgttgattatggatgtacctatggatgtgtaa

SEQ ID NO: 7203 - protein, 242 aa, Cytophaga hutchinsonii ATCC 33406
MNKEAHTRIHKADSRGAADHGWLKARHTFSFAGYYDEDREQFGALRVLNDDIIGAGYGFGMHPHNNMEIITIPLEGALRHKDSMGHTSVIKAGDVQVMSAGKGLTHSEYNASETDSLNLLQIWLFPKSRNIEPRYGETTFDVTKMEGEWLNVVAPLGDKSDALQINQDAWFSLGKFQKGKTVSYSKKRAGNGLYVFVIEGEVTVGEEVLSRRDAIGITETDSIELTAADHAYVLIMDVPMDV

SEQ ID NO: 7204 - DNA, 807 bp, Cytophaga hutchinsonii ATCC 33406
  CDS (1)..(807): transl_table=11
atgggtaacgttatgcagaacaatatcgatgaactcaaggaacttgaaattttaggattcaatcatattcccaatactcaatcaacacatatggaaaatgctgtactgcataaagctgaaacacgcggagacgcgaatcatgggtggctgcacagcaaacatacattcagttttgcaaattattacaatcccgaacgcatgcacttcggagtgctgcgtgtattaaatgatgatgttgtttccggtggaaaaggttttggaacacatccgcatgacaacatggaaatcatcagcattccgctggaaggagatctggagcataaggacagtatgggtaatgttacggttatccgtaatggagatgtacaggtaatgtctgccggcaccggcattcaacacagcgagtataataagaatgccgataagcaggtgaagtttttacagatctgggtgtttccggataaaaaaaatgtgacgcctcggtacgaccagattaccttacaacgggcccaccggcataatacatttcagcagatactttcaccagacccggaagatgccggcgtatggattcatcagcatgcctggtttcatttagcccaatttgatgccaatcatacacaggtttataaaatgaaagataaagtaaacgggttgtatgtattcaatctgaatggcagcattactgtgaataaccagatattaaacgcacgggatggttatggtatctggaacgtagaacaggtaagtattaaagcggattccgcatcagagtttctgttgatggaagtgccaatgacagtttga

SEQ ID NO: 7205 - protein, 268 aa, Cytophaga hutchinsonii ATCC 33406
MGNVMQNNIDELKELEILGFNHIPNTQSTHMENAVLHKAETRGDANHGWLHSKHTFSFANYYNPERMHFGVLRVLNDDVVSGGKGFGTHPHDNMEIISIPLEGDLEHKDSMGNVTVIRNGDVQVMSAGTGIQHSEYNKNADKQVKFLQIWVFPDKKNVTPRYDQITLQRAHRHNTFQQILSPDPEDAGVWIHQHAWFHLAQFDANHTQVYKMKDKVNGLYVFNLNGSITVNNQILNARDGYGIWNVEQVSIKADSASEFLLMEVPMTV

SEQ ID NO: 7206 - DNA, 690 bp, Haemophilus somnus 129PT
  CDS (1)..(690): transl_table=11
atgttttatattagaaaatccaatgaacgtggtcatgccaatcatggttggctagacagttaccatactttttcattcgccggctactatgatcctacatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttaccaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggtactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaa

SEQ ID NO: 7207 - protein, 229 aa, Haemophilus somnus 129PT
MFYIRKSNERGHANHGWLDSYHTFSFAGYYDPTFMGFSSLRVINEDRVKAGFGFGTHPHKNMEILSYVLEGTIAHQDSMGNVQTISAGECQIMSAGTGITHSEFNPSSTENLHFYQIWIQPNELNIAPRYEQKAFAHHEGATLILSPHAENGAFKIYQDMKLWRYQLRAGTQTDITLDSNRSYWIQVVKGTFFINGQTVSTSDGVAINQERLAKIETENDIEFLIFDLA

SEQ ID NO: 7208 - DNA, 738 bp, Trichodesmium erythraeum IMS101
  CDS (1)..(738): transl_table=11
atggttcaactacaagaggtagaaaaggttaaagtacgaaaaggtacagaaagaggaggcgcaaatcatggttggctcaatactaagcatacattttcttttgcaaattattttgatcccaaacacatgggttttcgttgcctcagagtaattaatgaagatacggttactcctggtaatggtttcggaactcatggacatcgagatatggaaattattacttatgtcttagaaggatcattagaacataaagatactataggtcaaggtggtgtattatctcctggagatgtacaacacatgagtgcaggtacaggaattatgcacagtgaatataaccgctcaacatcagaaaatgttcattttttacaaatatggctactgccaaaggctaatgctgtaaaaccagtatatcatcaaagctcttttaatatagaaaaaaactctggtaagttaaacttagtagttgctgtagatggtagggatggcgcactaaaagttaatcaagatgtggatttatttgcaagtgttttgagagagggcgatcgcatttcttattcttttaaagataaccgttatggatgggtgcaagtggctcgtggggaagtagatattgaagtagatactaataacaaattatctctcaacgctggagatggtgttgctttaagtgaaatccaaaatatttctatttcaactaagtccaatggagaaattcttttatttgatttgccataa

SEQ ID NO: 7209 - protein, 245 aa, Trichodesmium erythraeum IMS101
MVQLQEVEKVKVRKGTERGGANHGWLNTKHTFSFANYFDPKHMGFRCLRVINEDTVTPGNGFGTHGHRDMEIITYVLEGSLEHKDTIGQGGVLSPGDVQHMSAGTGIMHSEYNRSTSENVHFLQIWLLPKANAVKPVYHQSSFNIEKNSGKLNLVVAVDGRDGALKVNQDVDLFASVLREGDRISYSFKDNRYGWVQVARGEVDIEVDTNNKLSLNAGDGVALSEIQNISISTKSNGEILLFDLP

SEQ ID NO: 7210 - DNA, 735 bp, Synechococcus sp. CC9311
  CDS (1)..(735): transl_table=11
atgactacgtcccaaagcacaacccatccagcactggtgttccgtccagcccaagaacgctttcacagcgttcttgactggctcgagtcatggcatagcttttccttcgcgggtcatcacgatcccaactggatgagcttcggacctctacgcgtcgtcaatgacgacacgatttctgccggtcgtgggtttggcatgcattcccatcgcgacatggagatcatcacggtgatggtcgagggggaactccaacaccaggattcggccggaaaccatggcgtcattcaggctggagatgtgcagcgcatgagcgccggaaccggaatcatgcacagcgaaatcaatcaaagcgaccaaacctgccggttgctgcagatctggatcgaacccagccaacaaggactcgatcccgcctatgagcaaagaaagattgccctaaccgatcaggaatggatcccagtgctggatccaaacaacagcgaagccatggcgattgcgcgaccgattcagctctggcgcctacggcttgcccaaggcgaaagcatccaacttccagaactcgcctatccacaggcctggattcagatgatcaacggagcgatctcgatctcaggtggaaccgctgcaaatctttgccaaggcgatgggcttggatttcatccaacccaagcagagatcaaccaaatccactcctcgagcaatcaaaccgacttactcctgtttggattgatctaa

SEQ ID NO: 7211 - protein, 244 aa, Synechococcus sp. CC9311
MTTSQSTTHPALVFRPAQERFHSVLDWLESWHSFSFAGHHDPNWMSFGPLRVVNDDTISAGRGFGMHSHRDMEIITVMVEGELQHQDSAGNHGVIQAGDVQRMSAGTGIMHSEINQSDQTCRLLQIWIEPSQQGLDPAYEQRKIALTDQEWIPVLDPNNSEAMAIARPIQLWRLRLAQGESIQLPELAYPQAWIQMINGAISISGGTAANLCQGDGLGFHPTQAEINQIHSSSNQTDLLLFGLI

SEQ ID NO: 7212 - DNA, 696 bp, Shewanella sp. MR-4
  CDS (1)..(696): transl_table=11
atgatccgtttacgtaaagcgcaggaccgtgggcaggctgatttaggctggttaaagagccaacataccttctcgtttgcaagttactacgatccacagcatatgggcgtgtcttccctacgagtcattaatgatgacagagtcgcgccgggcgcagggtttgaaacccatggccataaagatatggaaatcatcagttatgtgatttcaggcaccattgcccataaggatagcttcggtaatgttaagaccttaccagcgggtgagtttcagttaatgtctgctggtaaagggatttatcatagcgagtttaatgcatcaaacactgagtctctgcactttttgcagatctggatccagccagacaccttaggcattgatgcgggttatcagcaaaaggccttcgagcaaacctcggcgctgaccgccgtggtcaccccaacgggtgaaaatggcaccttgaaagtacagcaggatgcaaccttgtatcgcctcatgctggcaccgcaagagcaagtgcatatgccgcagcttaagccacagcgtcagctctatgtgcaactggtggaaggtacgcttaaggtcaatgaccaagtgctcacccctggggatggcgcacatatcaccgccgaagaagcggttcgatttagtgccgctggcggctatgtcaccgccctagtgtttgacttagcctga

SEQ ID NO: 7213 - protein, 231 aa, Shewanella sp. MR-4
MIRLRKAQDRGQADLGWLKSQHTFSFASYYDPQHMGVSSLRVINDDRVAPGAGFETHGHKDMEIISYVISGTIAHKDSFGNVKTLPAGEFQLMSAGKGIYHSEFNASNTESLHFLQIWIQPDTLGIDAGYQQKAFEQTSALTAVVTPTGENGTLKVQQDATLYRLMLAPQEQVHMPQLKPQRQLYVQLVEGTLKVNDQVLTPGDGAHITAEEAVRFSAAGGYVTALVFDLA

SEQ ID NO: 7214 - DNA, 696 bp, Hyphomonas neptunium ATCC 15444
  CDS (1)..(696): transl_table=11
atgatcgaactccgcccctttgataagcttggccggtttcgcaatgactggctcaacgcccattatcacttttccttctccggctatcatgaccccagccgcgtgaaccatggcgcgctgcgcgtgtggaatgatgacgaaatccagccacggaccggctttccgccgcacgggcacgactccatggaaatcatcacttacgttcgcaagggcgccatcacccacaaggactcgctgggcaatcatggccgcaccgaagcgggcgatgtgcaggtgatgagcgcgggctctggcgtgcagcattcggaatggaacgccgaggacgaagtgaccgagctgttccagctgtggatcattccccgcacacgcggtggcacacccagctggggcgcgcggaagtttcccaagggcgaccggtctggccaatgggccgtgtttgcctcgggcaccggagagaatgacgccctggcgatcaaccaggacgcaaaggttctgggcgccacggtgaaggaaggcgaaacgctgacctatgacattcccaaaggccgctacgggtatctggttgtagccgatggcgaggtgacgctgaatggccagcggctgaagacccgcgacggcgcggcgatttccggcggcgagacgattaccctggaaggggtgaattcggcagagctcgtactggttgatacggtgtga

SEQ ID NO: 7215 - protein, 231 aa, Hyphomonas neptunium ATCC 15444
MIELRPFDKLGRFRNDWLNAHYHFSFSGYHDPSRVNHGALRVWNDDEIQPRTGFPPHGHDSMEIITYVRKGAITHKDSLGNHGRTEAGDVQVMSAGSGVQHSEWNAEDEVTELFQLWIIPRTRGGTPSWGARKFPKGDRSGQWAVFASGTGENDALAINQDAKVLGATVKEGETLTYDIPKGRYGYLVVADGEVTLNGQRLKTRDGAAISGGETITLEGVNSAELVLVDTV

SEQ ID NO: 7216 - DNA, 699 bp, Pseudomonas aeruginosa UCBPP-PA14
  CDS (1)..(699): transl_table=11
atgatcgaacgtcgtcccttcgaccgtctgggccatgccaaccacggctggctgaacgcgcgtcatcattttgccttcgccgactactatgacccggagcgcgaggactggggccgcctgcgggtctggaacgatgacgagatcgccgccggcagcggcttcccgccgcacccgcaccgcgacatggagatcattacctatgtccgcgaaggcgcgatcacccaccaggacagcctgggcaacaagggccgcaccgaggccggcgacgtgcaggtgatgagcgccggtaccggcatcgtccattcggagtacaacctggaagccgagaccacccggatcttccagatctggatcatcccggaccgccgcggcgaccagccgcgctggggctccaaaccgttcccgaaggccgagcgcgacggtcgtttcgtcactctcgccagcggcgacgagcaggacagcgaagcgctgcacatccgcgccgacgccgaggtcgccgcggtgaccctgaaggccggccagagcgccgagtacgccctggaaaacggtcgccgcgcctacctggtgccggccaccggcagcatcgaggtcaacggcgtgcgcgccgaggcccgcgatggcctggcggtacgcgacgaaccgaccctgaaggtcacggccctggaagacagcgaagtgctgctggtggaagtggcctga

SEQ ID NO: 7217 - protein, 232 aa, Pseudomonas aeruginosa UCBPP-PA14
MIERRPFDRLGHANHGWLNARHHFAFADYYDPEREDWGRLRVWNDDEIAAGSGFPPHPHRDMEIITYVREGAITHQDSLGNKGRTEAGDVQVMSAGTGIVHSEYNLEAETTRIFQIWIIPDRRGDQPRWGSKPFPKAERDGRFVTLASGDEQDSEALHIRADAEVAAVTLKAGQSAEYALENGRRAYLVPATGSIEVNGVRAEARDGLAVRDEPTLKVTALEDSEVLLVEVA

SEQ ID NO: 7218 - DNA, 702 bp, Solibacter usitatus Ellin6076
  CDS (1)..(702): transl_table=11
atgatcacaattcgaaagagcgacgaacgcggccacgccaatcacggctggttgaacacatttcacaccttctcattcgcgagttactacgacccgaaacacatgggcttcgggccgctgcgcgtgatcaatgaagatcgcgtgagccccggcaggggtttcgggtcgcacggccacgaggatatggagattctcacctacgtgatttcgggcgcgctggcccacaaagacagcatggggaatgtcgagacgctgcaagccaatgacctgcaacggatcacggcgggcaccggaatcgtacacagcgagttcaacggcagcgcgaaagatccggtccactttttgcagatctggattcaacccgcggagtataacttgacccccggctatgaacaactctctctcaccgagacggagaaaagcggcaagctgcgcctggtggcctcaccggaaggaggcaacggcgcgctgaagatcaaccaggacgcgcgggttctgatcggccaggcgggtgaggcggaggctctcgagtatgcgctgccggctggacgcaaggcgtgggtccacgtgatccgcggctcggcatcggtgaacgaccagctcctcctggcaggggatgcggctgcgattaccgacgaaagctccatcgcgattcggggtgacgacccgggagcggaggtgctactgttcgacttgaagtaa

SEQ ID NO: 7219 - protein, 233 aa, Solibacter usitatus Ellin6076
MITIRKSDERGHANHGWLNTFHTFSFASYYDPKHMGFGPLRVINEDRVSPGRGFGSHGHEDMEILTYVISGALAHKDSMGNVETLQANDLQRITAGTGIVHSEFNGSAKDPVHFLQIWIQPAEYNLTPGYEQLSLTETEKSGKLRLVASPEGGNGALKINQDARVLIGQAGEAEALEYALPAGRKAWVHVIRGSASVNDQLLLAGDAAAITDESSIAIRGDDPGAEVLLFDLK

SEQ ID NO: 7220 - DNA, 696 bp, Shewanella sp. ANA-3
  CDS (1)..(696): transl_table=11
atgatccgtatacgtaaagcgcaggaccgtgggcaggctgatttaggctggttaaagagccaacataccttctcgtttgccagctactacgatccacagcatatgggcgtgtcttccctacgagtgattaacgatgacagagtcgcgccgggcgctgggtttgaaacccatggtcataaagacatggaaatcatcagttatgtgatttcaggcaccatagcccataaggacagctttggtaatgttaagaccttaccagcgggagagttccagctaatgtccgccggtaaagggatttaccacagcgagtttaatgcatcaaacactgagtcactgcactttttgcaggtctggatccaaccagataccttaggcattgatgcgggttatcagcaaaaggccttcgagcaaacctcggcgctgaccgcagtagtcaccccaacgggtgaaaatggcaccttaaaagtgcagcaagatgcaaccttgtatcgcttaatgctgacaccgcaagagcaagtgcatatgccgcagcttaagccacagcgtcagctctatgtgcaattggtggaaggtacacttaaggtcaatgaccaagtgctcaccccaggggatggcgcacatatcaccgccgaagaagtggttcgatttagcgccgccgacagctatgtcaccgcactggtgtttgacttagcctga

SEQ ID NO: 7221 - protein, 231 aa, Shewanella sp. ANA-3
MIRIRKAQDRGQADLGWLKSQHTFSFASYYDPQHMGVSSLRVINDDRVAPGAGFETHGHKDMEIISYVISGTIAHKDSFGNVKTLPAGEFQLMSAGKGIYHSEFNASNTESLHFLQVWIQPDTLGIDAGYQQKAFEQTSALTAVVTPTGENGTLKVQQDATLYRLMLTPQEQVHMPQLKPQRQLYVQLVEGTLKVNDQVLTPGDGAHITAEEVVRFSAADSYVTALVFDLA

SEQ ID NO: 7222 - DNA, 687 bp, Azoarcus sp. BH72
  CDS (1)..(687): transl_table=11
atgatccaggtccgtcccgccgccagccgcggccacgcccatttcggctggctcgacagccgccacaccttttccttcggcagctaccacgatccgcagcacatgggcgtctccgcgctgcgggtgatcaacgacgaccgcgtcgaaccgggcgccggcttttccgcccacccgcaccgcgacatggaaatcatcagctacgtgctcgaaggcaccatcgagcacaaggacagcctcggctcgcacagccggctgaaggcgggcgaactgcaggtgatgagcgcaggcaccggcatcgtgcatagcgaatacaacccgtcggccagcgacggcctgcacttcctgcagatatggatccagcccgacacccgcggcgtcacaccgcgctacgagcagcacgacatctcgtcgctgcgcgggctgcagctggtggtgtcgccggacgggcagggcggttcgctgcgcatccaccaggacgcgcgggtgtggctggcccgcttcgacggcgcgccgctcggcttcgcgccggtggccgggcgcagctactacctgcaggtggcgcgcggcgaggtcacggtgaatggaatcgcgctcgcggccggcgatggcgccaccctcaccggcgaggccgagttgcaactgagcggcgcggccggggcggaggcgctgttgttcgatctgccgtga

SEQ ID NO: 7223 - protein, 228 aa, Azoarcus sp. BH72
MIQVRPAASRGHAHFGWLDSRHTFSFGSYHDPQHMGVSALRVINDDRVEPGAGFSAHPHRDMEIISYVLEGTIEHKDSLGSHSRLKAGELQVMSAGTGIVHSEYNPSASDGLHFLQIWIQPDTRGVTPRYEQHDISSLRGLQLVVSPDGQGGSLRIHQDARVWLARFDGAPLGFAPVAGRSYYLQVARGEVTVNGIALAAGDGATLTGEAELQLSGAAGAEALLFDLP

SEQ ID NO: 7224 - DNA, 702 bp, Acidovorax sp. JS42
  CDS (1)..(702): transl_table=11
atgctgacccttcgcaaatcgcaagatcgcggccacgcagaccacggctggctccattcgtaccacagcttctcgttcgcgggctactacgacccgcgccacatgggctggggcaacctgcgcgtcatcaacgaggaccgcatcgcgccgggcacgggcttcggcacccatggccaccgcgacatggagatcatcagctacgtgctgtccggcgaactggcgcaccaggacagcatgggcaacgtcaagggcattccgcccggcgacgtgcagcgcatgagcgccggcacgggcgtgatgcacagcgagttcaaccacgccgagggccagcagacgcactttctgcagatctggatcgagcccaatgtgcgtggcatcgcgccgagctatgagcaaaagcgctttcccgatgccgacaagcgcggccagttgcgtcgcgtggcctcgcccgacggcgcgcaaggctcggtcacgatccatgccgacgccacgctgtacgcgggcctgttcgacggtgctgaggcggcgcaactgcccattgccgcagggcgcaaagcctacgttcacctgatccgcggtacgctgcaggtcaacggacagcatctgagcgggggcgacgcggccctgctggataacgaaagcagcgtgaccctgtccgggggaagcgatgccgaagttctggtttttgatctcgccgcgtga

SEQ ID NO: 7225 - protein, 233 aa, Acidovorax sp. JS42
MLTLRKSQDRGHADHGWLHSYHSFSFAGYYDPRHMGWGNLRVINEDRIAPGTGFGTHGHRDMEIISYVLSGELAHQDSMGNVKGIPPGDVQRMSAGTGVMHSEFNHAEGQQTHFLQIWIEPNVRGIAPSYEQKRFPDADKRGQLRRVASPDGAQGSVTIHADATLYAGLFDGAEAAQLPIAAGRKAYVHLIRGTLQVNGQHLSGGDAALLDNESSVTLSGGSDAEVLVFDLAA

SEQ ID NO: 7226 - DNA, 702 bp, Magnetospirillum magnetotacticum MS-1
  CDS (1)..(702): transl_table=11
atgacccttcatctgcgccccgccgcccaacgcggccacgccaatcacggctggctggacagccgccataccttttctttcgccgactatttcgatccggcccatatgggtttccgggcccttcgggtgatcaacgaggattgggtggcccccgaaaccgggttcgacacccatccccaccgcgacatggagatcctgacctatgtgatcaacggcaccgtcgagcataaggacagcacgggcgcgcatagcctgacccggcgcggcgaggtccaggccatgaccgccggaaccgggatccgtcactcggaaatgaatccgctttcggaccagaccctgcaccttttgcagatctggatactgccggaggcgcaacggctgacccccggctacagtcaggccgtcttcaacgatgaatccaagcgcgacaatctgcgcctgatcgcctcgcgccatgggcgcgacggttcgctgatcctgcaccaggatgtggccatctatgccagcatcctcagccccggccacactcttacccaccatctggcggacggccgcggcgcctggattcaggtggtggcagggaccttggtgatcaatggtcaagtcctggcggccggcgacggcgcggccatcgaggacgaggcaaagctggccctgtcttcggaaagcggggccgagttccttctgttcgatctggggtga

SEQ ID NO: 7227 - protein, 233 aa, Magnetospirillum magnetotacticum MS-1
MTLHLRPAAQRGHANHGWLDSRHTFSFADYFDPAHMGFRALRVINEDWVAPETGFDTHPHRDMEILTYVINGTVEHKDSTGAHSLTRRGEVQAMTAGTGIRHSEMNPLSDQTLHLLQIWILPEAQRLTPGYSQAVFNDESKRDNLRLIASRHGRDGSLILHQDVAIYASILSPGHTLTHHLADGRGAWIQVVAGTLVINGQVLAAGDGAAIEDEAKLALSSESGAEFLLFDLG

SEQ ID NO: 7228 - DNA, 717 bp, Nostoc punctiforme PCC 73102
  CDS (1)..(717): transl_table=11
atgtctcaaaatacaattacccacttaattcacgatcgcaatgcccgtggtcacgcgaaaatgggctggctcgatagctatcacacattttctttcggtagtttttacgatcccaaccgtatgggatttcgctctctgcgcgtgattaacgacgatcgcatcgctcccggtgcaggattccctacccacagtcatcgtgacatggaaatcctcacttatgtgttagaaggtgctgtagagcataaagacagcttggggactggttcggtaattcgccccggtgatgcccaaattatgagtgctggaactggaatcagccacagcgaatttaatccttcaccaactgaaccactgcacttactgcaaatctggattcttcccgatcgagaaggaataacgccaagatacgaacaaaaagcttttcctctcgaagaaaagcgcggtaaactccgcttaattgcctctaaagatgggcgcgatggtgctgtaacaattcaccaagatgttgagctatatacatctgttttagagtcaggtgatgttgttaattatcaagtcaaaagcgatcgctatgcctggttacaagtagcccaaggtatagtcgatttaaatggagaagaactcagagccggcgatggtgtgcaaatcaatggcgaagaacagctagaaattagcaccaacatcggcggcgaaatcttgcttttcgatttaggctaa

SEQ ID NO: 7229 - protein, 238 aa, Nostoc punctiforme PCC 73102
MSQNTITHLIHDRNARGHAKMGWLDSYHTFSFGSFYDPNRMGFRSLRVINDDRIAPGAGFPTHSHRDMEILTYVLEGAVEHKDSLGTGSVIRPGDAQIMSAGTGISHSEFNPSPTEPLHLLQIWILPDREGITPRYEQKAFPLEEKRGKLRLIASKDGRDGAVTIHQDVELYTSVLESGDVVNYQVKSDRYAWLQVAQGIVDLNGEELRAGDGVQINGEEQLEISTNIGGEILLFDLG

SEQ ID NO: 7230 - DNA, 690 bp, Haemophilus somnus 2336
  CDS (1)..(690): transl_table=11
atgttttatattagaaaagccaatgaacgtggtcatgccaatcatggctggctagacagttaccatactttttcattcgccggctactatgatcctaaatttatgggattttcatcattgcgggtcattaatgaagatcgagtcaaagcagggttcggttttggtacacacccacataaaaatatggaaattctttcttatgttttggagggaacgattgcacatcaagatagtatgggaaatgtgcaaacaatttcagcaggtgaatgtcaaattatgtctgcgggtacgggcataacgcattcagaatttaatccaagcagtacagaaaatttacatttttaccaaatttggattcagccgaatgagttaaatattgctccacgttatgaacaaaaagcgtttgctcatcacgaaggtgcaactttgattttgtcacctcatgcggaaaatggggcattcaaaatttatcaagatatgaaattatggcgttatcaattaagagcaggtactcaaactgatattacgttggatagtaaccgctcttattggatacaagttgttaaaggcactttctttatcaatggtcaaacagtttcaacaagtgatggtgtggcaattaaccaagaacgtttagcgaagattgagacggaaaatgatattgagtttttgatatttgatttggcttaa

SEQ ID NO: 7231 - protein, 229 aa, Haemophilus somnus 2336
MFYIRKANERGHANHGWLDSYHTFSFAGYYDPKFMGFSSLRVINEDRVKAGFGFGTHPHKNMEILSYVLEGTIAHQDSMGNVQTISAGECQIMSAGTGITHSEFNPSSTENLHFYQIWIQPNELNIAPRYEQKAFAHHEGATLILSPHAENGAFKIYQDMKLWRYQLRAGTQTDITLDSNRSYWIQVVKGTFFINGQTVSTSDGVAINQERLAKIETENDIEFLIFDLA

SEQ ID NO: 7232 - DNA, 696 bp, Bacillus cereus G9241
  CDS (1)..(696): transl_table=11
atgtttagaaaagttgatcataaaaatatgggaagagcaaatcacggttggttaaatacacattttcatttttcatttgcgaattattataatcctaataacatgaacttcggtgcattacgtgtaattaatgatgacttagtagcaccgcaaactggctttgatatgcatccccaccgcgatatggaaatcatttcgtacgttgtagatggtgctttaacacatgaagatagcatggggaaccgcggaacaattgagcgaggacatgttcaatatatgagtgctggcacaggtgtatttcatagtgagcataatttaggaaatgaaacactacgtttattacaaatttggattttaccagatcgtgcggatcataaaccaaactatggtgagtttacatttgattggagcaagcgtgaaaatgaatggtttcatatggtatcaccaatagaaggcggggcaccaattcaaattcaccaagatgcaaatttatattctttatcgttagatgctggaaaagaaattcattttcctgtgaaagaaggccgtcaattgtaccttgtacaaattgaaggaagtagtgtaataaatggtgagacacttgttatgcgtgatgcggcagaagtgatagaagaagatattcatattgtagcgaaagagcaatcacactatttagcaattgaattgaaaaagtaa

SEQ ID NO: 7233 - protein, 231 aa, Bacillus cereus G9241
MFRKVDHKNMGRANHGWLNTHFHFSFANYYNPNNMNFGALRVINDDLVAPQTGFDMHPHRDMEIISYVVDGALTHEDSMGNRGTIERGHVQYMSAGTGVFHSEHNLGNETLRLLQIWILPDRADHKPNYGEFTFDWSKRENEWFHMVSPIEGGAPIQIHQDANLYSLSLDAGKEIHFPVKEGRQLYLVQIEGSSVINGETLVMRDAAEVIEEDIHIVAKEQSHYLAIELKK

SEQ ID NO: 7234 - DNA, 717 bp, Croceibacter atlanticus HTCC2559
  CDS (1)..(717): transl_table=11
atgaaaaaagtacatcatccttctcaaacacgtggaaaagctgactttggttggcttaaagcaaattactcttttagctttgcaagttactttaatccagaacgtgtgcagtttggtatgttaagagttttaaatgatgataccataggtcctggacaaggttttggaacacatcctcatgacaatatggaaattgtgaccataccactttctggttcattagcacataaagactctatgaatcatgaagaagtaattcattctggtgaaattcaggttatgagtgctggtactggtgtaactcatagtgagtataatgctagccaaacagaagctaccaacctattacaactttgggtatttcccgaacgtaaaaatgtagagcctcgttacgatcaaaaagcatttgattttaaaagtcgtaagaatgagttagtcactgtggtatctccaaaagatgcagatttaactgatgcactttggctaaaccaacaaacctattttaatttaggcgaatttgacaacaaccaaaccattgactacaaactacataaaaaaaaccacggcgtttatattttcgtaattaaaggtagtgctatatgtgatgacacagcattaaaaaccaaggatgcgttaggcatctgggagacagaaagcgtgtctataacaacaacttctgaagccaagattttggtgatagaggttcctatgaattaa

SEQ ID NO: 7235 - protein, 238 aa, Croceibacter atlanticus HTCC2559
MKKVHHPSQTRGKADFGWLKANYSFSFASYFNPERVQFGMLRVLNDDTIGPGQGFGTHPHDNMEIVTIPLSGSLAHKDSMNHEEVIHSGEIQVMSAGTGVTHSEYNASQTEATNLLQLWVFPERKNVEPRYDQKAFDFKSRKNELVTVVSPKDADLTDALWLNQQTYFNLGEFDNNQTIDYKLHKKNHGVYIFVIKGSAICDDTALKTKDALGIWETESVSITTTSEAKILVIEVPMN

SEQ ID NO: 7236 - DNA, 693 bp, Pseudoalteromonas tunicata D2
  CDS (1)..(693): transl_table=11
atgttttatattcgaaagtcagaacaacggggtaaagcaaattttggttggttacaaagtttacatagcttttcatttgggcgttattacgatgcgtctcacatgggaatttctgttttacgggtaattaatgatgattttgttgctcctgcacaagggtttgatacgcatggtcatagagatatggaaattatatcgtatgtgacatcaggggcacttaagcataaagatagtcgtggtaatgagcatattgttgctcatggtgaaattcaattgatgagtgcaggaagtgggatccaacattctgaatataatgcttcacatactgaacctgtgagttttttacaaatttggattaaacctaatgtacttggtcaagtacctagttatcagcagcaacaagttatacagaagggtgcactgacgctattagtatcaccatctgggcaggataatagtttaatgataaagcaagatatgactttatcgcgcttggtattggttgataaagaagagattgaattaaatacagctaaccgtttgggttatctgcatattattagtggttcactcaatattgatactaaccaatttgtagcaggcgatgctattggatttaatccaaatcaatctatcaatattttggcaaccggtactttagaagcgctttggtttgatttgcctcttgagtga

SEQ ID NO: 7237 - protein, 230 aa, Pseudoalteromonas tunicata D2
MFYIRKSEQRGKANFGWLQSLHSFSFGRYYDASHMGISVLRVINDDFVAPAQGFDTHGHRDMEIISYVTSGALKHKDSRGNEHIVAHGEIQLMSAGSGIQHSEYNASHTEPVSFLQIWIKPNVLGQVPSYQQQQVIQKGALTLLVSPSGQDNSLMIKQDMTLSRLVLVDKEEIELNTANRLGYLHIISGSLNIDTNQFVAGDAIGFNPNQSINILATGTLEALWFDLPLE

SEQ ID NO: 7238 - DNA, 696 bp, Photobacterium sp. SKA34
  CDS (1)..(696): transl_table=11
atgatcaccgtaagacactctgaccaacgtgggcttgcaaactttggttggttaaatagcaagcattctttttcattcggccattattatgacccacaacatatgggcttctccgtactacgagttattaatgacgatattgtcacagttggtgcaggttttaacactcacggccacaaagacatggaaatcattagctatgtacttgaaggagcaatagagcacaaagacagtgaaggtaatgtgcacattctctctgccggtgaatttcagattatgtcagcaggatctgggatataccacagtgaatataatgtgtcgccaactgaacatttaaagttcttacaaatttggattaaaccgaatagcttaggcaataaacctagctacgcacaaaaagactttggtaaacaacaagggctaacaaccatagccacaccaacgggtgaagacggtactttgcttatcaagcaagacacaaaactccatcaattaatactaaagccagatagcaaattaagtatcgatatcgcaacaaaccgtaagatttacctgcatcaaattaatggcacactttctgttgatgatgttgaactaaatgcaggagatggagcaaaaatagacaatatacgtacgctcaacttagctaatcgaggacaagaaaaggtaacagcattgatatttgatttaccttaa

SEQ ID NO: 7239 - protein, 231 aa, Photobacterium sp. SKA34
MITVRHSDQRGLANFGWLNSKHSFSFGHYYDPQHMGFSVLRVINDDIVTVGAGFNTHGHKDMEIISYVLEGAIEHKDSEGNVHILSAGEFQIMSAGSGIYHSEYNVSPTEHLKFLQIWIKPNSLGNKPSYAQKDFGKQQGLTTIATPTGEDGTLLIKQDTKLHQLILKPDSKLSIDIATNRKIYLHQINGTLSVDDVELNAGDGAKIDNIRTLNLANRGQEKVTALIFDLP

SEQ ID NO: 7240 - DNA, 714 bp, Flavobacteria bacterium BBFL7
  CDS (1)..(714): transl_table=11
atgaaaacaaaagtgcatagagccgtagatagaggatatgctaatcacggatggttggaggcaaatcatagttttagttttgcaagttggtataatcctgaaaaaattaattttggtgcgctacgtgtattgaatgatgatcgaatagtaggtggagctgggtttccgaaacatcctcataataacatggaaattatcaccattccgcttagtgggaaattggagcatgaggacagtttgggtaacaaggcgcagattgccgcaggagaagttcaggtaatgagcgccggaacaggtgtgacgcattctgaatataatgcttcggaaaatgaagagttgaggttatttcaaatatggatttttcctaataaacaaaatgttgttcctaggtatgatgagcttcaattaaatctagatgatagagacaacaggctgcaacaaatattatcgccaaatcctgatgatgatggagtttggattcatcaaaatgcgtggttgtatatgagtaatctttctaaagaaaaagaactaacttatataatgaataataatggtaatggagtttttgtaatggttatcaatggtgagattattattaatgatgaaattctcggcgctagagatgctattgctatagaatgtgtagattcatttactataagatcacaacaagacgctgagctactttttatagaggtacctatgattttttaa

SEQ ID NO: 7241 - protein, 237 aa, Flavobacteria bacterium BBFL7
MKTKVHRAVDRGYANHGWLEANHSFSFASWYNPEKINFGALRVLNDDRIVGGAGFPKHPHNNMEIITIPLSGKLEHEDSLGNKAQIAAGEVQVMSAGTGVTHSEYNASENEELRLFQIWIFPNKQNVVPRYDELQLNLDDRDNRLQQILSPNPDDDGVWIHQNAWLYMSNLSKEKELTYIMNNNGNGVFVMVINGEIIINDEILGARDAIAIECVDSFTIRSQQDAELLFIEVPMIF

SEQ ID NO: 7242 - DNA, 705 bp, Oceanobacter sp. RED65
  CDS (1)..(705): transl_table=11
atggactacattcgcaaagcatcggatcgaggccatgccgactttggctggctcaatagtcatcatagcttctcttttggtagctattacgacccacgccatatggggttttccaccctacgagtgattaacgacgacactgttgcccctggtgctggttttgatacccatggtcacgccaacatggaaatcatcagctacattacccatggtcgtatcgcacacaaagacagtatggggcatgaatacgtgattcccgcgaatgacattcagcgtatgagcgcgggtacgggaattacacatagtgaatataatcacagtcagaatgatgttctaaaatttcttcaaatctggattgagccccagcagcacaacatacggcccagttatgagcaaatacagctgcctgaaaagaccggtttaacgttattgatgtcgccggaacctgaggacggcagcctagccatcaattccgatgctaggctttatcgcttaacgttggaaaaagaatcatctactaggctagagcgtcaatcactacgtacaagctatctgcatattgtatcgggtcgtgcagaaattaacggccagatgtttgaacaaggcgacggtataggtttgatgacaacagaaagcatcgagatccacagtaaaagtaatgattttgttgccctttggtttgatttacctggtatcaaagaatga

SEQ ID NO: 7243 - protein, 234 aa, Oceanobacter sp. RED65
MDYIRKASDRGHADFGWLNSHHSFSFGSYYDPRHMGFSTLRVINDDTVAPGAGFDTHGHANMEIISYITHGRIAHKDSMGHEYVIPANDIQRMSAGTGITHSEYNHSQNDVLKFLQIWIEPQQHNIRPSYEQIQLPEKTGLTLLMSPEPEDGSLAINSDARLYRLTLEKESSTRLERQSLRTSYLHIVSGRAEINGQMFEQGDGIGLMTTESIEIHSKSNDFVALWFDLPGIKE

SEQ ID NO: 7244 - DNA, 696 bp, Vibrio sp. Ex25
  CDS (1)..(696): transl_table=11
atgattacggtaagacatgcagcagaccgaggtcgagcaaactttggctggcttgatagcaaacatacgttttctttcggtagctattacgatccacaacatatgggcttttctgagctgagagtcatcaatgacgatgtagtccaacctggcgcaggttttgatacacatggccatcgtgatatggagatcatcagctatgtgctggaaggtgttatcgcgcacaaagacagcgaaggtaacgtgaaaacattacccgccggggaattccaactcatgtcggcagggaaagggatttaccacagtgagtacaatgcgtcgaaccaagatacgctgcgctttctacagatttggattcagccaaatacatttggaaccaaaccaggttatcagcaaaaagactttggtcgcacgcctggattaacaaccatcgcgactccaacaggagaaaacggtacgctacttattaagcaagatgccacattacatcagttaattcttgaaccaaatagcgaacttaactttgagatagaatcgggtagaaacttattcgttcaccaagtaacgggaagccttagcatcgacaataccaccttgacggcgggcgacggcgcgaaggtcgaacagcaaagtaaggttgttttacgcaatacatcaaacgagagcacaaccgccctgctatttgacttgccataa

SEQ ID NO: 7245 - protein, 231 aa, Vibrio sp. Ex25
MITVRHAADRGRANFGWLDSKHTFSFGSYYDPQHMGFSELRVINDDVVQPGAGFDTHGHRDMEIISYVLEGVIAHKDSEGNVKTLPAGEFQLMSAGKGIYHSEYNASNQDTLRFLQIWIQPNTFGTKPGYQQKDFGRTPGLTTIATPTGENGTLLIKQDATLHQLILEPNSELNFEIESGRNLFVHQVTGSLSIDNTTLTAGDGAKVEQQSKVVLRNTSNESTTALLFDLP

SEQ ID NO: 7246 - DNA, 699 bp, Pseudomonas putida GB-1
  CDS (1)..(699): transl_table=11
atgctgcaactgcgacccttcgaaagcctcggccacgccaaccatggctggcttgacgcccaccaccacttctccttcgccgagtactacgacccggcacgcatgcactggggcaacctgcgggtatggaacgacgacctgattgcagccggcagtggcttcccgccgcatccgcaccgcgacatggaaatcatcacctatgtacgtgaaggcgcgatcagccaccaggacagcctgggcaacaagggccgtaccgaagccggtgatgtgcaggtgatgagtgccggcaccggtatcgtgcacagcgagtacaacctggaagacgtcgatacgcgcattttccagatctggatcgtgccggagcgcaccggtgaagcaccgcagtggggtagccggccgttccccaaaggcgaacgtggcgaaggcttcgtgaccttggccagcggccgtgccggtgatgaagacagcctgcagattcgcaccgatgcacggttggtggcggccaccttgcgtgcgggtgaaaccgccgaataccgcttcgatgccgcacgccggggttacctggtgccggccaaaggcctggtcgaggtcaacgggttgcgggccaaggcgcgcgacggcgtggcgatcgagcaggaagcagtactgcgggtgaccgccatcgaagacagcgagattgtgctggtggatgtggcctga

SEQ ID NO: 7247 - protein, 232 aa, Pseudomonas putida GB-1
MLQLRPFESLGHANHGWLDAHHHFSFAEYYDPARMHWGNLRVWNDDLIAAGSGFPPHPHRDMEIITYVREGAISHQDSLGNKGRTEAGDVQVMSAGTGIVHSEYNLEDVDTRIFQIWIVPERTGEAPQWGSRPFPKGERGEGFVTLASGRAGDEDSLQIRTDARLVAATLRAGETAEYRFDAARRGYLVPAKGLVEVNGLRAKARDGVAIEQEAVLRVTAIEDSEIVLVDVA

SEQ ID NO: 7248 - DNA, 714 bp, Moritella sp. PE36
  CDS (1)..(714): transl_table=11
atgataaaacactattcttttcagcagattggcaaggcaaaccacggttggttaaaaaccaatcatcactttagctttgctaattattacaactccaaaagaatggggtttggcacgctattagtggttaatgacgactgggtcgcggcaggaacagggtttccagctcacccacacaaaaatatggaaatcattacctttgtccgctccggcgcggtcactcatcaagacaatgccggtaataaaggcgtgaccctcgcaggcgaggtgcaagtgatgagtgcgggctcaggtattactcactcagaatacaatttaacgaaagagcccttaaccctatttcaaatttggattgaaccgaataagcacaacgtaaaaccgagatgggacagcaagctgttttctgaaaatacagataatgccacgttacccttattagtttctggatacccagacgaacaagataacgcactgtttatcaatcaagcggcgcgtatctatggcggtaaggtgaagaaagacaccctgtttactcattccattgaacaccaagcctatgttttggcatccagtggagagtttgaacttatcgataatcagagggcagtaatgatgaaaacaggcgatggcgcagaagtgactaaacaacaggaagtcacgattaaagcgctatccgatgcggagatcatcattattgatgcaccagcccagtga

SEQ ID NO: 7249 - protein, 237 aa, Moritella sp. PE36
MIKHYSFQQIGKANHGWLKTNHHFSFANYYNSKRMGFGTLLVVNDDWVAAGTGFPAHPHKNMEIITFVRSGAVTHQDNAGNKGVTLAGEVQVMSAGSGITHSEYNLTKEPLTLFQIWIEPNKHNVKPRWDSKLFSENTDNATLPLLVSGYPDEQDNALFINQAARIYGGKVKKDTLFTHSIEHQAYVLASSGEFELIDNQRAVMMKTGDGAEVTKQQEVTIKALSDAEIIIIDAPAQ

SEQ ID NO: 7250 - DNA, 687 bp, Magnetospirillum gryphiswaldense
  CDS (1)..(687): transl_table=11
atgctcgaccatcgccccttcgcccgcttgggcactttcgacaacgactggctgcacgcccattaccatttcagcttcgccgattacctcaaccaccagcgtctgggctggggcgtggtgcgggtgtggaacgacgataccatcgccgcccataccggtttcgacccgcacggtcaccgcgacatggagatcgtcacctatgtgcgcgaaggcgccatcactcaccaggacagcctgggtaacgaaggccgcaccgaagccggccaagttcaggtgatgagcgccggcaccggcatccgtcacgcggaatacaaccaagaagacgggcccaccaccttgttccagatctggatcctgccgcgggcacgcggcttggcgccgcgctgggaaacccggcagtttccgcgccagccggggcaattgcaggtgttggcctcgggtttcaccgaggatgaggcccccatgatcaaccaggacgcccgcgtcttgggcggcatcatcagtcccggcgaccgcatcacccatcgcttgcgcggccagcatgcctatctggtggcggcgcgcggcaatccggtggtgaacggcatcgctctggccccacgcgacggcttggccatcacggatgaaaccagtctggacatccattgcgtcgatgaggccgagatcgtcctggtcgaaggcccgtaa

SEQ ID NO: 7251 - protein, 228 aa, Magnetospirillum gryphiswaldense
MLDHRPFARLGTFDNDWLHAHYHFSFADYLNHQRLGWGVVRVWNDDTIAAHTGFDPHGHRDMEIVTYVREGAITHQDSLGNEGRTEAGQVQVMSAGTGIRHAEYNQEDGPTTLFQIWILPRARGLAPRWETRQFPRQPGQLQVLASGFTEDEAPMINQDARVLGGIISPGDRITHRLRGQHAYLVAARGNPVVNGIALAPRDGLAITDETSLDIHCVDEAEIVLVEGP

SEQ ID NO: 7252 - DNA, 699 bp, Pseudomonas aeruginosa
  CDS (1)..(699): transl_table=11
atgatcgaacgtcgtcccttcgaccgtctgggccatgccaaccacggctggctgaacgcgcgtcatcatttttccttcgccgactactatgacccggagcgcgaggactggggccgcctgcgggtctggaacgatgacgagatcgccgccggcagcggcttcccgccgcacccgcaccgcgacatggagatcattacctatgtccgcgaaggcgcgatcacccaccaggacagcctgggcaacaagggccgcaccgaggccggtgacgtgcaggtgatgagcgccggtaccggcatcgtccattcggagtacaacctggaagccgagaccacccggatcttccagatctggatcatcccggaccgccgcggcgaccaaccgcgctggggctccaaaccgttcccgaaggccgagcgcgacggtcgtttcgtcactctcgccagcggcgacgagcaggacagcgaagcgctgcacatccgcgccgacgccgaggtcgccgcggtgaccctgaaggccggccagagcgccgagtacgccctggaaaacggtcgccgcgcctacctggtgccggccaccggcagcatcgaggtcaacggcgtgcgcgccgaggcccgcgatggcctggcggtacgcgacgaaccgaccctgaaggtcaccgccctggaagacagcgaagtgctgctggtggaagtggcctga

SEQ ID NO: 7253 - protein, 232 aa, Pseudomonas aeruginosa
MIERRPFDRLGHANHGWLNARHHFSFADYYDPEREDWGRLRVWNDDEIAAGSGFPPHPHRDMEIITYVREGAITHQDSLGNKGRTEAGDVQVMSAGTGIVHSEYNLEAETTRIFQIWIIPDRRGDQPRWGSKPFPKAERDGRFVTLASGDEQDSEALHIRADAEVAAVTLKAGQSAEYALENGRRAYLVPATGSIEVNGVRAEARDGLAVRDEPTLKVTALEDSEVLLVEVA

SEQ ID NO: 7254 - DNA, 699 bp, Caulobacter crescentus
  CDS (1)..(699): transl_table=11
atgatcgaccgcaaaccgttcgacaagcttggcggcgccgaccacggttggctgaaggccaagcaccacttctcgttcgccagctactacgaccccaacaacatgaactggggcgcgctgcgggtctggaacgacgacgagatcgccccgaacacgggctttccgccgcacccgcacagcgacatggagatcatcacctatgtccgcgacggcgcgatcacccaccaggacaaccttggcaacaagggtcgcacggtcgccggcgacgtccaggtgatgagcgcaggctctggcatccgtcacgccgagtacaatcttgagccggaaaccacccggatcttccagatctggatcgagccgaagtcgttcggcggcgcgccctcctggggctccaagccgttcccgaaaggtgaccgctcgggcaagttcgtgaccctggccagcggcttttccgacgacgccgacgccctgccgatccgcaccgacgcccgcgtgctgggcgcgacgctgaaggccggcgagacgacgacctacgccctgggcaaggatcgtagcggttatctggtgcccgccgccggcgtggtcgaggtcaacggcgtgcggctgaacgcccgcgacggcgccgggatcaaggacgaggccgtgatcaccatcaccgccctggaggacgccgagctggtgctggtcgacgcagcctag

SEQ ID NO: 7255 - protein, 232 aa, Caulobacter crescentus
MIDRKPFDKLGGADHGWLKAKHHFSFASYYDPNNMNWGALRVWNDDEIAPNTGFPPHPHSDMEIITYVRDGAITHQDNLGNKGRTVAGDVQVMSAGSGIRHAEYNLEPETTRIFQIWIEPKSFGGAPSWGSKPFPKGDRSGKFVTLASGFSDDADALPIRTDARVLGATLKAGETTTYALGKDRSGYLVPAAGVVEVNGVRLNARDGAGIKDEAVITITALEDAELVLVDAA

SEQ ID NO: 7256 - DNA, 702 bp, Pasteurella multocida
  CDS (1)..(702): transl_table=11
atgttacgcgtacgctatgcacatgaaagaggaaaaagtcatcccgcaatccactggctaaggggatatcatagtttttcctttgctgattattattctccccaacatatacacttctcacatttacgtgtgattaacgaagatattattgccccacaacacggtttcgatatgcatccgcatcaagatatggaaattttaacctatatcttgtctggcacaattgaacatcaagatagcatgggcaatcacacccaattacatgctggcgaatttcaaatcatgtcggcaggatcaggcgtgcatcacgctgaaatcaatccaagtagtgagcatgatgtccatttataccaaatctggatcttaccgaagtcaaaaggcattgcaccgcgttatgaacaaggttgctttgctgacacagaaggagcaaccttaattttatccccggaagcaaaagacggcgccttttatattcatcaagacatgtctttatggcgttggcaacttagtttagaacaaagtgcggtcaaaacgattccacttttgccaacgcggcgctattggctacaactggtaaaaggacaactccgtgtgaatgacgtcctactcaacaccagtgacggtctggcaattacacacgaaaatgtcttacagattgaactgattcaaaacagcgaatttttattgttcgatttagtataa

SEQ ID NO: 7257 - protein, 233 aa, Pasteurella multocida
MLRVRYAHERGKSHPAIHWLRGYHSFSFADYYSPQHIHFSHLRVINEDIIAPQHGFDMHPHQDMEILTYILSGTIEHQDSMGNHTQLHAGEFQIMSAGSGVHHAEINPSSEHDVHLYQIWILPKSKGIAPRYEQGCFADTEGATLILSPEAKDGAFYIHQDMSLWRWQLSLEQSAVKTIPLLPTRRYWLQLVKGQLRVNDVLLNTSDGLAITHENVLQIELIQNSEFLLFDLV

SEQ ID NO: 7258 - DNA, 699 bp, Synechocystis sp
  CDS (1)..(699): transl_table=11
atgatcacactccgcccctccgaagcccggggtcatggcaaactcgactggctagatagttatttcagcttttccttttcccattactatgaccccgcccacatgaatttctccaatctgcgggtcattaatgaagactacattgcccctggtcagggttttgccacccatggtcacaaagatatggaaattgtcacctacgtcctggagggagaactggaacacaaagatagtatcggcaatggttcaattattcgtcctggggatgtgcaacgcatgagtgcgggcaccggcatcctccacagcgaatttaatccctcccccgatcaacccgttcatctgttgcaaatttggatcactcccaatcaatttggggtagaacccagttatgagcaaaagtttttctccccggaagacaaacagggacaattaaggctagtggcatcccccgatggtcggaatggttccgttactatccaccaagatgcttgcatttatgcttccgttctggggcaaggggaaacagtcagctacagcctatctaaccgtagagcctggctacagattatccgaggcaatctgacattgaatggaaaaaccctgaaaaccggagacggagcaggcattaacgaagagcaagccatcacctgtaccggccagggggaagcaacggaatttctactatttgacctaccttag

SEQ ID NO: 7259 - protein, 232 aa, Synechocystis sp
MITLRPSEARGHGKLDWLDSYFSFSFSHYYDPAHMNFSNLRVINEDYIAPGQGFATHGHKDMEIVTYVLEGELEHKDSIGNGSIIRPGDVQRMSAGTGILHSEFNPSPDQPVHLLQIWITPNQFGVEPSYEQKFFSPEDKQGQLRLVASPDGRNGSVTIHQDACIYASVLGQGETVSYSLSNRRAWLQIIRGNLTLNGKTLKTGDGAGINEEQAITCTGQGEATEFLLFDLP

SEQ ID NO: 7260 - DNA, 702 bp, Escherichia coli O157
  CDS (1)..(702): transl_table=11
  misc_feature (174)..(174): y is t or c
atgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacytatcccaaagtcgatattttaaatgtgattctggatggagaagcagagtatcgcgacagcgaaggcaatcatgttcaggccagcgccggtgaggcgttgctgctctctacccagccgggtgtcagctacagcgaacacaatctcagcaaagacaaaccgttaacacgaatgcagctttggctggacgcctgcccgcagcgagagaatccgctgattcaaaaactggcgcttaatatgggcaagcagcatttaatcgcctcgccagagggtgcgatgggaagcctgcaattacgccagcaagtgtggctgcaccatatcgtgctcgacaaaggcgaaagtgcgaatttccagttgcatgggccacgcacgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctag

SEQ ID NO: 7261 - protein, 233 aa, Escherichia coli O157
MITTRTARQCGQADYGWLQARYTFSFGHYFDPKLLGYASLRVLNQEVLAPGAAFQPRTYPKVDILNVILDGEAEYRDSEGNHVQASAGEALLLSTQPGVSYSEHNLSKDKPLTRMQLWLDACPQRENPLIQKLALNMGKQHLIASPEGAMGSLQLRQQVWLHHIVLDKGESANFQLHGPRTYLQSIHGKFHALTHHEEKAALTCGDGAFIRDEANITLVADSPLRALLIDLPV

SEQ ID NO: 7262 - DNA, 696 bp, Escherichia coli O157
  CDS (1)..(696): transl_table=11
atgatctacttacgcaaagcaaatgaacgtggtcatgcaaatcatggctggctggactcctggcatactttctcttttgccaactattacgatccgaactttatgggcttctccgcgctgcgcgtgattaacgacgacgtgattgaagcagggcagggcttcggcactcacccgcataaagatatggaaattttgacctacgtgctggaaggtactgttgagcaccaggacagcatgggcaataaagagcaggttccggcgggcgagttccagattatgagtgcgggtacgggtattcgtcactcagagtacaacccaagcagcaccgagcgtctgcacctgtatcagatctggatcatgccggaagaaaacggcattacgccgcgttatgaacagcgtcgcttcgatgcagtgcagggcaaacaactggtgctttcgccagatgcgcgtgatggttcattgaaagtgcatcaggatatggaactgtaccgctgggcgttgctgaaagatgagcagtcggtgcatcagattgccgctgaacgccgcgtctggatccaggtggtgaaaggcaatgtcaccattaacggcgtgaaagcctcgatcagcgatggtctggcaatctgggatgagcaggcaatctccatccatgcggatagcgacagcgaagtgttactgttcgatctgccgccggtttaa

SEQ ID NO: 7263 - protein, 231 aa, Escherichia coli O157
MIYLRKANERGHANHGWLDSWHTFSFANYYDPNFMGFSALRVINDDVIEAGQGFGTHPHKDMEILTYVLEGTVEHQDSMGNKEQVPAGEFQIMSAGTGIRHSEYNPSSTERLHLYQIWIMPEENGITPRYEQRRFDAVQGKQLVLSPDARDGSLKVHQDMELYRWALLKDEQSVHQIAAERRVWIQVVKGNVTINGVKASISDGLAIWDEQAISIHADSDSEVLLFDLPPV

SEQ ID NO: 7264 - DNA, 696 bp, Escherichia coli
  CDS (1)..(696): transl_table=11
atgatctacttacgcaaagcaaatgaacgtggtcatgcaaatcatggctggctggactcctggcatactttctcttttgccaactattacgatccgaactttatgggcttctccgcgctgcgcgtgattaacgacgacgtgattgaagcagggcagggcttcggcactcacccgcataaagatatggaaattttgacctacgtgctggaaggtactgttgagcatcaggacagcatgggcaataaagagcaggttccggcgggtgagttccagattatgagtgctggtacgggtattcgtcactcagagtacaacccaagcagcaccgagcgtctgcatctgtatcagatctggatcatgcctgaagaaaacggtattacgccgcgttatgaacagcgtcgcttcgatgccgtacagggcaaacagctggtgctctcgccggatgcgcgagatggttcattgaaagtgcatcaggatatggaactgtaccgctgggcgttgctgaaagatgagcagtcggtgcatcagattgccgctgaacgccgcgtctggatccaggtggtgaaaggcaatgtcaccattaacggcgtgaaagcctcgaccagcgatggtctggcaatctgggatgagcaggcaatctccatccatgcggatagcgacagcgaagtgttactgttcgatctgccgccggtttaa

SEQ ID NO: 7265 - protein, 231 aa, Escherichia coli
MIYLRKANERGHANHGWLDSWHTFSFANYYDPNFMGFSALRVINDDVIEAGQGFGTHPHKDMEILTYVLEGTVEHQDSMGNKEQVPAGEFQIMSAGTGIRHSEYNPSSTERLHLYQIWIMPEENGITPRYEQRRFDAVQGKQLVLSPDARDGSLKVHQDMELYRWALLKDEQSVHQIAAERRVWIQVVKGNVTINGVKASTSDGLAIWDEQAISIHADSDSEVLLFDLPPV

SEQ ID NO: 7266 - DNA, 23 bp, Artificial sequence
  primer
atgattactacccgaactgccag

SEQ ID NO: 7267 - DNA, 26 bp, Artificial sequence
  primer
ttagacaggcaaatctatcagcaaag

SEQ ID NO: 7268 - protein, 273 aa, Artificial sequence
  consensus sequence
  Variant (2)..(8): Xaa in position 2 to 8 is any amino acid
  Variant (9)..(38): Xaa in position 9 to 38 is any or no amino acid
  Variant (40)..(40): Xaa in position 40 is any amino acid
  Variant (41)..(42): Xaa in position 41 to 42 is any or no amino acid
  Variant (44)..(45): Xaa in position 44 to 45 is any amino acid
  Variant (47)..(47): Xaa in position 47 is any amino acid
  Variant (50)..(52): Xaa in position 50 to 52 is any amino acid
  Variant (54)..(54): Xaa in position 54 is any amino acid
  Variant (58)..(59): Xaa in position 58 to 59 is any amino acid
  Variant (61)..(61): Xaa in position 61 is any amino acid
  Variant (64)..(70): Xaa in position 64 to 70 is any amino acid
  Variant (74)..(74): Xaa in position 74 is any amino acid
  Variant (76)..(76): Xaa in position 76 is any amino acid
  Variant (78)..(83): Xaa in position 78 to 83 is any amino acid
  Variant (86)..(87): Xaa in position 86 to 87 is any amino acid
  Variant (89)..(89): Xaa in position 89 is any amino acid
  Variant (91)..(92): Xaa in position 91 to 92 is any amino acid
  Variant (96)..(101): Xaa in position 96 to 101 is any amino acid
  Variant (103)..(105): Xaa in position 103 to 105 is any amino acid
  Variant (107)..(107): Xaa in position 107 is any amino acid
  Variant (110)..(110): Xaa in position 110 is any amino acid
  Variant (112)..(118): Xaa in position 112 to 118 is any amino acid
  Variant (120)..(121): Xaa in position 120 to 121 is any amino acid
  Variant (123)..(123): Xaa in position 123 is any amino acid
  Variant (128)..(128): Xaa in position 128 is any amino acid
  Variant (130)..(131): Xaa in position 130 to 131 is any amino acid
  Variant (135)..(135): Xaa in position 135 is any amino acid
  Variant (137)..(145): Xaa in position 137 to 145 is any amino acid
  Variant (146)..(146): Xaa in position 146 is any or no amino acid
  Variant (150)..(151): Xaa in position 150 to 151 is any amino acid
  Variant (153)..(158): Xaa in position 153 to 158 is any amino acid
  Variant (160)..(175): Xaa in position 160 to 175 is any amino acid
  Variant (176)..(179): Xaa in position 176 to 179 is any or no amino acid
  Variant (181)..(221): Xaa in position 181 to 221 is any amino acid
  Variant (222)..(226): Xaa in position 222 to 226 is any or no amino acid
  Variant (228)..(239): Xaa in position 228 to 239 is any amino acid
  Variant (240)..(245): Xaa in position 240 to 245 is any or no amino acid
  Variant (247)..(264): Xaa in position 247 to 264 is any amino acid
  Variant (265)..(269): Xaa in position 265 to 269 is any or no amino acid
  Variant (271)..(272): Xaa in position 271 to 272 is any amino acid
MXXXXXXXXXXXXXXXXXXXXXXXXXXXXXXXXXXXXXGXXXAXXGXWLXXXHXFSFXXYXDPXXXXXXXLRVXNXDXXXXXXGFXXHXHXXMEIXXXXXXGXXXHXDSXGXXXXXXXGXXQXMSAGXGXXHSEXNXXXXXXXXXXQIWXXPXXXXXXPXXXXXXXXXXXXXXXXXXXXSXXXXXXXXXXXXXXXXXXXXXXXXXXXXXXXXXXXXXXXXXXXXXXGXXXXXXXXXXXXXXXXXXDXXXXXXXXXXXXXXXXXXXXXXXLXXD

SEQ ID NO: 7269 - protein, 17 aa, Artificial sequence
  protein pattern
  Variant (4)..(4): Xaa in position 4 is any amino acid
  Variant (5)..(5): Xaa in position 5 is Ala, Ser or Thr
  Variant (6)..(6): Xaa in position 6 is any amino acid
  Variant (7)..(7): Xaa in position 7 is His or Tyr
  Variant (8)..(8): Xaa in position 8 is any amino acid
  Variant (12)..(13): Xaa in position 12 to 13 is any amino acid
  Variant (14)..(14): Xaa in position 14 is any or no amino acid
  Variant (16)..(16): Xaa in position 16 is any amino acid
  Variant (17)..(17): Xaa in position 17 is Asp, Asn or Pro
GWLXXXXXFSFXXXYXX

SEQ ID NO: 7270 - DNA, 402 bp, Escherichia coli
  CDS (1)..(402): transl_table=11
atgaaagagaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataa

SEQ ID NO: 7271 - protein, 133 aa, Escherichia coli
MKEKPAVEVRLDKWLWAARFYKTRALAREMIEGGKVHYNGQRSKPSKIVELNATLTLRQGNDERTVIVKAITEQRRPASEAALLYEETAESVEKREKMALARKLNALTMPHPDRRPDKKERRDLLRFKHGDSE

SEQ ID NO: 7272 - DNA, 462 bp, Moraxella catarrhalis
  CDS (1)..(462): transl_table=11
ttgcctacaaaaccatcaagccaccaaccacctataaaattaaataaagtgataaattttatgaaccaaacgaagcttactaaggtgcgtgctgataaatggctatgggcagcacgattttttcgcaccagaagccttgccaaagaagccatcgaagcaggcaaggtacatatgaacggtgctaaaatcaaagtcagcaaagagctacaagtcggcgatacactcaccattcgccaagggcatgcgacacgccttgaagaaaaaacaatcatcatcaaagccctatctgaaaatcggggtaatgctacccttgcagcgacattgtatgaagaaactgatgcaagcaaaactcagcgtgcttttatggctgaacaaagaaaactgcttaatttggcgcgtccagacagccggcctgataaaaagcagcgtcgagaattaaataaatttaaacaccattggtag

SEQ ID NO: 7273 - protein, 153 aa, Moraxella catarrhalis
LPTKPSSHQPPIKLNKVINFMNQTKLTKVRADKWLWAARFFRTRSLAKEAIEAGKVHMNGAKIKVSKELQVGDTLTIRQGHATRLEEKTIIIKALSENRGNATLAATLYEETDASKTQRAFMAEQRKLLNLARPDSRPDKKQRRELNKFKHHW

SEQ ID NO: 7274 - DNA, 396 bp, Mesorhizobium loti MAFF303099
  CDS (1)..(396): transl_table=11
gtgggtccgatggttgccgaaggccgccagcgcatcgacaaatggctgttcttctcgcgggcggtgaaatcgcgctcgctggcggcgaagctcgtcgtcgccgggcgcgtgcgcatcaatcgcgacaaagcagcgcaggcctccgatctggtcaagtcgggcgacgtgctgaccatcacgctcgaccggcgcattttcgtctggaaggtgctcggcgctggtgtccggcgcggcccggcggaggaagcccgcaccctctatgaggatatgtcgccgccgccgacaccgaagggcgaggcgcttcccgacgccattccggcgctgcgcgaggccggcagcggccgccccaccaaaagagagcgccgccagaccgaccgcctgattggcgaagattga

SEQ ID NO: 7275 - protein, 131 aa, Mesorhizobium loti MAFF303099
MGPMVAEGRQRIDKWLFFSRAVKSRSLAAKLVVAGRVRINRDKAAQASDLVKSGDVLTITLDRRIFVWKVLGAGVRRGPAEEARTLYEDMSPPPTPKGEALPDAIPALREAGSGRPTKRERRQTDRLIGED

SEQ ID NO: 7276 - DNA, 384 bp, Vibrio cholerae O1 biovar eltor str. N16961
  CDS (1)..(384): transl_table=11
gtggcaatgagttccagcgcagaagaggtgagactggataaatggctgtgggcagcaagattttacaaaacacgctcgctcgcgcgaaatatggtcgaagggggcaaagtccactataatggccagcgcgccaaacccagcaaatcggttgaaattggagcgcaaatcacattgcgtcaaggtcatgatgagaaaacgatcattattgaaaagatctcagaccaacgccgtggggcacctgaagcacaacagctctatcgcgaaacggccgaaagcatcaccaaacgtgaacgcaatgccatgatgcgccaactcaacccgagtccggatcgacgtcctgacaagaaacagcgccgagatctactcaaattcatccatcagtaa

SEQ ID NO: 7277 - protein, 127 aa, Vibrio cholerae O1 biovar eltor str. N16961
MAMSSSAEEVRLDKWLWAARFYKTRSLARNMVEGGKVHYNGQRAKPSKSVEIGAQITLRQGHDEKTIIIEKISDQRRGAPEAQQLYRETAESITKRERNAMMRQLNPSPDRRPDKKQRRDLLKFIHQ

SEQ ID NO: 7278 - DNA, 423 bp, Pasteurella multocida subsp. multocida str. Pm70
  CDS (1)..(423): transl_table=11
atggcgaaaaagaataactggcatgaaaaagaggatgatgttcgcctagataaatggctttgggctgcccgtttttataaaacacgtactttagcaaaagacatgattgatggcggtaaagtgcattataatgggcagcgcacgaaacccaataaaacggttgaaattggttgtgtgatcaaacttcgtcaaggtaatgacgaaaaagaagtggaagtgcttgcgctttctacgcaacgtcgtggggcgccagaagcacaattgttgtatcaagaaacagaaaaaagcattgaacaacgtgcgaaaatggcgattgcacgtaagattaatgcattaacgatgccgcatcctgatcgtcgcccgaataaaaaagagcggcgtgatttattgaaatttaaacatcaagatagcttttcatcttga

SEQ ID NO: 7279 - protein, 140 aa, Pasteurella multocida subsp. multocida str. Pm70
MAKKNNWHEKEDDVRLDKWLWAARFYKTRTLAKDMIDGGKVHYNGQRTKPNKTVEIGCVIKLRQGNDEKEVEVLALSTQRRGAPEAQLLYQETEKSIEQRAKMAIARKINALTMPHPDRRPNKKERRDLLKFKHQDSFSS

SEQ ID NO: 7280 - DNA, 396 bp, Pseudomonas aeruginosa PAO1
  CDS (1)..(396): transl_table=11
gtgagcgagaaagacgacgacaaggtgcgcctggacaagtggctctgggcggcgcgcttcttcaagacccgggcgctggccaaggccgcgatagagggcggcaaggtgcattgccggggcgagcggtgcaagccgagcaaggaacccagggtaggggaggagttgaccattcgtacgggcttcgacgagcgaaccgtgaccattcgcgcgcttgccgtagtccgtcgtggcgcgcaggaggcccaggctctctacgaggaaaccgcggacagcgtggaaagccgcgagcgcgcggcggccatgcgcaaggccggggcgctgggcgtacagaccgaggggcggccgagcaagaagcagcggcggcagatccaccagttgcgcggcggccaggactga

SEQ ID NO: 7281 - protein, 131 aa, Pseudomonas aeruginosa PAO1
MSEKDDDKVRLDKWLWAARFFKTRALAKAAIEGGKVHCRGERCKPSKEPRVGEELTIRTGFDERTVTIRALAVVRRGAQEAQALYEETADSVESRERAAAMRKAGALGVQTEGRPSKKQRRQIHQLRGGQD

SEQ ID NO: 7282 - DNA, 417 bp, Agrobacterium tumefaciens str. C58
  CDS (1)..(417): transl_table=11
atgggaagcaacgaacagccactggaaagcacgcgtcagcgtctggacaagtggctgttctttgctcgcatggcaaaatcgcggtcgctggcccagagttacatccagtcaggccatgtaaaggtcaacggcgctaccatccgccagcccagccacatgctgaaggcgggggacagactggacatcggctttgagcggatggacaaggtactcgtcgtcaaatccggtggagcacggcgcggaccctatgaggaagcccggcttctctatgacgatcagacgccacaacgggagccgtccgacaggctgacccctctcgagcaggcgctgcgcgagtctggtagtgggcgtccgacgaaaaaagagcgcagggcgctcgacaggtttctgtctgacagcgacggaagcaaagaatag

SEQ ID NO: 7283 - protein, 138 aa, Agrobacterium tumefaciens str. C58
MGSNEQPLESTRQRLDKWLFFARMAKSRSLAQSYIQSGHVKVNGATIRQPSHMLKAGDRLDIGFERMDKVLVVKSGGARRGPYEEARLLYDDQTPQREPSDRLTPLEQALRESGSGRPTKKERRALDRFLSDSDGSKE

SEQ ID NO: 7284 - DNA, 432 bp, Sinorhizobium meliloti 1021
  CDS (1)..(432): transl_table=11
atggaaaagcagccgccgtccgcccctgcaatgcgccagcggctcgacaagtggctgttcttcgcccggctgatcaaatcgcgctcgctcgcccagaaggcgatagaggcgggtcatgtggcggtcaacggcaagcgtgagacgcaatcgtccgcccagatcaaggccggcgacatgctcgaggtatcgctggagcggcgcgatctcgtcgtgcgcgtgctgctgcccgggtcccgccgcggcccctatgaggaagcgcgcctgctctacgaggatctgactcccgccgtgcccgccggcaggccgacgcttttcgagcaggcgacgcgcgaccgcggagcggggcggccgacaaagcgggaccgccgcgagacggaccgcttgcggccggggccggaccgcttgcggccgggggacctggaagacgactga

SEQ ID NO: 7285 - protein, 143 aa, Sinorhizobium meliloti 1021
MEKQPPSAPAMRQRLDKWLFFARLIKSRSLAQKAIEAGHVAVNGKRETQSSAQIKAGDMLEVSLERRDLVVRVLLPGSRRGPYEEARLLYEDLTPAVPAGRPTLFEQATRDRGAGRPTKRDRRETDRLRPGPDRLRPGDLEDD

SEQ ID NO: 7286 - DNA, 408 bp, Yersinia pestis CO92
  CDS (1)..(408): transl_table=11
atgaaggataaaatctccccagcggaatcagtacgtctggataaatggttatgggccgcacggttttataaaaccagagcgatcgcacgtgacatggtggatggcggtaaagtccactataacggccagcgaagcaagcccagcaagctggttgaactccatgctgaaatccgtctgcggcaagggaatgatgagcgcacggtgcgtgtcttggcgttacatagtcaacgccggggggcagaggaagcccaaacattgtatgaagaaaccgaggcgagcattgccaaccgcgagaaagtcgcacaggcacgtaaactgaatgccctgacgatgccgcatccagatcggcggccggataaaaaagaacgtcgcaatctgatcaaatttaaacaaggcgagcctgagtaa

SEQ ID NO: 7287 - protein, 135 aa, Yersinia pestis CO92
MKDKISPAESVRLDKWLWAARFYKTRAIARDMVDGGKVHYNGQRSKPSKLVELHAEIRLRQGNDERTVRVLALHSQRRGAEEAQTLYEETEASIANREKVAQARKLNALTMPHPDRRPDKKERRNLIKFKQGEPE

SEQ ID NO: 7288 - DNA, 402 bp, Salmonella enterica subsp. enterica serovar Typhi str. CT18
  CDS (1)..(402): transl_table=11
atgaaagaaaagtcctccgttgaggtcagactggataaatggctgtgggccgcgcgtttttataaaacccgcgcgctggcccgcgagatgattgaaggcggtaaggtgcattacaacggccagcgcagtaagccgagcaaaatcgtcgagctgaacgcaacccttaccctgcgtcagggaaatgacgaacggacggtgatcgttaaagccatcaccgaacagcgccgtccggccagcgaagccgtcgctctgtatgaagagacggcggaaagcgtggaaaaacgcgaaaaaatggcgcaggcgcgcaagcttaacgccctgaccatgccgcatccggccaggcgaccggacaagaaagagcgccgcgacctgttacgatttaaacacggcgacagcgaataa

SEQ ID NO: 7289 - protein, 133 aa, Salmonella enterica subsp. enterica serovar Typhi str. CT18
MKEKSSVEVRLDKWLWAARFYKTRALAREMIEGGKVHYNGQRSKPSKIVELNATLTLRQGNDERTVIVKAITEQRRPASEAVALYEETAESVEKREKMAQARKLNALTMPHPARRPDKKERRDLLRFKHGDSE

SEQ ID NO: 7290 - DNA, 402 bp, Salmonella typhimurium LT2
  CDS (1)..(402): transl_table=11
atgaaagaaaagtcctccgttgaggtcagactggataaatggctgtgggccgcgcgtttttataaaacccgcgcgatggcccgcgagatgattgaaggcggtaaggtgcattacaacggccagcgcagtaagccgagcaaaatcgtcgagctgaacgcaacccttaccctgcgtcagggaaatgacgaacggacggtgatcgttaaagccatcaccgaacagcgccgtccggccagcgaagccgtcgctctgtatgaagagacggcggaaagcgtggaaaaacgcgaaaaaatggcgcaggcgcgcaagcttaacgccctgaccatgccgcatccggacaggcgaccggacaagaaagagcgccgcgacctgttacgatttaaacacggcgacagcgaataa

SEQ ID NO: 7291 - protein, 133 aa, Salmonella typhimurium LT2
MKEKSSVEVRLDKWLWAARFYKTRAMAREMIEGGKVHYNGQRSKPSKIVELNATLTLRQGNDERTVIVKAITEQRRPASEAVALYEETAESVEKREKMAQARKLNALTMPHPDRRPDKKERRDLLRFKHGDSE

SEQ ID NO: 7292 - DNA, 396 bp, Ralstonia solanacearum GMI1000
  CDS (1)..(396): transl_table=11
atgaaggtgagcaccgacgcggatggccgcgtgcgcatcgacaaatggctgtgggcggcgcgcttcttcaagacacgctcgcaggcgaccgatgcggtggagcgtggccgcgtgcagatcaacgaccagccggtgcgtccggccaaggacgtgaagatcggcgaccgcgtgcgcgtggccgcgcatgaacagcagtgggaggtgaatgtgctggcgctggcggaagtccgcgggcccgcctcggtggcgcagaccctctacgccgagacgcaggcgagccgcttaaaacgtgtcggggcggcgcagcagcggcacctgtaccgggaacccgccacgcagatcgccggccggccgaccaagcgcgaccggcgccgcatcgataagctgggcggatga

SEQ ID NO: 7293 - protein, 131 aa, Ralstonia solanacearum GMI1000
MKVSTDADGRVRIDKWLWAARFFKTRSQATDAVERGRVQINDQPVRPAKDVKIGDRVRVAAHEQQWEVNVLALAEVRGPASVAQTLYAETQASRLKRVGAAQQRHLYREPATQIAGRPTKRDRRRIDKLGG

SEQ ID NO: 7294 - DNA, 381 bp, Corynebacterium glutamicum ATCC 13032
  CDS (1)..(381): transl_table=11
atgtcagacactgatggattacctgtccgcatcgacgcgtgggtgtgggcagttcgtttatataaaacccggtcagaggctgccgaagcctgcagggcagggcacgtcaagctaaacaacaacgcggtcaaacctgcccaacaagtggtgccaggtgaccgcgtgcgcgtgtgggtaaaccaccgcgagtttgatgtggaggtgctgcgcaccatcaagaagcgagtcggagcctcggtggcccgaacctgctacgttgaccacaccccgccaccaccaccgatggaagtgctggcgtcgattcctcgccgtgaccgtggagccggacggcccaccaagaaggaacggcgagaaatggaacagttcaggggaatgtcctaa

SEQ ID NO: 7295 - protein, 126 aa, Corynebacterium glutamicum ATCC 13032
MSDTDGLPVRIDAWVWAVRLYKTRSEAAEACRAGHVKLNNNAVKPAQQVVPGDRVRVWVNHREFDVEVLRTIKKRVGASVARTCYVDHTPPPPPMEVLASIPRRDRGAGRPTKKERREMEQFRGMS

SEQ ID NO: 7296 - DNA, 561 bp, Streptomyces coelicolor A3(2)
  CDS (1)..(561): transl_table=11
atggcttccgagcatgacgagggcgggagcggcccggtggccgcaccgcgggacggcgccgctgccgcggccgggacaccggacccgaagacggcgacaccggacccgaagacggcggcggcgatcgccgccgccgaggcggccgggccgcagcacggggagagcgtccgcgtggacagctggatctgggccgtccgcctgatcaagacccgttccctgggggcgaccgcctgccgcggcggccatgtccgggtgaacggcgagcgggtgaagcccgcgtactcgctccgcgtcggcgacgaggtgcgcctgcgacaggagggccgggaacgggtcgtcgtcgtgaagcggctgatccgcaagcgcgtaggtgctccggtcgccgtccagtgctacgtcgacaactcgccgccgcccccgccccgcgaggccgtcgccccggcgggcatccgcgaccgcggcgccggccgcccgaccaagcgagaccgccgcgagatggaccggctgcgcgggctggagggcctgagcagctcccggagggacgcggggaccaggccctga

SEQ ID NO: 7297 - protein, 186 aa, Streptomyces coelicolor A3(2)
MASEHDEGGSGPVAAPRDGAAAAAGTPDPKTATPDPKTAAAIAAAEAAGPQHGESVRVDSWIWAVRLIKTRSLGATACRGGHVRVNGERVKPAYSLRVGDEVRLRQEGRERVVVVKRLIRKRVGAPVAVQCYVDNSPPPPPREAVAPAGIRDRGAGRPTKRDRREMDRLRGLEGLSSSRRDAGTRP

SEQ ID NO: 7298 - DNA, 408 bp, Xanthomonas axonopodis pv. citri str. 306
  CDS (1)..(408): transl_table=11
atgaatctagagctggaacaggcgatgacggtcaggctggatgtctggctgtgggcagcgcgctttttcaagacgcgcagcctggccaagaacgcagtggacaccggcaaggtagacgtggccgggcagcgtcccaagccgtcgcgcgcgttgcgcagcggcgaacaactgcgtatcgaccgcggcggcggaatcttcgagatcaccgttgccgcgctcagcgatgtgcgcggcccggcgccggtcgcgcaggcgctgtacatcgaaagcgacagctcgcgcgaggcccgcgcgcaatggcgccagcagcgcgctgccgagcgcaccggctaccgggcgcccgagggtaaaccggacaagcgtgcgcgacgtttgatcacggcattgggcgatatcgacgcgttgtag

SEQ ID NO: 7299 - protein, 135 aa, Xanthomonas axonopodis pv. citri str. 306
MNLELEQAMTVRLDVWLWAARFFKTRSLAKNAVDTGKVDVAGQRPKPSRALRSGEQLRIDRGGGIFEITVAALSDVRGPAPVAQALYIESDSSREARAQWRQQRAAERTGYRAPEGKPDKRARRLITALGDIDAL

SEQ ID NO: 7300 - DNA, 414 bp, Brucella suis 1330
  CDS (1)..(414): transl_table=11
ttggaacgaggcatggcgaccgctggaacaaacgctgagatggctgcggaaaaagccgcaaggcagcggatcgacaagtggttgttctttgcgcgcgtggtcaaatcaagatcgctggcggcgaaactcgccgtcggcggcaaggtccgggtcaaccgtgacaagattgagcaggccgcttatcaggtgaaggttggcgatgtgctgactattacgctcgaccggcggatccttgtctataaggtgctggcgcccggcgaacggcgcggccccgcgcccgaagcgcagcttttatacgaggacctttccccgtctccggctgcgtccaccgaaacagcccagcgcgagagcggcgcgggacgcccgaccaagaaagaacgccgaaatattgatcgccagcgcgaaggctggtga

SEQ ID NO: 7301 - protein, 137 aa, Brucella suis 1330
MERGMATAGTNAEMAAEKAARQRIDKWLFFARVVKSRSLAAKLAVGGKVRVNRDKIEQAAYQVKVGDVLTITLDRRILVYKVLAPGERRGPAPEAQLLYEDLSPSPAASTETAQRESGAGRPTKKERRNIDRQREGW

SEQ ID NO: 7302 - DNA, 399 bp, Shewanella oneidensis MR-1
  CDS (1)..(399): transl_table=11
atgacacaaagttcagacgacagtggcagcgttcgactcgataagtggttatgggccgcacgtttttataaaacccgtgccattgccaaagaaatgatcaacggcggtaaagtacattacaacggcgctcgcaccaaatccagtaagaatgcagagataggtgccattcttaagataaggcagggatatgacgataaagagatcgtcataaaaaaattatctgaagtgcgccaaagtgcatcaatagcgcaggaattgtaccaagaaacggccgccagtgccgctaaacgtgcggtaaacgccgaagccagacgattaaacatactgaataatcctgcgcccgaccgcaaaccggataaaaaacagcgacgagagcttatccgttttaaagaattctaa

SEQ ID NO: 7303 - protein, 132 aa, Shewanella oneidensis MR-1
MTQSSDDSGSVRLDKWLWAARFYKTRAIAKEMINGGKVHYNGARTKSSKNAEIGAILKIRQGYDDKEIVIKKLSEVRQSASIAQELYQETAASAAKRAVNAEARRLNILNNPAPDRKPDKKQRRELIRFKEF

SEQ ID NO: 7304 - DNA, 387 bp, Corynebacterium efficiens YS-314
  CDS (1)..(387): transl_table=11
atgagtgaccaggacggaaaaccggtccgcatcgatgcctgggtgtgggcagtgcgtctgtacaagacccgctccgatgcggccaccgcatgccgcgccgggcatgtgaagctcaacggccaggcggtcaaacctgcccagcaggtggtgccgggtgaccgggtgcgtgtgtgggtcaaccaccgggaatacgacgtcgaggtgctgcgcaccattgccaagcgggtgggtgcacccatcgcgcggacctgctatatcgaccacaccccaccgcccccgccgatggaggtgttcgcctccgtgccccggcgggaccgcggtgccgggcgccccaccaagaaggagcgccgcgagatggaccgtttccgcgggggtggcgcagggtaa

SEQ ID NO: 7305 - protein, 128 aa, Corynebacterium efficiens YS-314
MSDQDGKPVRIDAWVWAVRLYKTRSDAATACRAGHVKLNGQAVKPAQQVVPGDRVRVWVNHREYDVEVLRTIAKRVGAPIARTCYIDHTPPPPPMEVFASVPRRDRGAGRPTKKERREMDRFRGGGAG

SEQ ID NO: 7306 - DNA, 387 bp, Vibrio vulnificus CMCP6
  CDS (1)..(387): transl_table=11
atgagttccccaaatgaagccgttaggctcgataaatggctgtgggctgcaagattttacaaaacccgttcaatcgctcgcgatatggtcgatggcggtaaagtccactataatggccaacgtgcaaagcccagtaagattgtcgaagtgggcgcggtattgaaacttcgccaaggcaatgaagaaaaaacggttgtgatagaaaagctatccactcagcgacgtggcgcaccagaagcacaaacgctctatagcgaaacgcaagagagccaagcaaagcgagaagcacaagcaatgcaacgtaaactcaacgcgcataacccaagtccagatcgccgcccagataaaaagcagcgccgcgacattatcaaatttaaacaccagtaa

SEQ ID NO: 7307 - protein, 128 aa, Vibrio vulnificus CMCP6
MSSPNEAVRLDKWLWAARFYKTRSIARDMVDGGKVHYNGQRAKPSKIVEVGAVLKLRQGNEEKTVVIEKLSTQRRGAPEAQTLYSETQESQAKREAQAMQRKLNAHNPSPDRRPDKKQRRDIIKFKHQ

SEQ ID NO: 7308 - DNA, 408 bp, Pseudomonas syringae pv. tomato str. DC3000
  CDS (1)..(408): transl_table=11
atggcacaaaagatggaagaggacgacaaggttcgtctggataaatggctgtgggccgcccgctttttcaaaacgcgtgcgctggccaaagccgctatcgaaagcggcaaggtgcactgtcgcggcgaacgttgcaagcccggcaaggagcctcgccttggcgatgagtttcagattcgcatgggcttcgatgaacgcacagtggtcgtcgaggcgctgtccattgttcgccgtggcgcgccgcaagcgcagacgctctatcgcgagaccccggaaagcatcgccaaacgtgaaaatgcagctcttcagcgcaaggccggcaacctgggtgtgaccaccgatggcaagccgaccaagaagcagcgtcgccagcttttcgatttccgcggcgctcgcgacagcgaataa

SEQ ID NO: 7309 - protein, 135 aa, Pseudomonas syringae pv. tomato str. DC3000
MAQKMEEDDKVRLDKWLWAARFFKTRALAKAAIESGKVHCRGERCKPGKEPRLGDEFQIRMGFDERTVVVEALSIVRRGAPQAQTLYRETPESIAKRENAALQRKAGNLGVTTDGKPTKKQRRQLFDFRGARDSE

SEQ ID NO: 7310 - DNA, 387 bp, Vibrio parahaemolyticus RIMD 2210633
  CDS (1)..(387): transl_table=11
atgagttccctaaatgaagccgttaggctagataaatggctatgggccgcaagattttataaaacccgctctatcgctcgtaatatggtcgatggtggtaaagtccactataatggccaacgaagcaagccgagtaaaatcgttgagttgggcgctgagatcagacttcgtcaaggcaacgaagaaaaaaccgtgattatcgaaaagatttctgatcaacgacgaggcgcccctgtcgcacagaccctgtatcgcgaaactaatgaaagtatagcgaaacgtgaggaacacgcgacacaacgcaaacttaacgcccacaaccctagtccggaacgccgcccagataaaaagcagcgccgagacatcattaagttcaaacaccaataa

SEQ ID NO: 7311 - protein, 128 aa, Vibrio parahaemolyticus RIMD 2210633
MSSLNEAVRLDKWLWAARFYKTRSIARNMVDGGKVHYNGQRSKPSKIVELGAEIRLRQGNEEKTVIIEKISDQRRGAPVAQTLYRETNESIAKREEHATQRKLNAHNPSPERRPDKKQRRDIIKFKHQ

SEQ ID NO: 7312 - DNA, 423 bp, Bacteroides thetaiotaomicron VPI-5482
  CDS (1)..(423): transl_table=11
atggcagaagcaagaatagataaatggatgtgggctgttcgtattttcaagacacgcacaattgccgccgaagcctgcaagatgaaccgtgtcactatcaacggagcatacgtaaaggcatctcgcatgataaagccgggtgatgtagttcaagttaagaagccgcctattacctattcattcaaagtgttgcaagctattgagaagcgagtaggcgcaaagcttgtacccgatgtaatggaaaacgttaccactcccgaccaatacgaactattggaaatgagtaaaatcagcggattcattgatcgcgcacggggaaccggacgtccaaccaaaaaagaccgcagaagtctggaggaattcacagctccggaatttatggatgattttgatttcgactttgatttcgacgaagataagtaa

SEQ ID NO: 7313 - protein, 140 aa, Bacteroides thetaiotaomicron VPI-5482
MAEARIDKWMWAVRIFKTRTIAAEACKMNRVTINGAYVKASRMIKPGDVVQVKKPPITYSFKVLQAIEKRVGAKLVPDVMENVTTPDQYELLEMSKISGFIDRARGTGRPTKKDRRSLEEFTAPEFMDDFDFDFDFDEDK

SEQ ID NO: 7314 - DNA, 411 bp, Nitrosomonas europaea ATCC 19718
  CDS (1)..(411): transl_table=11
atgaccgaaaagagtgcacagtctgcagacgagaaattccgtatcgacaaatggctgtttgccgcccgcttttacaaaacgcgttcacaggctgccgatgcggtcgaacgcgggcaggtacaggtcaatgggatgcgagccaagccttccaggattctgaatacgggtgacctgcttgctattcgtatcgggccttatcactacttggtaaaagtgctggcgttgtccaaccagcgcagatccgccactgaagctcgcctgctttatcaggaaacggaagaaagccggcaggcgcgtgaggccgtggcagaaaaccttaaatcgcagccgaccccgccgcattacgccggtaaaggcagacccaccaaacgtgcccggcgtgatctggagcgtttcatgagcgagaaatga

SEQ ID NO: 7315 - protein, 136 aa, Nitrosomonas europaea ATCC 19718
MTEKSAQSADEKFRIDKWLFAARFYKTRSQAADAVERGQVQVNGMRAKPSRILNTGDLLAIRIGPYHYLVKVLALSNQRRSATEARLLYQETEESRQAREAVAENLKSQPTPPHYAGKGRPTKRARRDLERFMSEK

SEQ ID NO: 7316 - DNA, 420 bp, Haemophilus ducreyi 35000HP
  CDS (1)..(420): transl_table=11
atgaaggacaatacagcacaaacattggcggacactattcggctagataaatggctttgggctgcgcgcttttataaaacacgttcgcttgcgaaaagtatgattgatggcggtaaagtgcattataatggccagcgggtaaaaaccagtaagatagtgcaagtcggtgcacggatcaaattacgtcaagctgatgaagaaaaagaggttgtcgtgttggcactgagtgatcagcgacgatcggctttagaagcacaagcgttatatcaagaaacagacaagagtatacaacaacgacaagcacttgcgatcgctcgccgtgctaatgcattatcaatgccacacccagaccgccggcctaataagaaagaacggcgcgcattagtcaaatttaaacaagatattttagtaagcgaatag

SEQ ID NO: 7317 - protein, 139 aa, Haemophilus ducreyi 35000HP
MKDNTAQTLADTIRLDKWLWAARFYKTRSLAKSMIDGGKVHYNGQRVKTSKIVQVGARIKLRQADEEKEVVVLALSDQRRSALEAQALYQETDKSIQQRQALAIARRANALSMPHPDRRPNKKERRALVKFKQDILVSE

SEQ ID NO: 7318 - DNA, 381 bp, Bordetella parapertussis 12822
  CDS (1)..(381): transl_table=11
atggacaagatacggctggacaaatggctatgggcggcgcgcttctacaagacgcgcagcctggcggtgcaggaaatcggcaagggcagggtgcaggtcaacggccagccggccaagccggcgcgcgaggtggcgccgggcgacgtggtgtgcatccgcaaggaagatccgcccatccatgtgcgggtctgcgcggtcagcggcgtgcgcggtccggcgccggtggcgcggcagctgtacgaggaaacgccggaaagcgcggcggcgcgcgagcgggccgccgagatgcggcggctggcgcccgagcccgccatggatatcgtcgccggccgtccgaccaagcgcgaccgccgcctgatcgacaagtggcgcgacgcttag

SEQ ID NO: 7319 - protein, 126 aa, Bordetella parapertussis 12822
MDKIRLDKWLWAARFYKTRSLAVQEIGKGRVQVNGQPAKPAREVAPGDVVCIRKEDPPIHVRVCAVSGVRGPAPVARQLYEETPESAAARERAAEMRRLAPEPAMDIVAGRPTKRDRRLIDKWRDA

SEQ ID NO: 7320 - DNA, 381 bp, Bordetella bronchiseptica RB50
  CDS (1)..(381): transl_table=11
atggacaagatacgcctggacaaatggctatgggcggcgcgcttctacaagacgcgcagcctggcggtgcaggaaatcggcaagggcagggtgcaggtcaacggccagccggccaagccggcgcgcgaggtggcgccgggcgacgtggtgtgcatccgcaaggaagatccgcccatccatgtgcgggtctgcgcggtcagcggcgtgcgcggcccggcgccggtggcgcagcagctgtacgaggaaacgccggaaagcgcggcggcgcgcgagcgggccgccgagatgcggcggctggcgcccgagcccgccatggatatcgtcgccggccgtccgaccaagcgcgaccgccgcctgatcgacaagtggcgcgacgcttag

SEQ ID NO: 7321 - protein, 126 aa, Bordetella bronchiseptica RB50
MDKIRLDKWLWAARFYKTRSLAVQEIGKGRVQVNGQPAKPAREVAPGDVVCIRKEDPPIHVRVCAVSGVRGPAPVAQQLYEETPESAAARERAAEMRRLAPEPAMDIVAGRPTKRDRRLIDKWRDA

SEQ ID NO: 7322 - DNA, 405 bp, Chromobacterium violaceum ATCC 12472
  CDS (1)..(405): transl_table=11
atggcaaggcaggaagagcgggacgacgacaaggtgcgtctggacaagtggctgtgggcggcgcgcttcttcaagacgcgccagctggcgcacgaggcgctggaactgggccgggtgctggtcaacggcgagcgggtgaaggcctcgcgcgtggtgaaggagggcgacaggctgttcctgaggctcaaccagctggagtacgacgtggaggtgctgcagttggccacccagcgccggccggccaaggaagccgcgctgatgtaccgcgaggacgccgcgtccatcgccgcccgcgaggagcggacgctgctgctgaaggccgagcgcgccagcttcccgcatggcgacggccggcccaccaagaaggcgcgccgggaaatttcccgcttcaaatcgtcgttttag

SEQ ID NO: 7323 - protein, 134 aa, Chromobacterium violaceum ATCC 12472
MARQEERDDDKVRLDKWLWAARFFKTRQLAHEALELGRVLVNGERVKASRVVKEGDRLFLRLNQLEYDVEVLQLATQRRPAKEAALMYREDAASIAAREERTLLLKAERASFPHGDGRPTKKARREISRFKSSF

SEQ ID NO: 7324 - DNA, 438 bp, Porphyromonas gingivalis W83
  CDS (1)..(438): transl_table=11
atggaagaggtaaggatagaccgttggatgtgggctacgcgtatcttcaagacacgaacgatagccacggatgcctgcaagaaaagccgagtaactgtgaacgggctgcaagccaagccttcgcgtatggtacgtgtgggcgacgtcattcaggtaaggaagccaccggtgacctattcctttcgtattctggctttggctcagaatcggatgggtgccaagctggtgaaggactttctggaaaatatcactccgcccgaagagtatgagatactcgaaatgcaacgcatttcgggctttgtggacagagccaagggcaccggtcgtccgaccaaaaaggacaggcgagagctggagcagtttagcgaagagatgcccgatctgccgtactcgttcgattcgttcgactgggatgaagaagactttgccgaagactga

SEQ ID NO: 7325 - protein, 145 aa, Porphyromonas gingivalis W83
MEEVRIDRWMWATRIFKTRTIATDACKKSRVTVNGLQAKPSRMVRVGDVIQVRKPPVTYSFRILALAQNRMGAKLVKDFLENITPPEEYEILEMQRISGFVDRAKGTGRPTKKDRRELEQFSEEMPDLPYSFDSFDWDEEDFAED

SEQ ID NO: 7326 - DNA, 417 bp, Photorhabdus luminescens subsp. laumondii TTO1
  CDS (1)..(417): transl_table=11
atgaagggtaattcagactccgatcaagctgtccgtctggataagtggctgtgggcggctcgtttttataaaacacgggctattgcacgggaaatgatagacggtggtaaagttcactataatggtcaaagaagtaaaccgagtaaattggttgagctaggggctgaaattaaactgcgtcagggtaatgatgaacgtatagttgaagttcttgtactaagcaatcatcggcgcggtgcgccggaggcgcaacaactttaccaagagacggaagcgagtatgactaaccgggaaaaaatggcaattgctcgaaaaatgaatgcattaactatgcctcatcctgatcgccggccggataaaaaagaaagacgcacgctgattaagtttaaaaacaccaaattaaatgggcaggaataa

SEQ ID NO: 7327 - protein, 138 aa, Photorhabdus luminescens subsp. laumondii TTO1
MKGNSDSDQAVRLDKWLWAARFYKTRAIAREMIDGGKVHYNGQRSKPSKLVELGAEIKLRQGNDERIVEVLVLSNHRRGAPEAQQLYQETEASMTNREKMAIARKMNALTMPHPDRRPDKKERRTLIKFKNTKLNGQE

SEQ ID NO: 7328 - DNA, 393 bp, Vibrio vulnificus YJ016
  CDS (1)..(393): transl_table=11
gtgaccatgagttccccaaatgaagccgttaggctcgataaatggctgtgggctgcaagattttacaaaacccgttcaatcgctcgcgatatggtcgatggcggtaaagtccactataatggccaacgtgcaaagcccagtaagattgtcgaagtgggcgcggtattgaaacttcgccaaggcaatgaagaaaaaacggttgtgatagaaaagctatccactcagcgacgtggcgcaccagaagcacaaacgctctatagcgaaacgcaagagagccaagcaaagcgcgaagcacaagcaatgcaacgtaaactcaacgcgcataacccaagtccagatcgccgcccagataaaaagcagcgccgcgacattatcaaatttaaacaccagtaa

SEQ ID NO: 7329 - protein, 130 aa, Vibrio vulnificus YJ016
MTMSSPNEAVRLDKWLWAARFYKTRSIARDMVDGGKVHYNGQRAKPSKIVEVGAVLKLRQGNEEKTVVIEKLSTQRRGAPEAQTLYSETQESQAKREAQAMQRKLNAHNPSPDRRPDKKQRRDIIKFKHQ

SEQ ID NO: 7330 - DNA, 378 bp, Corynebacterium diphtheriae NCTC 13129
  CDS (1)..(378): transl_table=11
atggcagaggatgcggcacctgtgcgtatcgacgtgtgggtttgggctgttcgtttgctcaaaacacggtcgttatcagcgcaggcgtgcaaggcagggcatatcaaactcaacggggttgcagttaaaccctcgcagttggttactccgggggaccgagtacgggtatgggctgatcaccgcgagcgtgatgtagaggttgttagcacagttcgtaaacgtgtaggtgctgcaattgcccaagcctgctacattgatcattctccgccaccgccgccgaaagaaattctgctttctatgccacgtcgtgacaaaggcgcggggcggccaacgaagaaagaacgccgagacatcgatcggttgcgtggtaggcgctga

SEQ ID NO: 7331 - protein, 125 aa, Corynebacterium diphtheriae NCTC 13129
MAEDAAPVRIDVWVWAVRLLKTRSLSAQACKAGHIKLNGVAVKPSQLVTPGDRVRVWADHRERDVEVVSTVRKRVGAAIAQACYIDHSPPPPPKEILLSMPRRDKGAGRPTKKERRDIDRLRGRR

SEQ ID NO: 7332 - DNA, 381 bp, Herminiimonas arsenicoxydans
  CDS (1)..(381): transl_table=11
atgacgacagaatccgtacgcatagacaagtggttgtgggcggcacgatttttcaagacgcggacgctggcgagcgacgcggtcgacaacggaaaggtcagaatagagcgcgaacgcatcaagccggctcgcaatgtcaggtgtggcgacctggtgcagatagataatggttccagcgtatgggaagtgctggtgcgcggcttgtcggatgtacgcggttcggccgagatggcccagaagctgtatgcagagacagaggaaagcatcgtcaaacggcagcaggaagcggataaaaggaaattcttcaaggaaccgggtatgactatcaagggccggcctaccaagcgtgatcggcgcctgctggataaaacgaatcaatag

SEQ ID NO: 7333 - protein, 126 aa, Herminiimonas arsenicoxydans
MTTESVRIDKWLWAARFFKTRTLASDAVDNGKVRIERERIKPARNVRCGDLVQIDNGSSVWEVLVRGLSDVRGSAEMAQKLYAETEESIVKRQQEADKRKFFKEPGMTIKGRPTKRDRRLLDKTNQ

SEQ ID NO: 7334 - DNA, 408 bp, Burkholderia vietnamiensis G4
  CDS (1)..(408): transl_table=11
atgaactacaggatttcgaccgaaccgggcgcgaaactgcgcatcgacaagtggctgtgggcggcgcggttcttcaagacgcgttcgctcgcatcggacgcggtcgacaagggccacgtgaagatcggcggcgcggccatcaagccgtcgaaggacgtgcgcgtcggcgacgaggtcgagattgcgatcgacggagtggtctggcacattgccgtgctgggcatctgcgacgtgcgcgggccggcgagcgtcgcgcagacgctctacgcggaaaccgaggccggccgcaccgcgcggctcgccgaactcgaacggcgccgtacctaccgggagccggcggccgagctgcacggccggccgaccaagcgcgaccgtcgcatcatcgacagattttcgggtgaacgctga

SEQ ID NO: 7335 - protein, 135 aa, Burkholderia vietnamiensis G4
MNYRISTEPGAKLRIDKWLWAARFFKTRSLASDAVDKGHVKIGGAAIKPSKDVRVGDEVEIAIDGVVWHIAVLGICDVRGPASVAQTLYAETEAGRTARLAELERRRTYREPAAELHGRPTKRDRRIIDRFSGER

SEQ ID NO: 7336 - DNA, 420 bp, Dichelobacter nodosus VCS1703A
  CDS (1)..(420): transl_table=11
atgaagtcgataaaattgcaacaaaacaatgattgccaacgagaaaccgtccgcttagatcaatggttgtgggcggcgcggttttttaaaacacgacccgttgcggtgcaaaatattaaaaatggacgggttttagtcaacggacagcgcgcaaaaccagcgagaacgatcagcgttggcgacacgctcaccattcaaaaaacgccggaattatgttttgaagtaaacgtgctggcgctggaaaataaacgtctcggcgcaaaattggcaacggcgctttatcaagaaactgaagcaagtattcacaatcggcaagaattagcgttgcggcaacagctggcaaaatctttggtgcaatttccaactcgccgacccgataaacgcgagcggcgcgcattgcgcagtttgcgttatcagtaa

SEQ ID NO: 7337 - protein, 139 aa, Dichelobacter nodosus VCS1703A
MKSIKLQQNNDCQRETVRLDQWLWAARFFKTRPVAVQNIKNGRVLVNGQRAKPARTISVGDTLTIQKTPELCFEVNVLALENKRLGAKLATALYQETEASIHNRQELALRQQLAKSLVQFPTRRPDKRERRALRSLRYQ

SEQ ID NO: 7338 - DNA, 402 bp, Klebsiella pneumoniae subsp. pneumoniae MGH 78578
  CDS (1)..(402): transl_table=11
atgaaagagaagcccaccgaaaccgtcagactggacaaatggctttgggccgcccgcttttacaaaacccgcgcgctggcgcgggaaatgattgaaggcggcaaggtgcattacaacggacaacgtagcaaacccggaaaaatcgtcgaactcgacgccatgctgacgctgcgccagggcaacgacgagcggacggtgcgcattatcggcattaccgaacagcgccgcccggcaagcgaagccgtcaacctgtatgaagagacggcggagagtatcgagaagcgtgaaaaaatggccctggcgcgcaaaatgaacgccctgaccatgccgcaccctgacagacgtccggacaagaaagagcgccgcgacctgatgagatttaaacacggcgagagtgaataa

SEQ ID NO: 7339 - protein, 133 aa, Klebsiella pneumoniae subsp. pneumoniae MGH 78578
MKEKPTETVRLDKWLWAARFYKTRALAREMIEGGKVHYNGQRSKPGKIVELDAMLTLRQGNDERTVRIIGITEQRRPASEAVNLYEETAESIEKREKMALARKMNALTMPHPDRRPDKKERRDLMRFKHGESE

SEQ ID NO: 7340 - DNA, 444 bp, Acinetobacter sp. ADP1
  CDS (1)..(444): transl_table=11
atgtctagacagcaacatgaagaacatagtattgattctatgcgagttgataaatggctatgggctgctcgtttctttaaaacacgttctatagctaaagcagccatcgaaggcggaaaagttcaccacaatagtgaacgtgttaaagtttccaaagaaattcgggtaggaatggaattgaccattcagcaaggctttgaaagaaaaactgttgttgtaaaagcattatctaatatgcggggacctgcacctatagcacaacagctctatgatgaaactgaagttagtattgcaaaaagagagttgattgcttcgcaaagaaaattgcataatttagcccgaccagatcatcgtccttctaaaaaagatcgacgacagattcatcggtttaaacaagaaaatgatcagaattttgagcagtcgtggtcatataatgatgattaa

SEQ ID NO: 7341 - protein, 147 aa, Acinetobacter sp. ADP1
MSRQQHEEHSIDSMRVDKWLWAARFFKTRSIAKAAIEGGKVHHNSERVKVSKEIRVGMELTIQQGFERKTVVVKALSNMRGPAPIAQQLYDETEVSIAKRELIASQRKLHNLARPDHRPSKKDRRQIHRFKQENDQNFEQSWSYNDD

SEQ ID NO: 7342 - DNA, 411 bp, Erwinia carotovora subsp. atroseptica SCRI1043
  CDS (1)..(411): transl_table=11
atggcgaaagttaccgagcaggctgacgacgccgttcgtctggacaaatggctctgggccgcccgtttctataaaacccgagcgatggcccgcgagatgatcgacggcggcaaagtgcactataacgggcaacgcggtaaaccgagcaaacaggtcgaactgaatgccgagattaaactgcgtcagggaaatgacgaacgcacggtgatcattgtggctgtcagcggccagcgtagaagtgcgacagaggcgcaggcgctgtatcaggaaacggctgcaagcattgagaaacgagaaaaggtggcgcaggcgcggaaaatgaatgcgctgacgatgccacaccccgatcgccgcccagataaaaaagagcgacgcgatctgattaaatttaaatacagcgatcaagactaa

SEQ ID NO: 7343 - protein, 136 aa, Erwinia carotovora subsp. atroseptica SCRI1043
MAKVTEQADDAVRLDKWLWAARFYKTRAMAREMIDGGKVHYNGQRGKPSKQVELNAEIKLRQGNDERTVIIVAVSGQRRSATEAQALYQETAASIEKREKVAQARKMNALTMPHPDRRPDKKERRDLIKFKYSDQD

SEQ ID NO: 7344 - DNA, 366 bp, Propionibacterium acnes KPA171202
  CDS (1)..(366): transl_table=11
atgacgaggatcgacgtgtggctgtggtcggtgcgcgtctataagtcccggtcgttggctaccgccgccgtcaagggcggccacattcgcctcaatggagacccggttaaaccctcccacgacgtgaaacccggcgataccgtcaccatccacacccccggatgggaccgggtcctcaaggtcgtcaacccgatcacgaaaagagtcggcgccaaactcgcggtcgaggcttacgaagatctgtcagctccccgacccgcctacctctcggctcccctcgctcgccgtgaccgtgggactggacgacccaccaagaaggatcgtcgcgagatcgatcggctccgaggccgagactctcgctattga

SEQ ID NO: 7345 - protein, 121 aa, Propionibacterium acnes KPA171202
MTRIDVWLWSVRVYKSRSLATAAVKGGHIRLNGDPVKPSHDVKPGDTVTIHTPGWDRVLKVVNPITKRVGAKLAVEAYEDLSAPRPAYLSAPLARRDRGTGRPTKKDRREIDRLRGRDSRY

SEQ ID NO: 7346 - DNA, 393 bp, Desulfotalea psychrophila LSv54
  CDS (1)..(393): transl_table=11
atgaccagcgaagaggcaaggataagagtagataaatggctgtgggcggcccgttttttcaaaacacgttctcttgcctccgcggcagtaaatggtggcaaggttcatctgggtggcaatcgggtcaaggcatctcgtcccgttggggtggggatggtgcttaccatcacccggggagtggttgagtttgaggtcactattcttgctcttaatcaacagcgcagaccggcggttgaggcccaactactctatgaggaaagtgaggcaagcagaatcaaaagggaggagaatcgtgagttgcgtagagccctcaatgttagccacagtcctcctgcgaaaaaaccaagcaaacgagatcgacgtaagataaaagagtttgttcgcaaaagttag

SEQ ID NO: 7347 - protein, 130 aa, Desulfotalea psychrophila LSv54
MTSEEARIRVDKWLWAARFFKTRSLASAAVNGGKVHLGGNRVKASRPVGVGMVLTITRGVVEFEVTILALNQQRRPAVEAQLLYEESEASRIKREENRELRRALNVSHSPPAKKPSKRDRRKIKEFVRKS

SEQ ID NO: 7348 - DNA, 411 bp, Mannheimia succiniciproducens MBEL55E
  CDS (1)..(411): transl_table=11
atggcaaaaaaaccaggcaaagcggatgaaaaggacgaagatgtcacccgtttggacaaatggctttgggcggcacgtttttataaaacccgcactatcgcaaaagaaatgatcgacggcggtaaagtgcattataacgggcaacgtaccaaaccgaataaaaccgtagaaatcggcgctaccattaaattacgccaaggcaatgatgaaaaagagataaaagtgaccgcactttccactcaacgccggggcgcgccgcaggcgcaattgctgtatgcggaaaccgaacaaagcattgaaaacagagaaaaaaatgcattagcgcggaaaatgaacgccatgcctcatcctgatcatcggccgaataaaaaagagcgacgggatttaatcaaatttaaaaatcaaggctaa

SEQ ID NO: 7349 - protein, 136 aa, Mannheimia succiniciproducens MBEL55E
MAKKPGKADEKDEDVTRLDKWLWAARFYKTRTIAKEMIDGGKVHYNGQRTKPNKTVEIGATIKLRQGNDEKEIKVTALSTQRRGAPQAQLLYAETEQSIENREKNALARKMNAMPHPDHRPNKKERRDLIKFKNQG

SEQ ID NO: 7350 - DNA, 426 bp, Methylococcus capsulatus str. Bath
  CDS (1)..(426): transl_table=11
atggcggatccgggtgcgcatctcccccctgccgaggcgagtggagcgaaggttcggctggataaatggctctgggccgctcgtttcttcaaaacccggcagctcgccgtcgaggccatcaacggcggcaaggtccatttgaatggccagcgcgccaaacccggcaaggaaatcggcatcggcgcccggctggagatcacgcgtgaacgggaggtctgggaagtcgtcgtcgaggccttgaacacccagcgccgacccgccagggaagccgtcctgctctatcgggaaaccccggaaagccaggcacggcgcgaagccgacgccgcccgcagacgggatgagaaatcgttcgcgaacgaacccgcccaccgcccgtccaaaagggaccgccgcttgatccaccgcttcaaacaatccctggattga

SEQ ID NO: 7351 - protein, 141 aa, Methylococcus capsulatus str. Bath
MADPGAHLPPAEASGAKVRLDKWLWAARFFKTRQLAVEAINGGKVHLNGQRAKPGKEIGIGARLEITREREVWEVVVEALNTQRRPAREAVLLYRETPESQARREADAARRRDEKSFANEPAHRPSKRDRRLIHRFKQSLD

SEQ ID NO: 7352 - DNA, 402 bp, Neisseria gonorrhoeae FA 1090
  CDS (1)..(402): transl_table=11
atgaaagacaagcacgattcttccgccatgcggctggacaaatggctttgggcggcacgttttttcaagacccgttcccttgcgcaaaagcatatcgaactgggtagggttcaagtaaacggctcgaaagtcaaaaacagtaaaaccatagacatcggcgatattatcgacctgacgctcaattcccttccccataaaatcaaggttaaaggtttgaaccaccaacgccgcccggcacccgaggcgcggcttctgtatgaagaagacgcgaaaacggcagcattgagggaagagtgcaaacagctcgaccaattcagccgcatcacttccgcccatcccgacggcagaccgaccaagcgcgaccgccgccaactggacaggctgaaaaaaggagactggtaa

SEQ ID NO: 7353 - protein, 133 aa, Neisseria gonorrhoeae FA 1090
MKDKHDSSAMRLDKWLWAARFFKTRSLAQKHIELGRVQVNGSKVKNSKTIDIGDIIDLTLNSLPHKIKVKGLNHQRRPAPEARLLYEEDAKTAALREECKQLDQFSRITSAHPDGRPTKRDRRQLDRLKKGDW

SEQ ID NO: 7354 - DNA, 408 bp, Pseudomonas syringae pv. syringae B728a
  CDS (1)..(408): transl_table=11
atggcacaaaagatggaagaagacgataaggtccgcctggataagtggctgtgggctgcgcgctttttcaaaacacgtgcgctggccaaagcggctatcgaaagcggcaaggtgcactgtcgcggcgagcgttgcaagcccggcaaggagccgcgtgtcggtgacgagttccagattcgcatgggtttcgacgaccgcaccgtagtggtcgaggcgctgtcgatcgttcggcgtggcgcgccggaggcacagacgctgtatcacgagacacccgagagcatcgccaggcgcgagaatgccgcggctcagcgcaaggccggcaacctgggtgtgaccactgacggaaagccgaccaagaagcaacgccgggagcttttcggcttccgcgccagccaaaacaacgactga

SEQ ID NO: 7355 - protein, 135 aa, Pseudomonas syringae pv. syringae B728a
MAQKMEEDDKVRLDKWLWAARFFKTRALAKAAIESGKVHCRGERCKPGKEPRVGDEFQIRMGFDDRTVVVEALSIVRRGAPEAQTLYHETPESIARRENAAAQRKAGNLGVTTDGKPTKKQRRELFGFRASQNND

SEQ ID NO: 7356 - DNA, 462 bp, Pseudomonas fluorescens Pf-5
  CDS (1)..(462): transl_table=11
atgagagcccgcttgcaggcggtaaagttgcgacatttttcagcgaggggaattccagtggcgcacaagcaggaagaagaggacaaggttcgtctggataaatggctgtgggcagcgcgcttctacaagacccgggccctggccaagacagcgattgaaagcggcaaggtgcatcaccggggcgagcgctgcaaaccgggcaaggagccgcgggtaggcgatgaataccagattcgcgccggcttcgacgaacgcaccgtggtggtccaggccctgtccatcgtccgccgtggcgctcctgaagcgcaggctctgtacgcggaaaccgaggccagcatcgccaagcgcgaagccgctgcggcccagcgcaaggctggtgccctaggagtgagcaccgacggtaaaccgagcaagaaacagcgccgggacctgttcaagttccacggcagcaaccacgaatga

SEQ ID NO: 7357 - protein, 153 aa, Pseudomonas fluorescens Pf-5
MRARLQAVKLRHFSARGIPVAHKQEEEDKVRLDKWLWAARFYKTRALAKTAIESGKVHHRGERCKPGKEPRVGDEYQIRAGFDERTVVVQALSIVRRGAPEAQALYAETEASIAKREAAAAQRKAGALGVSTDGKPSKKQRRDLFKFHGSNHE

SEQ ID NO: 7358 - DNA, 441 bp, Psychrobacter arcticus 273-4
  CDS (1)..(441): transl_table=11
atgagtaaacacaataaaaaccacaatcagcccagccatagcaagcctgatgctgtgcgtatgcgtattgataaatggctatgggcggcgcgcttttatcggacgcgcaatcttgctaaagaagccatcgaaagcggtcgcgtgcattatgctggtagccgcgtaaagaccagtaaagagattgctgttggcgatgaattgcagattcgtcaaggctcagccactgctatgaccgaaaagacggtcgtggttgaagcattgacggtacaacgtggtaatgccaccgatgcggaagtcttatattcagaaactaaagaaagcatcgctcgccgtgactattatgctgagcagcgcaaacttgccaaccttgcgcgcccagataataaacccaataaaaaagagcgccgtgatttacagcgctttaaaagcaaccaagattga

SEQ ID NO: 7359 - protein, 146 aa, Psychrobacter arcticus 273-4
MSKHNKNHNQPSHSKPDAVRMRIDKWLWAARFYRTRNLAKEAIESGRVHYAGSRVKTSKEIAVGDELQIRQGSATAMTEKTVVVEALTVQRGNATDAEVLYSETKESIARRDYYAEQRKLANLARPDNKPNKKERRDLQRFKSNQD

SEQ ID NO: 7360 - DNA, 405 bp, Colwellia psychrerythraea 34H
  CDS (1)..(405): transl_table=11
atgtcaacaagtcaagatcctcaaaaaaagccaattcgtttagataaatggctttgggctgcaagattctatcgaacccgcgctattgctaaacagatgattgatggcggaaaaattttttataatggtcaacgtactaagtcgggaaaagccgtatcaatcggtgatataataaaaatcagacaaggatttgaagaaaaagaagtcaccgttattgcattagctgacaaacgcagtgacgctacttttgctcaaaccttatatcaagaaagtaaacaaagtattgaaacccgtgagaaaaatgccctagcacgtaagcaaggtattctccttagccctgctagtgttactaagccagataaaaaacaacgtaggaaactacgtgaatttaaagaaaggatctaa

SEQ ID NO: 7361 - protein, 134 aa, Colwellia psychrerythraea 34H
MSTSQDPQKKPIRLDKWLWAARFYRTRAIAKQMIDGGKIFYNGQRTKSGKAVSIGDIIKIRQGFEEKEVTVIALADKRSDATFAQTLYQESKQSIETREKNALARKQGILLSPASVTKPDKKQRRKLREFKERI

SEQ ID NO: 7362 - DNA, 408 bp, Pseudomonas syringae pv. phaseolicola 1448A
  CDS (1)..(408): transl_table=11
atggcgcaaaagccggaagaagatgacaaggtccgtctggataaatggctgtgggccgcacgttttttcaaaacacgcgcattggccaaagcagctatcgaaagcggcaaggtgcactgtcgcggcgaacgttgcaagcccggcaaggagcctcgtccaggcgacgagtttcagattcgcataggcttcgatgagcgcacgatagtggtcgaggcgttgtccaccgttcgccggggtgcgcctgaggcgcagacgctgtatagcgagacacccgacagcatcgccaaaagagaaagcgcggccgctcagcgcaaggctggcaacctgggtgtaactaccgacggaaagcccaccaagaagcaacgccgggagctttttggtttccgtgccagccacaacaacgactga

SEQ ID NO: 7363 - protein, 135 aa, Pseudomonas syringae pv. phaseolicola 1448A
MAQKPEEDDKVRLDKWLWAARFFKTRALAKAAIESGKVHCRGERCKPGKEPRPGDEFQIRIGFDERTIVVEALSTVRRGAPEAQTLYSETPDSIAKRESAAAQRKAGNLGVTTDGKPTKKQRRELFGFRASHNND

SEQ ID NO: 7364 - DNA, 369 bp, Dechloromonas aromatica RCB
  CDS (1)..(369): transl_table=11
ttgcgcgtcgataaatggctgtgggcagcgcgattcttcaagacgcgctccctggccagcgatgccgtcagtggcggcaaggtgaaggtcaatggcgctacgatcaaaccagcccgcgacatcaagatcggtgaccgactcaacatcattaacagtgaaacgcgctgggaagtgaccgtccaagccccgtcggacaagcgcggcccggcaccggaagcccgcctgctctacgaggaaacacccgaaagcatcgctgcccgtgaagccgcgagagatagccgacagttcgtgcaagatccagcagcggacatccacggccgaccgaccaagcgcgaccgccgccagcttggccgcttcagcggctcataa

SEQ ID NO: 7365 - protein, 122 aa, Dechloromonas aromatica RCB
MRVDKWLWAARFFKTRSLASDAVSGGKVKVNGATIKPARDIKIGDRLNIINSETRWEVTVQAPSDKRGPAPEARLLYEETPESIAAREAARDSRQFVQDPAADIHGRPTKRDRRQLGRFSGS

SEQ ID NO: 7366 - DNA, 444 bp, Thermobifida fusca YX
  CDS (1)..(444): transl_table=11
gtgcacgaccacgatcccaggcaggaaccggcccgttcggaagaaccgcagaaaacggctcctccgctcccgcccggtccccccgctacgcgcgtggaccggtggctgtgggcggtacgcctcaccaagacccgctcggacgcggcccaggcatgccgggccgggcacgttcgggtcaacgacaagcccgctaaacccgccacctcggtcaaggtaggcgaccgggtgcgggctcgcgtcaacggagtcacccggatcgtcgaggtcacccacatcatcgaaaaacgcgtgggtgcgccgatcgcgacccgctgctacatcgaccacactcctgtggtgccgcccgagctcgccgttccggtggcccgccgcccccgcggtgcgggacgccccaccaagcgtgaacgtcgccagcttgaccggctgcggggcttcacccgctga

SEQ ID NO: 7367 - protein, 147 aa, Thermobifida fusca YX
MHDHDPRQEPARSEEPQKTAPPLPPGPPATRVDRWLWAVRLTKTRSDAAQACRAGHVRVNDKPAKPATSVKVGDRVRARVNGVTRIVEVTHIIEKRVGAPIATRCYIDHTPVVPPELAVPVARRPRGAGRPTKRERRQLDRLRGFTR

SEQ ID NO: 7368 - DNA, 396 bp, Ralstonia eutropha JMP134
  CDS (1)..(396): transl_table=11
atgaatgtcagtttcgaacccgatgcccgcctgcgtatcgacaaatggttatggtgcgcgcgcttcttcaagacgcgctcgttggcggccgaggccgtggagcgcggcaaggtgacggtcaatggccagccgtgcaagaattcgcgcgaggtcaagcccggcgacacgatcgtgctggaagcccaccagcagcgctgggaactggtggtgaagggcattgcgccagcgcgcggttcggcgccggtggcgcagacgctgtatgccgagacggaagccagccaggcgcgccgccaggccgagacggagcagcggcgctaccagcctgaaccgtcgtcccagttacagggccgcccgaccaagcgggaccgccggcgcatcgatgattttagaaactga

SEQ ID NO: 7369 - protein, 131 aa, Ralstonia eutropha JMP134
MNVSFEPDARLRIDKWLWCARFFKTRSLAAEAVERGKVTVNGQPCKNSREVKPGDTIVLEAHQQRWELVVKGIAPARGSAPVAQTLYAETEASQARRQAETEQRRYQPEPSSQLQGRPTKRDRRRIDDFRN

SEQ ID NO: 7370 - DNA, 405 bp, Thiobacillus denitrificans ATCC 25259
  CDS (1)..(405): transl_table=11
gtgacgggcgacacgactgcagcaagcgagcgcatgcggctcgacaaatggctatgggcggcgcgcttcttcaagacgcggagcctcgcggtgcaggccattgcgcatggccgggtgcggctcgacggcgagcgggtcaagccggcgcgcgaagtgaagtgcggcgaccggctcgatatccagatcgaggtgctcgagtggtcggtgaccgtgcgcggcctgagcaagcaacgcggtcccgcggccgtcgcgcagatgctctacgaggaagacccgtcgagcatcgcgcgccgcgccgagcgccggcagcagcacgcgctcgcgccgaatcccgccgccgcgatcaagggccggccgactaagcgcgaccgccgccacatccaccgcttcaccggcggttcctga

SEQ ID NO: 7371 - protein, 134 aa, Thiobacillus denitrificans ATCC 25259
MTGDTTAASERMRLDKWLWAARFFKTRSLAVQAIAHGRVRLDGERVKPAREVKCGDRLDIQIEVLEWSVTVRGLSKQRGPAAVAQMLYEEDPSSIARRAERRQQHALAPNPAAAIKGRPTKRDRRHIHRFTGGS

SEQ ID NO: 7372 - DNA, 408 bp, Pseudomonas fluorescens PfO-1
  CDS (1)..(408): transl_table=11
atggcacaaaaaagcgaagaagacgacaaggttcgtctcgacaagtggctgtgggccgcgcgttttttcaagactcgcgctttggccaaagccgccatcgagagtggcaaggtgcattgtcggggagagcgctgcaagcccggcaaagaaccacgcattggcgacgaattcgagattcgcgccggcttcgatgagaagaccgtggtggttcaggccttgtcgatcgtgcgtcgcggcgcacctgaggcgcagacgctgtacgccgagaccgaggccagcattgccaaacgtgaagcggctgcggcgatgcgcaaggcaggcgccctgggcgtgaccaccgatggcaaaccgagcaagaagcagcgtcgggatctgtttaagtttcgtgggaacagtagcggcgaataa

SEQ ID NO: 7373 - protein, 135 aa, Pseudomonas fluorescens PfO-1
MAQKSEEDDKVRLDKWLWAARFFKTRALAKAAIESGKVHCRGERCKPGKEPRIGDEFEIRAGFDEKTVVVQALSIVRRGAPEAQTLYAETEASIAKREAAAAMRKAGALGVTTDGKPSKKQRRDLFKFRGNSSGE

SEQ ID NO: 7374 - DNA, 408 bp, Burkholderia sp. 383
  CDS (1)..(408): transl_table=11
atgaattacaagatttcgaccgaaccgggcgcgaagctgcgcatcgacaaatggctgtgggcggcccggttcttcaagacgcgctcgcttgcgaccgatgcggtcgacaaggggcacgtgaagatcggcggcgcggcggtcaagccggcgaaggaagtgcgcgtgggcgacgaggtcgagattgcgatcgacggcatcgtctggcacattgccgtgctcggcgtgtgcgacgtgcgcgggccggcgagcgtcgcgcagacgctttacgcggaaacggaagcggggcgggccgcacggctcgccgaactggagcggcgccgcacgtatcgcgagccggcagcggaattgcacggccggccgacgaagcgcgaccggcgcatcatcgacagattttctggtgggagctga

SEQ ID NO: 7375 - protein, 135 aa, Burkholderia sp. 383
MNYKISTEPGAKLRIDKWLWAARFFKTRSLATDAVDKGHVKIGGAAVKPAKEVRVGDEVEIAIDGIVWHIAVLGVCDVRGPASVAQTLYAETEAGRAARLAELERRRTYREPAAELHGRPTKRDRRIIDRFSGGS

SEQ ID NO: 7376 - DNA, 435 bp, Rhodospirillum rubrum ATCC 11170
  CDS (1)..(435): transl_table=11
atgagcaaggccggcatcggagccggagacggggcgggcgggctatcgccagggatcgatagcccgctttcgcagcggatcgataagtggctgtggtacgcccgcttctgcaaaacgcgcggtctggcccaaaccctatgcgccgccggccatgtgaagcgcgagggggagtcgctggtcaaggcggccaccctggtgcggccgggggaccgcctgaccctggtccttggcccgctgcgccgaacggtggtggtgcgcgcggccggggcgcggcgggggccggcccccgaagccagaaccctttatgacgagcccgagcccgccgaacgtctgggcgatccgacgatggaagggctgtcgcgaccaagcggcggcgggcggccgaccaaaaaggatcgccgcgcccttgatcgctggcgggccgaggacgagtag

SEQ ID NO: 7377 - protein, 144 aa, Rhodospirillum rubrum ATCC 11170
MSKAGIGAGDGAGGLSPGIDSPLSQRIDKWLWYARFCKTRGLAQTLCAAGHVKREGESLVKAATLVRPGDRLTLVLGPLRRTVVVRAAGARRGPAPEARTLYDEPEPAERLGDPTMEGLSRPSGGGRPTKKDRRALDRWRAEDE

SEQ ID NO: 7378 - DNA, 408 bp, Burkholderia thailandensis E264
  CDS (1)..(408): transl_table=11
atgaatttcaagatctcgaccgaacccggcgcgcggctgcgcatcgacaagtggctctgggccgcgcgctttttcaagactcgctcgctcgcggccgaagccgtcgagaaagggcgggtgaagatcggcggcgcggccgtcaagccggcgaaggacgtgcgcgtcggcgaccgggtcgacgtgacgatcgagcacgtcgtctgggaaatcgacgtgctcggcgtgtgcgacgtgcgcgggccggcgagcgttgcgcagacgctctacgcggagacggaagcggggcgggcgaagcgtcttgcggaactcgagcggcgccggcatttccgggagccttcggcagagctgcacggacggccgacgaagcgggaccgccggattatcgacaggttttcggatgggagctga

SEQ ID NO: 7379 - protein, 135 aa, Burkholderia thailandensis E264
MNFKISTEPGARLRIDKWLWAARFFKTRSLAAEAVEKGRVKIGGAAVKPAKDVRVGDRVDVTIEHVVWEIDVLGVCDVRGPASVAQTLYAETEAGRAKRLAELERRRHFREPSAELHGRPTKRDRRIIDRFSDGS

SEQ ID NO: 7380 - DNA, 411 bp, Frankia sp. CcI3
  CDS (1)..(411): transl_table=11
atgacgtcgcccacgcctatgacgtcgccggcgggaaccgcccggatcgacacctggatctggtgcgtgcgcctggtcaagacgcgatcgcaggcgaccgccgcctgccgcgccggccatgtccgcctcaacggcgagcgggtcaagccggcccatccggtgcgggccggcgacgagatccgggtgcgccagcccgggcacgagcgggtcgtcgtcgtcacccggatcccgcacaggcgggtcggcgcgcccgttgccgcggagtccttcgtcgaccgcagcccgccggtcgcgcgcgaggtgccgccggtggtggccgtgcgcgatcggggcgccgggcggccgacgaagcgcgaccggcgggcgctggaacgcctgcgcgaccagccccgccggccggatgcgcggtag

SEQ ID NO: 7381 - protein, 136 aa, Frankia sp. CcI3
MTSPTPMTSPAGTARIDTWIWCVRLVKTRSQATAACRAGHVRLNGERVKPAHPVRAGDEIRVRQPGHERVVVVTRIPHRRVGAPVAAESFVDRSPPVAREVPPVVAVRDRGAGRPTKRDRRALERLRDQPRRPDAR

SEQ ID NO: 7382 - DNA, 369 bp, Francisella tularensis subsp. holarctica
  CDS (1)..(369): transl_table=11
atgagtgtaagactagataaatggttatgggctactagattctacaaaactagagctttagcaaaaaaagctatcgaaggtggcaaagtacactttcaaggacaaaaaacaaaagtaagtaaaattgtaaatattggcgatacctatcaaattcaacaaggttatataaaaaagaccgtaattgttgaagctttagatgaagttagaaagtctgctagtgaagcacaaaagctctatagagaaactgctgaaagtatcgaaaaaagagaacaagaaacaattattagaaaaactgccaatctaataagtccagaaaaacctacaaaaaaacagcgtagacaaataattgattttaaaagaaatgattag

SEQ ID NO: 7383 - protein, 122 aa, Francisella tularensis subsp. holarctica
MSVRLDKWLWATRFYKTRALAKKAIEGGKVHFQGQKTKVSKIVNIGDTYQIQQGYIKKTVIVEALDEVRKSASEAQKLYRETAESIEKREQETIIRKTANLISPEKPTKKQRRQIIDFKRND

SEQ ID NO: 7384 - DNA, 387 bp, Saccharophagus degradans 2-40
  CDS (1)..(387): transl_table=11
atggataaggtacgtatagacaagtggctttgggccgcccgtttttttaaaacccgcaacttggcaaagtctgccattgatggcggtaaaatacatataaacggcagccgggttaagccaagcaaagaggtagaagttggcaacaaattgttaatacgcgttggctgggatgagatggaagtgttggtaaccgccctctcggataaacgccgcggtgcacccgaagccgccaaactgtaccaagaaacacagcagagcatagataagcgcaccacctacgccgagcagcgcaaagccattggccaaagccagctacaaccagcaaccaagcccaacaccaaagagcgccgccaattgcagcgtgttaagcgcattctaagcgaataa

SEQ ID NO: 7385 - protein, 128 aa, Saccharophagus degradans 2-40
MDKVRIDKWLWAARFFKTRNLAKSAIDGGKIHINGSRVKPSKEVEVGNKLLIRVGWDEMEVLVTALSDKRRGAPEAAKLYQETQQSIDKRTTYAEQRKAIGQSQLQPATKPNTKERRQLQRVKRILSE

SEQ ID NO: 7386 - DNA, 396 bp, Methylobacillus flagellatus KT
  CDS (1)..(396): transl_table=11
atgagtgaacaggaaagcaagtgccgcctggacaaatggttatgggcggcaagattcttcaagacccgcagcctggcgtcggaagccgtggacaccggcaaagtgcatgtggacggagacagggtgaagcccgccaaggaagtccgcctggggcaacgtatccacatccgccgcaaggagatggaggtggaagttgtcgtgcgcggcctgagcacgcagcgccgtggcgcacctgaggcagcgctgttgtatgaagaaacccctgaaagcatcagcaggcgcgaaaatctcacggttacccgcgagcatgagcatgctaggcgcgagcgcggcatgggtcggccaaccaagcgccagcgccgcgacatcaagaagtttaccgggatagactggtaa

SEQ ID NO: 7387 - protein, 131 aa, Methylobacillus flagellatus KT
MSEQESKCRLDKWLWAARFFKTRSLASEAVDTGKVHVDGDRVKPAKEVRLGQRIHIRRKEMEVEVVVRGLSTQRRGAPEAALLYEETPESISRRENLTVTREHEHARRERGMGRPTKRQRRDIKKFTGIDW

SEQ ID NO: 7388 - DNA, 408 bp, Burkholderia xenovorans LB400
  CDS (1)..(408): transl_table=11
atgaattacgggatctcaaccgaagcgggcgcgaaactgcgcatcgacaaatggctttgggccgcgcgctttttcaagacgcgttcgctcgcggcggcggccgtcgagaaagggcatgtgcgcattgagggcgccagcgtcaagccggccaaagacgtgcgcgtcggcgacctggtcgagatcgagatcgagcggattgtgtggcaggtggcggtgctgggcgtgtgcgacgtgcgcggcccggcgagcgtcgcacagacgctttatgcggaaaccgaagagagcagggtgaagcggcaggtcgaacaggagcggcgcaagacgtatcgcgaaccggcggccgcattgcacggccggccgaccaagcgcgaccggcgcactatcgacaaactttcaggtgggggttga

SEQ ID NO: 7389 - protein, 135 aa, Burkholderia xenovorans LB400
MNYGISTEAGAKLRIDKWLWAARFFKTRSLAAAAVEKGHVRIEGASVKPAKDVRVGDLVEIEIERIVWQVAVLGVCDVRGPASVAQTLYAETEESRVKRQVEQERRKTYREPAAALHGRPTKRDRRTIDKLSGGG

SEQ ID NO: 7390 - DNA, 396 bp, Ralstonia metallidurans CH34
  CDS (1)..(396): transl_table=11
atgcaagtcgatttcgaacccgatgcgcggctgcgcatcgacaaatggctctggtgcgcgcgcttcttcaagacgcgctcgctggctgccgaggcggtggagcggggccgcgtgagcgtcaacgggcagccctgcaagaactcgcgcgaggtcaagccgggcgacaccgtgatattggaggcgcatcaacagcaatgggaggtggtggtcaagggcgtggccgcgtcacgcgggccggcgccgatcgcccagacgctctatgcggagaccgaggaaagccaggccaggcgccagacagacgcggaacggcggcgcttccagcacgagccggccgcgcagatgcacgggcgaccgaccaagcgcgaccggcgcagaatcgacggcttcaaggggtga

SEQ ID NO: 7391 - protein, 131 aa, Ralstonia metallidurans CH34
MQVDFEPDARLRIDKWLWCARFFKTRSLAAEAVERGRVSVNGQPCKNSREVKPGDTVILEAHQQQWEVVVKGVAASRGPAPIAQTLYAETEESQARRQTDAERRRFQHEPAAQMHGRPTKRDRRRIDGFKG

SEQ ID NO: 7392 - DNA, 372 bp, Acidobacteria bacterium Ellin345
  CDS (1)..(372): transl_table=11
gtgcgtatggacaaatggctgtgggcggcgcggttttacaagacgcgaggccttgccgcaaaagcttgcgagttgggacgagtgctgtcaaaaggccagaccgtgaaggccgcccgcgaggtcaaagtcggcgatcgactgaacatcaccaccgagggcggcgtctacgacgtggacgttcttgagttgagcgaagtacgcgggccggcgccggaagcacacaaacttttttgcgaaaccgacgagagcaaagccgctcgcgcgagggaagccgagatacggcggatgaaccgcgagttcacgccggcaccggtgggaaggccgtcgaagaaagaccggcggaggattattcagttcagaggtggaagatag

SEQ ID NO: 7393 - protein, 123 aa, Acidobacteria bacterium Ellin345
MRMDKWLWAARFYKTRGLAAKACELGRVLSKGQTVKAAREVKVGDRLNITTEGGVYDVDVLELSEVRGPAPEAHKLFCETDESKAARAREAEIRRMNREFTPAPVGRPSKKDRRRIIQFRGGR

SEQ ID NO: 7394 - DNA, 375 bp, Silicibacter sp. TM1040
  CDS (1)..(375): transl_table=11
atgagcgatcacgcggacaagatgcgggtcgacaaatggctgtggcacgcgcggtttttcaaaacccgctctctcgcggccaagcaagtcggcgcaggtcatgtccgcgtgaatggctccaaggctgcaaagccctctcagaacgtctccattggggacgttttgacctttccgcaggggcatcaggtgcgcgttgtgcgcatcacctccctttcggagcggcgtggaccagcaaccgaggctcaaacgctgtactttgatatgacggagaagcaggacaaaccgcctgccaatcccaaatacgaaggaaaaggtcgcccggataagaaagagcgcagggcgcttggtcttactcgcgtctgggacgggcattga

SEQ ID NO: 7395 - protein, 124 aa, Silicibacter sp. TM1040
MSDHADKMRVDKWLWHARFFKTRSLAAKQVGAGHVRVNGSKAAKPSQNVSIGDVLTFPQGHQVRVVRITSLSERRGPATEAQTLYFDMTEKQDKPPANPKYEGKGRPDKKERRALGLTRVWDGH

SEQ ID NO: 7396 - DNA, 435 bp, Rhodococcus sp. RHA1
  CDS (1)..(435): transl_table=11
gtgacgcgcccgcaggccacaccgtcacgcgcgctttcgtatcctggtcgggtggcgatttccggtaccgatcccgcgagcgtccgggtcgacagctggacctgggcgacccggctgttcaaaacgcggtccgcggcggcggccgcctgcaggtcggggcacgtgcgggtcaacggcaccaccgccaaaccggcgcagccggtcaaggccggtgacgaggtccgcgttcgcgcggcgggtgtcgaacgcatcgtcgaggttgtccggccgatcaccaaacgggtcggcgcggtggtggcggtcgagtgctacaccgacaacacaccaccgcccccaccgcgcgaagtcctcgcgtcgataccgcagcgcgaccgcggcgccggcaggcccaccaaacgcgaacgccgcgagatggaccggttgcgcgggttgtga

SEQ ID NO: 7397 - protein, 144 aa, Rhodococcus sp. RHA1
MTRPQATPSRALSYPGRVAISGTDPASVRVDSWTWATRLFKTRSAAAAACRSGHVRVNGTTAKPAQPVKAGDEVRVRAAGVERIVEVVRPITKRVGAVVAVECYTDNTPPPPPREVLASIPQRDRGAGRPTKRERREMDRLRGL

SEQ ID NO: 7398 - DNA, 411 bp, Haemophilus somnus 129PT
  CDS (1)..(411): transl_table=11
atggcaaaacagcatttacccaaggaaaaagatgatagtattcggctcgataaatggctatgggctgcacgcttttataaaacacgtactattgcaaaagaaatgattgacggtggaaaggtgcattataataaccaacgtactaaaccaaataaaacggtggaaattggtgcaatactcaaattgcgtcaaggtagtgaagaaaaagaagtagaagtgctggcactatctgcacaacgtcgtggtgcaccggaagcacaattgttgtatcgtgaaactgctaggagtgttgaacagcgagagaaaatggcaattgcacgtaagaataatgcactttctatgccacacccagatcgccgtccaaataaaaaagagcggagagatttattgaagtttaagtatcaggaatag

SEQ ID NO: 7399 - protein, 136 aa, Haemophilus somnus 129PT
MAKQHLPKEKDDSIRLDKWLWAARFYKTRTIAKEMIDGGKVHYNNQRTKPNKTVEIGAILKLRQGSEEKEVEVLALSAQRRGAPEAQLLYRETARSVEQREKMAIARKNNALSMPHPDRRPNKKERRDLLKFKYQE

SEQ ID NO: 7400 - DNA, 399 bp, Shewanella sp. MR-4
  CDS (1)..(399): transl_table=11
atggcgcaaagttcaggcgacagtgacagcgttcgactcgataagtggttatgggccgcacgtttttataaaacccgtgccattgccaaagaaatgatcaacggcggcaaagtacattacaacggtgctcgcaccaaatctagtaagaatgccgagataggtgccgtccttaagatacgacagggatatgacgataaagagatcgtcataaaaaaattatctgaaatacgccaaagcgcagcgattgcacaggaattgtacgaagaaacggccgtgagtatagccaagcgtgcggtaaatgccgaagcaagacgattgaatattctcaataatcctgcgcccgaccataaaccggataaaaagcaacgacgagcgcttatccgttttaaagaatgctaa

SEQ ID NO: 7401 - protein, 132 aa, Shewanella sp. MR-4
MAQSSGDSDSVRLDKWLWAARFYKTRAIAKEMINGGKVHYNGARTKSSKNAEIGAVLKIRQGYDDKEIVIKKLSEIRQSAAIAQELYEETAVSIAKRAVNAEARRLNILNNPAPDHKPDKKQRRALIRFKEC

SEQ ID NO: 7402 - DNA, 399 bp, Shewanella sp. MR-7
  CDS (1)..(399): transl_table=11
atggcgcaaagttcaggcgacagtgacagcgttcgactcgataagtggttatgggccgcacgtttttataaaacccgtgccattgccaaagaaatgatcaacggcggcaaagtacattacaacggtgctcgcaccaaatctagtaagaatgccgagataggtgccgtccttaagatacgacagggatatgacgataaagagatcgtcataaaaaaattatctgaaatacgccaaagcgcagcgattgcacaggaattgtacgaagaaacggccgcgagcatagccaagcgtgcggtaaatgccgaagcaagacgattgaatattctcaataatcctgcgcccgaccataaaccggataaaaagcaacgacgagcgcttatccgttttaaagaatgctaa

SEQ ID NO: 7403 - protein, 132 aa, Shewanella sp. MR-7
MAQSSGDSDSVRLDKWLWAARFYKTRAIAKEMINGGKVHYNGARTKSSKNAEIGAVLKIRQGYDDKEIVIKKLSEIRQSAAIAQELYEETAASIAKRAVNAEARRLNILNNPAPDHKPDKKQRRALIRFKEC

SEQ ID NO: 7404 - DNA, 411 bp, Alkalilimnicola ehrlichei MLHE-1
  CDS (1)..(411): transl_table=11
atgggtcaccgggacgaccaaccgacagcaaaggtccggctcgaccgctggctgtgggcggcgcgttttttcaagacgcgccgtctggccgtcgaggcgatcaagggcggcaaggtcgaggtggatggcgtgaacgccaagccggcacgggaggtcggtgccggtaaccgggtgcgggtgcgcaagggcgcgatcaccttcgaggtggtggtccgcgatgtcgccaaccagcgcggtccggcaaaggtagcgcagcagctctacgaggagacgccggagagtgtggccgcgcgggagaaggtgcgggagcagcagcgcatgaacgcggccttcgtgccccgcccggaccatcgcccggacaagcgcagccgccggcagctggcccgggtgaagcggggcggcggggagtag

SEQ ID NO: 7405 - protein, 136 aa, Alkalilimnicola ehrlichei MLHE-1
MGHRDDQPTAKVRLDRWLWAARFFKTRRLAVEAIKGGKVEVDGVNAKPAREVGAGNRVRVRKGAITFEVVVRDVANQRGPAKVAQQLYEETPESVAAREKVREQQRMNAAFVPRPDHRPDKRSRRQLARVKRGGGE

SEQ ID NO: 7406 - DNA, 405 bp, Rhizobium leguminosarum bv. viciae 3841
  CDS (1)..(405): transl_table=11
atgagcggggagacacagccgacaagcggttcgcgccagcgcatcgacaagtggctgttcttcgcgcgcatggcgaagtcacgctcggtggcgcagagccatatccaatcgggccatgtgcgcatcaacggagagcgttgcagctatccgagccagatggtcaagccgggcgaccgtatcgagctgacgctggagcggcgcgatgtcgttctcgtcgtgcgccttgccggcgagcggcggggtccttacgaggaggcgcggctgctctacgacgaccaatccccgccgcctgatgaggcaaaacgtctcacgccctacgagcaggcgatccgggcgaccggcaccggccgtccgaccaaaaaggaaagacgtgcaattgacaggctgatgtcggacgaggattag

SEQ ID NO: 7407 - protein, 134 aa, Rhizobium leguminosarum bv. viciae 3841
MSGETQPTSGSRQRIDKWLFFARMAKSRSVAQSHIQSGHVRINGERCSYPSQMVKPGDRIELTLERRDVVLVVRLAGERRGPYEEARLLYDDQSPPPDEAKRLTPYEQAIRATGTGRPTKKERRAIDRLMSDED

SEQ ID NO: 7408 - DNA, 396 bp, Pseudomonas aeruginosa UCBPP-PA14
  CDS (1)..(396): transl_table=11
gtgagcgagaaagacgacgacaaggtgcgcctggacaagtggctctgggcggcgcgcttcttcaagacccgggcgctggccaaggccgcgatagagggcggcaaggtgcattgccggggcgagcggtgcaagccgagcaaggaacccagggtaggggaggaattgaccattcgtacgggcttcgacgagcgaaccgtgacgattcgcgcgctttccgtagtccggcgtggcgcgccggaggcccaggctctctacgaggaaaccgcggacagcgtggaaagccgcgagcgcgcggcggccatgcgcaaggccggggcgctgggcgtacagaccgaggggcggccgagcaagaagcagcggcggcagatccaccagttgcgcggcggccaggactga

SEQ ID NO: 7409 - protein, 131 aa, Pseudomonas aeruginosa UCBPP-PA14
MSEKDDDKVRLDKWLWAARFFKTRALAKAAIEGGKVHCRGERCKPSKEPRVGEELTIRTGFDERTVTIRALSVVRRGAPEAQALYEETADSVESRERAAAMRKAGALGVQTEGRPSKKQRRQIHQLRGGQD

SEQ ID NO: 7410 - DNA, 408 bp, Solibacter usitatus Ellin6076
  CDS (1)..(408): transl_table=11
gtgaggattatcgtcgagaatagtcctatggacggcgtgaggatggacaagtggctgtgggccgcgcgattttttaagacgcgctcgctcgcctcgaaagcctgcgagctcggccgcatcgaatccaacggacagccggccaaagccgcgcgcgaagttcgtgccggcgacatgctccgtgtcaggaatgaaggcggcgatttcgaggtgctggtactgggcgtcagcgatatgcgcggaccggcggccttggcgcaactgctctaccgggaaaccgaagccagccgcgagctccgcctgaaactcgccgaggagcgccgcatgcagccctccttcgagaatacccgcgaaggccgtccttcgaaacgcgaccggcgcgtcatgggcaggctgcgaggacgctcgtga

SEQ ID NO: 7411 - protein, 135 aa, Solibacter usitatus Ellin6076
MRIIVENSPMDGVRMDKWLWAARFFKTRSLASKACELGRIESNGQPAKAAREVRAGDMLRVRNEGGDFEVLVLGVSDMRGPAALAQLLYRETEASRELRLKLAEERRMQPSFENTREGRPSKRDRRVMGRLRGRS

SEQ ID NO: 7412 - DNA, 393 bp, Magnetococcus sp. MC-1
  CDS (1)..(393): transl_table=11
atgtccccctctaacgaagcgcggttacgcattgataagtggttatgggcggcccgtttttttaaaacccgcgcccttgccaccgatgcggtcaacggggggcatgtccacctgaacggtcaacgaattaaagccagccatcaggttaaggttggggatcgcctggagatcaccaaaggccccgtgcagtttgcgctggtgatcgaagggctccatgacaaacgtggccccgcacccgcagcacagcagctctattgcgagtcggaggcgagcaaacaggcgcgggtggcggtggctgaccaacaacgtgccgagcgcatcagccgtcccgactatggcagtgcccgccccaccaaacgggatcgccgcgccatggaccggttaaaagggtag

SEQ ID NO: 7413 - protein, 130 aa, Magnetococcus sp. MC-1
MSPSNEARLRIDKWLWAARFFKTRALATDAVNGGHVHLNGQRIKASHQVKVGDRLEITKGPVQFALVIEGLHDKRGPAPAAQQLYCESEASKQARVAVADQQRAERISRPDYGSARPTKRDRRAMDRLKG

SEQ ID NO: 7414 - DNA, 399 bp, Shewanella sp. ANA-3
  CDS (1)..(399): transl_table=11
atgacgcaaagttcaggcgacagtggcagcgttcgactcgataagtggttatgggccgcacgtttttataaaacccgtgccattgccaaagaaatgatcaacggcggcaaagtacattacaacggtgctcgtaccaaatctagtaagaatgccgagataggtgccgtccttaagatacgacagggatatgacgataaagagatcgtcataaaaaaattatctgaaatgcgccaaagcgcgacgattgcgcaggaattgtacgaagaaacggctgctagtgtggccaagcgtgcggtaaacgccgaagcaagacgattgaatattctcaataatcctgcgcccgaccataaaccggataaaaagcaacgacgccaacttatccgttttaaagaatgctaa

SEQ ID NO: 7415 - protein, 132 aa, Shewanella sp. ANA-3
MTQSSGDSGSVRLDKWLWAARFYKTRAIAKEMINGGKVHYNGARTKSSKNAEIGAVLKIRQGYDDKEIVIKKLSEMRQSATIAQELYEETAASVAKRAVNAEARRLNILNNPAPDHKPDKKQRRQLIRFKEC

SEQ ID NO: 7416 - DNA, 405 bp, Azoarcus sp. BH72
  CDS (1)..(405): transl_table=11
gtgaccacctccccctcaggcagcgacgacgcccgcacccgcatcgacaagtggctgtgggcggcgcgcttcttcaagcaccgcaccggcgccaccgacgcggtcgacggcggcaaggtcaagctcaatggcagcgcggtgaagcccgcgcgcgacgtgaaggtcggggaccgcctcgacatcaccatcggcgaggagcagttcaccgtggtggtgcgcgcgatcgccgacaagcgcggaccggccagtgtggcccagacgctgtacgaagaaaccccggacagcgtcgaacgccgccaggccagccgcgaacagcgcaagctcgccgccaccccgggcgccgacctgcacggccgccccaccaagcgtgaccgccgccagatccgccgcttcaccgacttctga

SEQ ID NO: 7417 - protein, 134 aa, Azoarcus sp. BH72
MTTSPSGSDDARTRIDKWLWAARFFKHRTGATDAVDGGKVKLNGSAVKPARDVKVGDRLDITIGEEQFTVVVRAIADKRGPASVAQTLYEETPDSVERRQASREQRKLAATPGADLHGRPTKRDRRQIRRFTDF

SEQ ID NO: 7418 - DNA, 363 bp, Mycobacterium sp. KMS
  CDS (1)..(363): transl_table=11
atggattcgacccgtatagaccgctggttgtgggcggtccggctgaccaagacgcggccggacgccgcagccgcgtgccggggcgggcacgtgcgggtcaacgaccggcccgccaaaccgtcgaccaccgtggcacccggcgaccaggtgcgcgccctggtcggcgaccggatgcggatcgtcgaggtggtgcgggtgatccagaagcgggtcggtgcggccgatgcggtgacgtgctacctcgaccgcaccccgcctgcgcccaagaccaccgagatcccgctggcggtccgtgaccggggcgcaggacggccgacgaaacgagaccgccgacggctcgacagatggctcgcggggcaatga

SEQ ID NO: 7419 - protein, 120 aa, Mycobacterium sp. KMS
MDSTRIDRWLWAVRLTKTRPDAAAACRGGHVRVNDRPAKPSTTVAPGDQVRALVGDRMRIVEVVRVIQKRVGAADAVTCYLDRTPPAPKTTEIPLAVRDRGAGRPTKRDRRRLDRWLAGQ

SEQ ID NO: 7420 - DNA, 402 bp, Neisseria meningitidis FAM18
  CDS (1)..(402): transl_table=11
atgaaagacaagcacgattcttccgccatgcggctggacaaatggctttgggcggcacgttttttcaagacccgttcccttgcgcaaaagcacatcgaactgggtagggttcaagtaaacggctcgaaggtcaaaaacagtaaaaccatagacatcggcgatattatcgacctgacgctcaattcccttccctataaaatcaaggttaaaggtttgaaccaccaacgccgcccggcatccgaggcgcggcttctgtatgaagaggacgcgaaaacggcaacattgagggaagagcgcaaacagctcgaccaattcagccgcatcacttccgcctatcccgacggcagaccgaccaagcgcgaccgccgccaactggacaggctgaaaaaaggagactggtaa

SEQ ID NO: 7421 - protein, 133 aa, Neisseria meningitidis FAM18
MKDKHDSSAMRLDKWLWAARFFKTRSLAQKHIELGRVQVNGSKVKNSKTIDIGDIIDLTLNSLPYKIKVKGLNHQRRPASEARLLYEEDAKTATLREERKQLDQFSRITSAYPDGRPTKRDRRQLDRLKKGDW

SEQ ID NO: 7422 - DNA, 426 bp, Acidovorax sp. JS42
  CDS (1)..(426): transl_table=11
atgacgacaccacccgatgcaatgcgcctggacaaatggctgtggtgcgcgcgcttctacaagacccgcagcctcgccgtggaagagatcggcaaaggccgcgtaaccgtcaacggccaggcggccaaagccgcgcgtgaactgcgcgcgggcgacaccgtcgcgctgcgccagggcgcggtagcccgcacggtcgtggtgcgcgccttgagcaacttccgcagcccggcgcccgtggcgcagcagctctatgaggaaacgcccgagagcctcgccgcgcgcgcgcaggccgccgaagcgcgccgcctggcgcccgagccagccgccgcgctgcgcgagggccgccccaccaagcgcgaccgccgctccatggaccacctgcgccatgactgggacgaccgctggagcgcctccatcgacgactga

SEQ ID NO: 7423 - protein, 141 aa, Acidovorax sp. JS42
MTTPPDAMRLDKWLWCARFYKTRSLAVEEIGKGRVTVNGQAAKAARELRAGDTVALRQGAVARTVVVRALSNFRSPAPVAQQLYEETPESLAARAQAAEARRLAPEPAAALREGRPTKRDRRSMDHLRHDWDDRWSASIDD

SEQ ID NO: 7424 - DNA, 411 bp, Haemophilus somnus 2336
  CDS (1)..(411): transl_table=11
atggcaaaacagcatttacccaaggaaaaagatgatagtattcggctcgataaatggctatgggctgcacgcttttataaaacacgtactattgcaaaagaaatgattgacggtggaaaggtgcattataataaccaacgtactaaaccaaataaaacggtggaaattggtgcaatactcaaattgcgtcaaggtagtgaagaaaaagaagtagaagtgctagccctatctgcacaacgtcgtggtgcaccggaagcacaattgttgtatcgtgaaaccactaggagtgttgaacagcgagagaaaatggcaatcgcacgtaagaataatgtactttctatgccacacccagatcgccgtccaaataaaaaagagcggagagatttattgaagtttaagtatcaggaatag

SEQ ID NO: 7425 - protein, 136 aa, Haemophilus somnus 2336
MAKQHLPKEKDDSIRLDKWLWAARFYKTRTIAKEMIDGGKVHYNNQRTKPNKTVEIGAILKLRQGSEEKEVEVLALSAQRRGAPEAQLLYRETTRSVEQREKMAIARKNNVLSMPHPDRRPNKKERRDLLKFKYQE

SEQ ID NO: 7426 - DNA, 381 bp, Magnetospirillum magnetotacticum MS-1
  CDS (1)..(381): transl_table=11
atggtgacgaccgaggcgacgagcgcgcgcgtcgacagctggctgtgggccgtccgcgtgttcaagagccgctcgcaggcgacggccgccgtgaaggcggggcacgtgcgcgtcaacggcgagcgcgcgaagcccgcgacgagcgtgaaggtcaaggaccgcgtcgtcgtgcggggcggtccggtcgagcggatcctcgtcgtcgagaaggtgctcgtgaagcgggtgtccgcgaccctcgccgcgacggccgtcgacgaccagagcccacccccgccgccgcgcgagctcaccgtgcgcgtcgcggtccgcgaccgcggtgccgggcgccccacgaagcgcgagcgccgcgacctcgaccggctgcggggccggggctga

SEQ ID NO: 7427 - protein, 126 aa, Magnetospirillum magnetotacticum MS-1
MVTTEATSARVDSWLWAVRVFKSRSQATAAVKAGHVRVNGERAKPATSVKVKDRVVVRGGPVERILVVEKVLVKRVSATLAATAVDDQSPPPPPRELTVRVAVRDRGAGRPTKRERRDLDRLRGRG

SEQ ID NO: 7428 - DNA, 378 bp, Croceibacter atlanticus HTCC2559
  CDS (1)..(378): transl_table=11
atgcgagtagaaaaatatttatggtgtgtaagatattttaagactagaagtcttgccactaaagcgtgtaatcttggtcgcgtaaagatagacggccaaaatctcaagccctcaagagaagttcatcccttagatgaaattgaagtgagaaaaaatcagattaattataaaattagagtacttgacacccctaaatctagagttggtgctaaattagttggattatatcttgtagatattacacctgcagaaaacttagagaaattagacctattgagttatacaaaatctcaacagcgcgaaaaaggtacaggaagacctactaaaaaagaccgtagagatattgagggttttatagacgatacagatgacatctaa

SEQ ID NO: 7429 - protein, 125 aa, Croceibacter atlanticus HTCC2559
MRVEKYLWCVRYFKTRSLATKACNLGRVKIDGQNLKPSREVHPLDEIEVRKNQINYKIRVLDTPKSRVGAKLVGLYLVDITPAENLEKLDLLSYTKSQQREKGTGRPTKKDRRDIEGFIDDTDDI

SEQ ID NO: 7430 - DNA, 393 bp, Oceanicola batsensis HTCC2597
  CDS (1)..(393): transl_table=11
gtggctgagcaaccgaccaagttcaggctcgacaagtggatatggcaggcgcgattcgtgaaatcgcgcagcctggccgccgggctggtcaccggcggtcacgtccgcgtcaacggtatgcgcgcggccaagccctcgcacggggtccagccgggcgatgtgctgacctttcctcagggcgaccgcatccgcgtcgtgcgcatcctcgcccccgccgcgcgccgtggaccggcagccgaggcgcaggcgctttacgaggacatgtcgccccccgaggagaagacgcaaatcccgcaaggggcccggaacgagggcaattctcgtcccacgaagcgggatcgccggaaactcgatctttatcgcaagggcatgggcgatgacgcgcttgaatga

SEQ ID NO: 7431 - protein, 130 aa, Oceanicola batsensis HTCC2597
MAEQPTKFRLDKWIWQARFVKSRSLAAGLVTGGHVRVNGMRAAKPSHGVQPGDVLTFPQGDRIRVVRILAPAARRGPAAEAQALYEDMSPPEEKTQIPQGARNEGNSRPTKRDRRKLDLYRKGMGDDALE

SEQ ID NO: 7432 - DNA, 414 bp, Pseudoalteromonas tunicata D2
  CDS (1)..(414): transl_table=11
gtggctcactcaacaaaaaaaaatagtaatactgaagaccatgcgcttaggcttgataagtggctttgggcggcacgtttttataaaacgcgggctttagcacgagaagtgattttaggtggcaaagtgcaatataatggccaacgctgcaaaccaagtaaaatagttgaagtgggtgccataattaagctcactcagggacatgatgaaaaaatcattaccgttatgcaactctcggctaatcgcttaaaagccgaacttgcacagctgttataccaagaatcagatcaaagtattaaaaaacgggaagagaatcatcaagcgcgtaaactcaatgcgtttttctcacccagcccagatcgtaagcccgataaaaaacaacgtcggactcttattaaatttaagcaaagctag

SEQ ID NO: 7433 - protein, 137 aa, Pseudoalteromonas tunicata D2
MAHSTKKNSNTEDHALRLDKWLWAARFYKTRALAREVILGGKVQYNGQRCKPSKIVEVGAIIKLTQGHDEKIITVMQLSANRLKAELAQLLYQESDQSIKKREENHQARKLNAFFSPSPDRKPDKKQRRTLIKFKQS

SEQ ID NO: 7434 - DNA, 411 bp, Photobacterium sp. SKA34
  CDS (1)..(411): transl_table=11
atgggtcaagcgacatccgaactaaaacaggttcgtcttgataaatggttatgggctgcacgtttttataagactcgttctgttgctcgcgcgatgattgatggcggcaaagtgcaatataacgggcaacgctcaaaaccaagtaaaatggttgaagttggcgctgaagtaaaattacgccaaggtaacgatgaaaaaaccgttaccatcgaaaagatctctgatacccgccgtggtgcaccggaagcacaattgctatatcaagaaacaacacaaagtattgaattacgggaacgccatgcacaaatgcgcaaactcaatgcttttgatagtccgagtccgatcaaacgaccagataaaaaacaacgtcgtgacatcatgagattcaaaaacatcaatacatcagaataa

SEQ ID NO: 7435 - protein, 136 aa, Photobacterium sp. SKA34
MGQATSELKQVRLDKWLWAARFYKTRSVARAMIDGGKVQYNGQRSKPSKMVEVGAEVKLRQGNDEKTVTIEKISDTRRGAPEAQLLYQETTQSIELRERHAQMRKLNAFDSPSPIKRPDKKQRRDIMRFKNINTSE

SEQ ID NO: 7436 - DNA, 420 bp, Oceanospirillum sp. MED92
  CDS (1)..(420): transl_table=11
atgacccacagtgaagagaaagtccgccttgataagtggttatgggcggcacgcttttataaaacccgggctatcgctaagcagatgatcgaaggcggtaaggtccattacaacggtcagcgtaccaaatgtagtcgtcatgtagaggttggcgctgtgttggaaatccgccagggctttgatgagaaagagatcgttgtggtgatgctttctgatcagcgcagaggtgcgccggaagcaatgaagctatatcaggagaccgaagccagtatcaaaaagcgcgaggagcatgccgctcagcgcaaggcgatgggaagtggtcttaacccgcgtaaccggcctaacaagaaagagcgtaggcaaatcaaatcgttcaaagatggtgaacgcagtatctttgataaaggaggaagtttctga

SEQ ID NO: 7437 - protein, 139 aa, Oceanospirillum sp. MED92
MTHSEEKVRLDKWLWAARFYKTRAIAKQMIEGGKVHYNGQRTKCSRHVEVGAVLEIRQGFDEKEIVVVMLSDQRRGAPEAMKLYQETEASIKKREEHAAQRKAMGSGLNPRNRPNKKERRQIKSFKDGERSIFDKGGSF

SEQ ID NO: 7438 - DNA, 378 bp, Flavobacteria bacterium BBFL7
  CDS (1)..(378): transl_table=11
atgcgagttgacaaatatttatgggctactagatacttcaaaaccagaagcaaagctacagatgccgcaaaaaaaggacgaattagaataggtgattcgatagtaaaaccatctagagacgtgtatcctggagatataattaacgttagaaaagatcaaatcgattatattatagaagtacttgatttaccagagagtcgagtaggaaataaactagtcaatttatataggttagatcgtactccacaggaaaattttgaagctcgtaaaatgattgaattaaatcaagactattatagacgaaaaggtgaaggacgcccaacaaaaaaagaccgtagagacttgagcgatttattagggcagcaagaagaagaatga

SEQ ID NO: 7439 - protein, 125 aa, Flavobacteria bacterium BBFL7
MRVDKYLWATRYFKTRSKATDAAKKGRIRIGDSIVKPSRDVYPGDIINVRKDQIDYIIEVLDLPESRVGNKLVNLYRLDRTPQENFEARKMIELNQDYYRRKGEGRPTKKDRRDLSDLLGQQEEE

SEQ ID NO: 7440 - DNA, 399 bp, delta proteobacterium MLMS-1
  CDS (1)..(399): transl_table=11
atgatggtaaaagcggagaaaatcaggcttgatatctggctctgggcggcccgctttttcaagacccggaccctggcgggacaagcggtaagcggcggtaaggtgcatcttaacggtggccgggtaaaagcggcccggttggtgggctccgacgatctcctggagattcgcaagggggtactggccttcacggtgacggtgcggggtaccagccggcagcgcctggcggcgccgctggccgccgaactctatgaagaaagtccggagagtctggccgcccgccaggccgccagccaggagcgccgcacggcggctaaggccgggccgcaagcccccaggggtaaacccgccaaacgggatcggcgcctgattaaaaaatttatccgccgggatgagtga

SEQ ID NO: 7441 - protein, 132 aa, delta proteobacterium MLMS-1
MMVKAEKIRLDIWLWAARFFKTRTLAGQAVSGGKVHLNGGRVKAARLVGSDDLLEIRKGVLAFTVTVRGTSRQRLAAPLAAELYEESPESLAARQAASQERRTAAKAGPQAPRGKPAKRDRRLIKKFIRRDE

SEQ ID NO: 7442 - DNA, 405 bp, Oceanobacter sp. RED65
  CDS (1)..(405): transl_table=11
atggcagacaaagacaacgcaaaaatacgtttggataaatggttatgggctgcaaggttttataaaacccgcgctttggccaaaaccgcaatcgaaggcggcaaagtccaatatgagggccagcgcagcaaagtgagtaaaatagtcgagcttggcgccactataaaagtgcgacaaggtttcgacgataaagtcgtagtggtgaaggcgttgagtgatcagcgccgaggagctcccgaagcccaattactgtatgaagaaacagctgagagtatcaagcatagaatggatgaaactgagcgccgtcgtaaatttaagcaagccaatccattgttcgatcataagcccaataaaaaagagcgccgtcaaatggaaaagtggcgtaaggatacaatgccttcataa

SEQ ID NO: 7443 - protein, 134 aa, Oceanobacter sp. RED65
MADKDNAKIRLDKWLWAARFYKTRALAKTAIEGGKVQYEGQRSKVSKIVELGATIKVRQGFDDKVVVVKALSDQRRGAPEAQLLYEETAESIKHRMDETERRRKFKQANPLFDHKPNKKERRQMEKWRKDTMPS

SEQ ID NO: 7444 - DNA, 423 bp, Alteromonadales bacterium TW-7
  CDS (1)..(423): transl_table=11
atgagtaaaaaaagtaatagtaataaagactcagacctcacagataacctaaaagttcgattagataaatggttatgggcagcacgcttttataaaacacgtgcgatagcaagggaaatggtacaaggcggtaaagtgcattataatggacagcgaacaaaggcgagtaaaatagtcgaggttggtgcggtagtgaaactcgctcaaggcgtagatgaaaaaatcgtaaccataactaaggtgcttgaaaaacgacaaagcgcccccattgctcagaccttgtaccaagaatctgatgctagtatcgccaaacgcgaagaaaacagcatcgcacgtaaaaataatagcttttttgctcctcatccggataaaaaacccgataaaaagcaaagacgcgaacttttaaaaatgaaatcaagttag

SEQ ID NO: 7445 - protein, 140 aa, Alteromonadales bacterium TW-7
MSKKSNSNKDSDLTDNLKVRLDKWLWAARFYKTRAIAREMVQGGKVHYNGQRTKASKIVEVGAVVKLAQGVDEKIVTITKVLEKRQSAPIAQTLYQESDASIAKREENSIARKNNSFFAPHPDKKPDKKQRRELLKMKSS

SEQ ID NO: 7446 - DNA, 417 bp, marine gamma proteobacterium HTCC2143
  CDS (1)..(417): transl_table=11
atgaatagtcccagccacccctttcccaccgcaaaggtccgactggacaaatggctgtgggcagctcgattttttaagacccgcagtctggcaaagcaagccattgaaggcgggaaagttcactacaatggtactcgcagtaaagtcagcaaggaaacagaggtcggtgcaaagctgacgattcgtatcggcctagatgaagttgaagttgaagttattgcgctatcggaccaacgccgcggcgcgccggtggcaaacttactctacgctgaaacgagcgacagtatacggaaacgcgaaattgaggcccagcagcgtaaagtcatgcgagggcttgatatcggccgccgcgaaagacccaataaaaaacagcgtcggcaaattcaccagttcaaacaagatagcgacaaaagctaa

SEQ ID NO: 7447 - protein, 138 aa, marine gamma proteobacterium HTCC2143
MNSPSHPFPTAKVRLDKWLWAARFFKTRSLAKQAIEGGKVHYNGTRSKVSKETEVGAKLTIRIGLDEVEVEVIALSDQRRGAPVANLLYAETSDSIRKREIEAQQRKVMRGLDIGRRERPNKKQRRQIHQFKQDSDKS

SEQ ID NO: 7448 - DNA, 417 bp, marine gamma proteobacterium HTCC2080
  CDS (1)..(417): transl_table=11
atggataaacagaccaaagtcaccaaggttcgcgtcgataagtggctttgggcagcacgattttttaaaactcgcagtcttgccaaagccgcgatcgagggtggcaaagttcaacttgaggggcaaagagtaaaagtcagtcgagagatagccattggagatcgtctgacaatacgccaaggttgggatgaaaaagatatcacagtacgaagtctgagcgaccagagaggccccgcgtcaagagcccaggagctgtacgaagaatctgtggagagcattgcccgtcgcgagcgagaaaccttgttgcgacgcgctgccggcggtctaaatagacccgatcaccgtcccgataaacatcaacggcgacagatcagccgcttacggcgcgatggagggcctaaccccgagggcgattaa

SEQ ID NO: 7449 - protein, 138 aa, marine gamma proteobacterium HTCC2080
MDKQTKVTKVRVDKWLWAARFFKTRSLAKAAIEGGKVQLEGQRVKVSREIAIGDRLTIRQGWDEKDITVRSLSDQRGPASRAQELYEESVESIARRERETLLRRAAGGLNRPDHRPDKHQRRQISRLRRDGGPNPEGD

SEQ ID NO: 7450 - DNA, 402 bp, Pseudomonas putida GB-1
  CDS (1)..(402): transl_table=11
atggcacaaaaagacgaagacgacgataaggttcgtctggacaaatggctgtgggcggcgcgcttttacaagacgcgagcgctggccaaggccgcgatcgaaagcggcaaggtgcattgccggggcgagcgatgcaagccgggcaaagaaccgcgggtgggcgacgagttcgtgctgcgcaccgggttcgatgaacgtactgtggtggtgaaagcgttgtcggtggtgcggcgtggggcgccagaggcgcagacgctgtacgaggaaaccgaagaaagtgtgcgtcgccgtgagcaggcggccgacctgcgtaaggcgggggcgatgggggtgactaccgatggccggccgaccaaaaagcagcggcggcagatacaccagttgcatgggagctttgaatag

SEQ ID NO: 7451 - protein, 133 aa, Pseudomonas putida GB-1
MAQKDEDDDKVRLDKWLWAARFYKTRALAKAAIESGKVHCRGERCKPGKEPRVGDEFVLRTGFDERTVVVKALSVVRRGAPEAQTLYEETEESVRRREQAADLRKAGAMGVTTDGRPTKKQRRQIHQLHGSFE

SEQ ID NO: 7452 - DNA, 411 bp, Marinobacter sp. ELB17
  CDS (1)..(411): transl_table=11
atggctacacccaacaaaaacgacgatgaccgcgtcaggctggacaagtggctatgggccgcgcgctttttcaaaactcgtgccctggccaaagccgcggtggaaggcggcaaagtgcgttacaacacccagcgttgcaagcccggcaaactgatggaagcaggggcggaactgtcgatacggctgggctggcaggaaaaaattgtggtggtagacgatatcagcgaccgccgcggcggggcagcggaagcggccctgctttatcacgaaaccgaagacagcgtgaaaaagcgcgaagacctggcctggcaacgcaaaactctgcaaacttcccagcttccgccggcacggcgcccgtcgaaaaaggaccgccgcgacatagaccggtttcgcgaacacaacgggctctag

SEQ ID NO: 7453 - protein, 136 aa, Marinobacter sp. ELB17
MATPNKNDDDRVRLDKWLWAARFFKTRALAKAAVEGGKVRYNTQRCKPGKLMEAGAELSIRLGWQEKIVVVDDISDRRGGAAEAALLYHETEDSVKKREDLAWQRKTLQTSQLPPARRPSKKDRRDIDRFREHNGL

SEQ ID NO: 7454 - DNA, 417 bp, Moritella sp. PE36
  CDS (1)..(417): transl_table=11
atggttgcattaattatgtcaaaaaataccaaaccagatagtagtgatgtgcgtttcgataaatggctatgggctgcccggttttataaaacccgcgccattgccagagaaatgatccaaagtggcaaaattcgctacaatgaccaacgcactaaacccagtaaaaccgttgagttgggtgcaacaataaaaataagacaaggctttgatgaaaaggaagtgatcgtaaagcagctttccgcgcaaaggagaggggcaccagaagcggctaccttgtatgaagaaacaccaagtagtgttgaaaagcgtgcacaaaatgatgtcgcgcgtaaactaaatacattgtataacccctgccccgataaacgtcccgacaagaaacaacgtcgagaactattgcggataaaaaatcattaa

SEQ ID NO: 7455 - protein, 138 aa, Moritella sp. PE36
MVALIMSKNTKPDSSDVRFDKWLWAARFYKTRAIAREMIQSGKIRYNDQRTKPSKTVELGATIKIRQGFDEKEVIVKQLSAQRRGAPEAATLYEETPSSVEKRAQNDVARKLNTLYNPCPDKRPDKKQRRELLRIKNH

SEQ ID NO: 7456 - DNA, 372 bp, uncultured Flavobacteriaceae bacterium
  CDS (1)..(372): transl_table=11
atgcgtattgacaagtatttatggtgtataaggtattttaaaacaagaactattgctacaactgcctgcaggaaagggcacgttagaatcaataaagaaattgctaaacctagcagagaagtttatccacaagatttaattgaattaagaaaagatcaaataaattatcaacttgttgtaaatgatattcctgaaaacagaataggagctaaacttgttgacatttacagaacggataaaacaccaaaagaacaatttgaagctcatgaacttttaaaattatctaaagattattacagaaaaaaaggtgttggaagacctacaaaaaaagatagaagagatatggataattttaatgatgaaaatgagtaa

SEQ ID NO: 7457 - protein, 123 aa, uncultured Flavobacteriaceae bacterium
MRIDKYLWCIRYFKTRTIATTACRKGHVRINKEIAKPSREVYPQDLIELRKDQINYQLVVNDIPENRIGAKLVDIYRTDKTPKEQFEAHELLKLSKDYYRKKGVGRPTKKDRRDMDNFNDENE

SEQ ID NO: 7458 - DNA, 399 bp, Aeromonas salmonicida
  CDS (1)..(399): transl_table=11
atgccgaatcccgcagaaaccacaacccaggtccgcctcgacaaatggttgtgggccgcgcgtttttacaagacccgcagcctggcccgcgatcagattgaagggggcaaggtgcactataacggccagcgcagcaaacctggcaaggccgttgaagccggcgccctcatccgtgtctggcagggccaggacgagcgggaggtacgggtactgcaagtgagcgaacagcgcaagtccgccccgctggcccagctgctctatgaagagacggaagccagcctgaaaaaacgggccgagaacagcgaggcgcgccgcttcaacagccagtttgccccgagccccgagcgtcgccccgacaagcaggagcggcgccagctgatcaaggtcaagcaatactga

SEQ ID NO: 7459 - protein, 132 aa, Aeromonas salmonicida
MPNPAETTTQVRLDKWLWAARFYKTRSLARDQIEGGKVHYNGQRSKPGKAVEAGALIRVWQGQDEREVRVLQVSEQRKSAPLAQLLYEETEASLKKRAENSEARRFNSQFAPSPERRPDKQERRQLIKVKQY

SEQ ID NO: 7460 - DNA, 396 bp, Haemophilus influenzae
  CDS (1)..(396): transl_table=11
atggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcatgggcaagaaaaaataattccctttcaatgccccatcctgatcgtcgcccaaataaaaaagagcggagagatttattgaaatttaaacaccaagataaatttgaataa

SEQ ID NO: 7461 - protein, 131 aa, Haemophilus influenzae
MAEKEVRLDKWLWAARFYKTRSIAKAMIESGKVHYNNQRAKVSKIVEVGAMLKLRQGNEEKEIKIIALSDQRRGAPEAQLLYQETESSVKKREEIAWARKNNSLSMPHPDRRPNKKERRDLLKFKHQDKFE

SEQ ID NO: 7462 - DNA, 22 bp, Artificial sequence
  primer
atgaaagagaaacctgctgttg

SEQ ID NO: 7463 - DNA, 23 bp, Artificial sequence
  primer
ttattcactgtcgccgtgtttaa

SEQ ID NO: 7464 - protein, 119 aa, Artificial sequence
  consensus sequence
  Variant (2)..(2): Xaa in position 2 is any amino acid
  Variant (11)..(12): Xaa in position 11 to 12 is any amino acid
  Variant (16)..(17): Xaa in position 16 to 17 is any amino acid
  Variant (19)..(24): Xaa in position 19 to 24 is any amino acid
  Variant (26)..(26): Xaa in position 26 is any amino acid
  Variant (28)..(30): Xaa in position 28 to 30 is any amino acid
  Variant (32)..(34): Xaa in position 32 to 34 is any amino acid
  Variant (35)..(35): Xaa in position 35 is any or no amino acid
  Variant (37)..(43): Xaa in position 37 to 43 is any amino acid
  Variant (45)..(66): Xaa in position 45 to 66 is any amino acid
  Variant (67)..(70): Xaa in position 67 to 70 is any or no amino acid
  Variant (72)..(73): Xaa in position 72 to 73 is any amino acid
  Variant (75)..(76): Xaa in position 75 to 76 is any amino acid
  Variant (78)..(79): Xaa in position 78 to 79 is any amino acid
  Variant (82)..(88): Xaa in position 82 to 88 is any amino acid
  Variant (89)..(90): Xaa in position 89 to 90 is any or no amino acid
  Variant (92)..(102): Xaa in position 92 to 102 is any amino acid
  Variant (103)..(111): Xaa in position 103 to 111 is any or no amino acid
  Variant (114)..(114): Xaa in position 114 is any amino acid
  Variant (116)..(117): Xaa in position 116 to 117 is any amino acid
RXDKWLWAARXXKTRXXAXXXXXXGXVXXXGXXXXKXXXXXXXGXXXXXXXXXXXXXXXXXXXXXXXXXXRXXAXXAXXLYXXXXXXXXXRXXXXXXXXXXXXXXXXXXXXRPXKXXRR

SEQ ID NO: 7465 - protein, 38 aa, Artificial sequence
  protein pattern
  Variant (2)..(2): Xaa in position 2 is any amino acid
  Variant (4)..(4): Xaa in position 4 is any amino acid
  Variant (8)..(8): Xaa in position 8 is any or no amino acid
  Variant (10)..(10): Xaa in position 10 is any or no amino acid
  Variant (12)..(12): Xaa in position 12 is Phe, Leu or Val
  Variant (13)..(13): Xaa in position 13 is any amino acid
  Variant (14)..(14): Xaa in position 14 is Lys or Arg
  Variant (15)..(15): Xaa in position 15 is any amino acid
  Variant (17)..(18): Xaa in position 17 to 18 is any amino acid
  Variant (20)..(24): Xaa in position 20 to 24 is any amino acid
  Variant (25)..(25): Xaa in position 25 is any or no amino acid
  Variant (27)..(27): Xaa in position 27 is His, Lys or Arg
  Variant (28)..(28): Xaa in position 28 is Ile or Val
  Variant (29)..(37): Xaa in position 29 to 37 is any amino acid
  Variant (38)..(38): Xaa in position 38 is Ala, Gly, Asn, Pro or Ser
RXDXWLWXAXRXXXXRXXAXXXXXXGXXXXXXXXXXXX

SEQ ID NO: 7466 - protein, 9 aa, Artificial sequence
  protein pattern
  Variant (2)..(2): Xaa in position 2 is any or no amino acid
  Variant (4)..(4): Xaa in position 4 is Asp, Asn, Ser or Thr
  Variant (6)..(6): Xaa in position 6 is Lys or Arg
  Variant (7)..(7): Xaa in position 7 is Ala, Asp, Glu, Gln or Ser
RXPXKXXRR

SEQ ID NO: 7467 - DNA, 237 bp, Escherichia coli
  CDS (1)..(237): transl_table=11
atggcttcacttattcaggtgcgcgatttgctggcgttacggggccgtatggaagcggcccagataagccagacattgaacactccacagccaatgattaacgccatgctgcaacaactggaaagtatgggcaaagccgtgcggattcaggaagaacctgacggctgcctctctggcagttgtaaaagctgcccggaaggaaaagcctgtctgcgcgagtggtgggcgctgcgttaa

SEQ ID NO: 7468 - protein, 78 aa, Escherichia coli
MASLIQVRDLLALRGRMEAAQISQTLNTPQPMINAMLQQLESMGKAVRIQEEPDGCLSGSCKSCPEGKACLREWWALR

SEQ ID NO: 7469 - DNA, 264 bp, Proteus mirabilis
  CDS (1)..(264): transl_table=11
ctgtcactaagtcacaaaaggaaaaataagatggcaagtttgatgcaagttcgtgattgtgtcgcgcttaacggtcgggctgatgctcgtcttgtcagccatcagcttaatatgcctgaacctatggtaaaagcgatgttagagcggcttacgttaatgggtaaattacaagaggtcgatgtagaagagtgcttggtgggtagctgtaaaagctgccctgaagccaccgcatgtcagactaaagtttatcaattacgctcctaa

SEQ ID NO: 7470 - protein, 87 aa, Proteus mirabilis
LSLSHKRKNKMASLMQVRDCVALNGRADARLVSHQLNMPEPMVKAMLERLTLMGKLQEVDVEECLVGSCKSCPEATACQTKVYQLRS

SEQ ID NO: 7471 - DNA, 351 bp, Enterobacter cloacae
  CDS (1)..(351): transl_table=11
ttggcctgctgcgccgggcgcgtagccgcgttgacattaacctgctggcaacgcgcaaaaccccaacgacctgctgtaacagcccagcaggcgactgtcactgaggggaaaaagatggcatcgttgattcaggttcgtgacttactggcgttacagggacgaatggaggcgaagcagctcagcctcagcctgcatacgccgcagccgatgatcgatgccatgctggaaaggctggaggcgatggggaaagccgtgcgcattcaggaagagccggacggttgtctgtccggcagttgcaagagttgtcctgaaggtaaagcctgtctcagggagtggtggacgcttcgctga

SEQ ID NO: 7472 - protein, 116 aa, Enterobacter cloacae
LACCAGRVAALTLTCWQRAKPQRPAVTAQQATVTEGKKMASLIQVRDLLALQGRMEAKQLSLSLHTPQPMIDAMLERLEAMGKAVRIQEEPDGCLSGSCKSCPEGKACLREWWTLR

SEQ ID NO: 7473 - DNA, 243 bp, Pseudomonas aeruginosa PAO1
  CDS (1)..(243): transl_table=11
atggcgacactcatgcagctccgcgccgccctggaagacggccaggcgcgtgggctgaaacagctcagccgccaggtggacgcgccgccggcgctggtggaggcgatcctggagcggctgatcgcgctcggcaaggtcgagcgggtggctgcgcaaagctcgggcggttgcggcggcggttgcaagggctgcgcccagcgcgatccgtgcgcggagccggagccgtatttccgcctgcgctag

SEQ ID NO: 7474 - protein, 80 aa, Pseudomonas aeruginosa PAO1
MATLMQLRAALEDGQARGLKQLSRQVDAPPALVEAILERLIALGKVERVAAQSSGGCGGGCKGCAQRDPCAEPEPYFRLR

SEQ ID NO: 7475 - DNA, 258 bp, Yersinia pestis CO92
  CDS (1)..(258): transl_table=11
atggccagcctactgcaactacgtgatgcgattgccctcaacggcagcgctgaagccagccagctaagccggcagttggcaataccgttgcccttggtcaacgccatgctggagaagttaaccgccatggggaagatagaacgtattgagttggatcatagcggctgcctgacaggcagttgcaaaagctgtcccgaaggccatcagcactgtaatactgtgatctatcagttaaaagaacctcacgcacaccaataa

SEQ ID NO: 7476 - protein, 85 aa, Yersinia pestis CO92
MASLLQLRDAIALNGSAEASQLSRQLAIPLPLVNAMLEKLTAMGKIERIELDHSGCLTGSCKSCPEGHQHCNTVIYQLKEPHAHQ

SEQ ID NO: 7477 - DNA, 246 bp, Escherichia coli CFT073
  CDS (1)..(246): transl_table=11
ttgccattaatggcttcacttattcaggtgcgtgatttgctggcgttacggggccgtatggaagcggcccagattagccagacactgaacactccgcagccaatgattaacgccatgctgaaacagctagaaagtatgggaaaagcagtgcggattcaggaagaacctgacggctgtctttccggcagttgtaaaagctgcccggaaggaaaagcctgtctgcacgaatggtgggcgttgcgttaa

SEQ ID NO: 7478 - protein, 81 aa, Escherichia coli CFT073
MPLMASLIQVRDLLALRGRMEAAQISQTLNTPQPMINAMLKQLESMGKAVRIQEEPDGCLSGSCKSCPEGKACLHEWWALR

SEQ ID NO: 7479 - DNA, 240 bp, Photorhabdus luminescens subsp. laumondii TTO1
  CDS (1)..(240): transl_table=11
atgattagcctattacaagtaagggatgccgtcgctctgaatgggcgagcagatgctaagttgttaagccaccagctttctgcttcattatcgatggtagaagcgatgcttgaacaactcaccgtaatgggcaaactggaaaagctcaatgcaactgcctgcctgagtggcagttgcaaacagtgcccggaagtacagcaatgtgacacggtggtttatcggatcgctgggggatactga

SEQ ID NO: 7480 - protein, 79 aa, Photorhabdus luminescens subsp. laumondii TTO1
MISLLQVRDAVALNGRADAKLLSHQLSASLSMVEAMLEQLTVMGKLEKLNATACLSGSCKQCPEVQQCDTVVYRIAGGY

SEQ ID NO: 7481 - DNA, 228 bp, Klebsiella pneumoniae subsp. pneumoniae MGH 78578
  CDS (1)..(228): transl_table=11
atggaagtccgcgatatgctggccctgcagggccgcatggaggcgaaacagctcagtgctcgcctgcagacacctcagccgctgattgacgccatgcttgagcgaatggaagccatgggtaaggtggtccggatcagcgaaacgagcgagggctgcctctccggcagctgtaaaagttgccctgaagggaaagcggcgtgccggcaggagtggtgggcgctgcgatga

SEQ ID NO: 7482 - protein, 75 aa, Klebsiella pneumoniae subsp. pneumoniae MGH 78578
MEVRDMLALQGRMEAKQLSARLQTPQPLIDAMLERMEAMGKVVRISETSEGCLSGSCKSCPEGKAACRQEWWALR

SEQ ID NO: 7483 - DNA, 243 bp, Pseudomonas aeruginosa UCBPP-PA14
  CDS (1)..(243): transl_table=11
atggcgacactcatgcagatccgcgccgccctggaagacggccaggcgcgtgggctgaaacagctcagccgccaggtggacgcgccgccggcgctggtggaggcgatcctggagcggctgatcgcgctcggcaaggtcgagcgggtggctgcgcaaagctcgggcggttgcggcggcggttgcaagggctgcgcccagcgcgatccgtgcgcggagccggagccgtatttccgcctgcgctag

SEQ ID NO: 7484 - protein, 80 aa, Pseudomonas aeruginosa UCBPP-PA14
MATLMQIRAALEDGQARGLKQLSRQVDAPPALVEAILERLIALGKVERVAAQSSGGCGGGCKGCAQRDPCAEPEPYFRLR

SEQ ID NO: 7485 - DNA, 228 bp, Serratia marcescens
  CDS (1)..(228): transl_table=11
atggccgggctgctgcaggtgcgcgatgcgttggcgctgcgcgcgacgtcaggcgcacagctcagccaatcgctggcgacgccgctgccgctggtgcaggcgatgctggaccgtttgacggcgatggggaaagtggaacgcatcgaacaggatgacggcgcctgtctgagcggcggctgcaaaagctgcccgcagccaaggggtgcagcacggtgttctaccggctga

SEQ ID NO: 7486 - protein, 75 aa, Serratia marcescens
MAGLLQVRDALALRATSGAQLSQSLATPLPLVQAMLDRLTAMGKVERIEQDDGACLSGGCKSCPQPRGAARCSTG

SEQ ID NO: 7487 - DNA, 23 bp, Artificial sequence
  primer
atggcttcacttattcaggtgcg

SEQ ID NO: 7488 - DNA, 20 bp, Artificial sequence
  primer
ttaacgcagcgcccaccact

SEQ ID NO: 7489 - protein, 79 aa, Artificial sequence
  consensus sequence
  Variant (3)..(3): Xaa in position 3 is any amino acid
  Variant (5)..(5): Xaa in position 5 is any amino acid
  Variant (7)..(7): Xaa in position 7 is any amino acid
  Variant (10)..(11): Xaa in position 10 to 11 is any amino acid
  Variant (14)..(19): Xaa in position 14 to 19 is any amino acid
  Variant (20)..(20): Xaa in position 20 is any or no amino acid
  Variant (22)..(22): Xaa in position 22 is any amino acid
  Variant (24)..(25): Xaa in position 24 to 25 is any amino acid
  Variant (27)..(28): Xaa in position 27 to 28 is any amino acid
  Variant (30)..(34): Xaa in position 30 to 34 is any amino acid
  Variant (38)..(39): Xaa in position 38 to 39 is any amino acid
  Variant (41)..(42): Xaa in position 41 to 42 is any amino acid
  Variant (46)..(47): Xaa in position 46 to 47 is any amino acid
  Variant (49)..(54): Xaa in position 49 to 54 is any amino acid
  Variant (55)..(55): Xaa in position 55 is any or no amino acid
  Variant (58)..(58): Xaa in position 58 is any amino acid
  Variant (60)..(60): Xaa in position 60 is any amino acid
  Variant (63)..(63): Xaa in position 63 is any amino acid
  Variant (66)..(76): Xaa in position 66 to 76 is any amino acid
  Variant (77)..(78): Xaa in position 77 to 78 is any or no amino acid
MAXLXQXRDXXALXXXXXXXQXSXXLXXPXXXXXAMLXXLXXMGKXXRXXXXXXXCLXGXCKXCPXXXXXXXXXXXXXL

SEQ ID NO: 7490 - protein, 14 aa, Artificial sequence
  protein pattern
  Variant (3)..(3): Xaa in position 3 is Ser, Thr or Val
  Variant (5)..(5): Xaa in position 5 is Gly or Ser
  Variant (8)..(8): Xaa in position 8 is Gln or Ser
  Variant (11)..(11): Xaa in position 11 is Glu or Gln
  Variant (12)..(12): Xaa in position 12 is Ala, Gly, Pro or Val
  Variant (13)..(13): Xaa in position 13 is any amino acid
  Variant (14)..(14): Xaa in position 14 is Ala, Gly or Gln
CLXGXCKXCPXXXX

SEQ ID NO: 7491 - protein, 12 aa, Artificial sequence
  protein pattern
  Variant (3)..(4): Xaa in position 3 to 4 is any or no amino acid
  Variant (7)..(7): Xaa in position 7 is Asn, Gln or Arg
  Variant (8)..(8): Xaa in position 8 is Ala or Gly
  Variant (9)..(10): Xaa in position 9 to 10 is any amino acid
  Variant (11)..(11): Xaa in position 11 is Asp, Glu or Gly
RDXXALXXXXXA

SEQ ID NO: 7492 - DNA, 663 bp, ESCHERICHIA COLI
  CDS (1)..(663): transl_table=11
atggcttatcgcgaccaacctttaggtgaactggcgctctctattcctcgcgcttcagctctgtttcgtaaatatgatatggattactgctgtggcggtaagcagacgctggcgcgcgcggcggcacgtaaagaactggatgttgaggtcattgaagctgaactggcaaagctcgctgaacaaccgattgagaaagactggcgtagcgccccgctggcagaaatcatcgaccatatcatcgtgcgctaccacgatcgtcaccgcgagcaactgccggagctgattctgcaagcgactaaagtcgagcgcgttcacgccgacaaaccgagcgtgccaaaagggctgacaaaatacctgaccatgctgcatgaagagctttccagccacatgatgaaagaagagcagatcctcttcccgatgatcaaacaaggcatgggcagccaggcaatggggccaatcagcgtaatggaaagcgagcacgatgaagcgggcgaactgctggaagtgattaaacacaccaccaataacgtcacaccgccgccagaagcctgcaccacctggaaagcgatgtataacggcattaatgaactgattgatgacctgatggatcacatcagtctggaaaacaatgtactgttcccacgcgcgctggcgggtgagtaa

SEQ ID NO: 7493 - protein, 220 aa, ESCHERICHIA COLI
MAYRDQPLGELALSIPRASALFRKYDMDYCCGGKQTLARAAARKELDVEVIEAELAKLAEQPIEKDWRSAPLAEIIDHIIVRYHDRHREQLPELILQATKVERVHADKPSVPKGLTKYLTMLHEELSSHMMKEEQILFPMIKQGMGSQAMGPISVMESEHDEAGELLEVIKHTTNNVTPPPEACTTWKAMYNGINELIDDLMDHISLENNVLFPRALAGE

SEQ ID NO: 7494 - DNA, 666 bp, Yersinia pestis
  CDS (1)..(666): transl_table=11
atggattaccgcaatcagtctctgggcgcactggctatcgctattcctcgggccacaaagttattccgtcaacatcagctcgatttctgctgtggcggcaaacaaacactcttacgggccgccaataagttgaatctggatattgatgcgctggaagcacaattgagtgcattgcaaaccgaacctcactcatctgaagattggcaacaacagccactgacaaatctcattagttttatcatcagccgctaccatgatcgccatcgtgagcagctaccagaactggttctcatggcggaaaaggttgaacgggtacacggcgagaaacccacctgtcctcgtgggctggcagcagaactcagtgcgattttagaagagttgactcaacatatgtataaagaggagcagatcctgttcccgatgatccaacgaggcatgggttctcaggccagtgggccaatatttgtgatggaagcggagcacgatgcggttgggcagcaattagacgtggtaaaacaactcacacaaaatgtgacaccaccagaaggggcctgtaatacctggcgggcgctttacaccggtatcaatgaattcattactgacctgatggaacatattcatctggaaaataatttactgtttccccgtgcgctaaggggcgaataa

SEQ ID NO: 7495 - protein, 221 aa, Yersinia pestis
MDYRNQSLGALAIAIPRATKLFRQHQLDFCCGGKQTLLRAANKLNLDIDALEAQLSALQTEPHSSEDWQQQPLTNLISFIISRYHDRHREQLPELVLMAEKVERVHGEKPTCPRGLAAELSAILEELTQHMYKEEQILFPMIQRGMGSQASGPIFVMEAEHDAVGQQLDVVKQLTQNVTPPEGACNTWRALYTGINEFITDLMEHIHLENNLLFPRALRGE

SEQ ID NO: 7496 - DNA, 672 bp, Haemophilus influenzae
  CDS (1)..(672): transl_table=11
atgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaagtaaagcagaaaataatgataaagattggacttcggcatcttatgcggagatgatcgatcacattattactcgttttcataatcgccaccgtgaacaactcccagaattaattacattagcggagaaagtagaaaatgtacatgctgatcgtgatgactgtcctataggcgtaaccgcacaattagaaaaaatttatgctgaacttagccagcatttaatgaaagaagaacaaattttgttcccaatgatcaaaatggggaattatgctatggcctcaatgccaattcgtgtaatggaaatggaacacgatgaagcaggacaagatgtggaagtgatcaaatcccttactaataactgcacgctaccagcagatgcttgtttcagttggaaagccttatatagcggtattaatgaatttattgatgatttaatgcaccatattcatttggaaaataatattttatttccacgtgtattaaacgaaaaataa

SEQ ID NO: 7497 - protein, 223 aa, Haemophilus influenzae
MSFAQQKLSELAVSIPGATKIFREYDLDFCCGGSVLLEVAAQQKNLNLAEIEKRLTDLQQSKAENNDKDWTSASYAEMIDHIITRFHNRHREQLPELITLAEKVENVHADRDDCPIGVTAQLEKIYAELSQHLMKEEQILFPMIKMGNYAMASMPIRVMEMEHDEAGQDVEVIKSLTNNCTLPADACFSWKALYSGINEFIDDLMHHIHLENNILFPRVLNEK

SEQ ID NO: 7498 - DNA, 720 bp, Clostridium acetobutylicum ATCC 824
  CDS (1)..(720): transl_table=11
atgcaaaatgtatttaatgtaaatcaaaagattggggatatagtagttaagtttccaagagctattgaaatacttaaaagatataaaatagatttttgctgtggaggagatagagtacttgaagaggcaataaaggaacaagggcttaatggacaagaaataatagatgaaataaatgaggattataataaatatataatggaggaagtaaaggatagagattgggcaactgaaccatattcaaaattaatagaacacgttataaacacacatcacgcatatttaaatgaaacgctgccgcgcttaagcgagcttacaactaaaatacttagagtgcatggagcaaaacattctgaattggctaaggtgcataagcttctgcatagcttaaaaatggaattagaacagcatttgataaaagaggaggaaatagtatttccgctcatacaggaatacgaaagaacgggaaataatgagactttaagtaatgctgtagaaaagattatagaattagaagaggaacatgaaggtgcaggctcaatactaaaggagcttagggaggttactaagaattatgagcttcctgaagatgcctgcaacagctataaagcagcatataaacttttagaggatgtagaggatgatacctttagacacatacatcttgaaaataatattatgtttccaaggcttgttagtgaatcaaagaagcataagtaa

SEQ ID NO: 7499 - protein, 239 aa, Clostridium acetobutylicum ATCC 824
MQNVFNVNQKIGDIVVKFPRAIEILKRYKIDFCCGGDRVLEEAIKEQGLNGQEIIDEINEDYNKYIMEEVKDRDWATEPYSKLIEHVINTHHAYLNETLPRLSELTTKILRVHGAKHSELAKVHKLLHSLKMELEQHLIKEEEIVFPLIQEYERTGNNETLSNAVEKIIELEEEHEGAGSILKELREVTKNYELPEDACNSYKAAYKLLEDVEDDTFRHIHLENNIMFPRLVSESKKHK

SEQ ID NO: 7500 - DNA, 792 bp, Sinorhizobium meliloti 1021
  CDS (1)..(792): transl_table=11
atgccattctcgtgcacgaacatatcagttcaggggcgcggcttctgctcggaatggctccagcgagtcttaagccaaggacatctctggcaagcaacaccagacaaggaacagatcatgacgggaatacgtctcgacaacaccgtcgcagcaatcgcggcagagctgcccggagcggcggaactcttccggggccatgacatcagcttctgttgcggcggcaacgtccagctctcggaagccgccgtcaaggcaggcgtcgcgccgtcggcgctgcttgcagagttgcaagccctcgtagtggccgcgagacgagatgcacctgcggaaacatcggacctcatcgggcacatcctggacagatatcaccagacgcaccgcgccgagctcgcctggctcatcccgctcgcccagaaggtggagcgggtacacggagaccacccctcggcaccgatcgggctctcccaggtacttgagcgcctgcgagacgacctcgagagccacatgatgaaggaagagcaggtcctgttcccgataatgcggcgcggcggcagtgcggtgatcgcccatccgatcacgcagatgcgagacgagcacgaggaggaggcggagcatctccggacggtcgaacatgtgacccatgggctttcgctgccgccaggcgcctgcggctcgtggaccgcactctatacgggactgcgcaagttcaccgacgacctggtgacccacatgcatctcgagaacgcagtgctgtttccgcggttcgaaacccaggcccaggcggccgtttga

SEQ ID NO: 7501 - protein, 263 aa, Sinorhizobium meliloti 1021
MPFSCTNISVQGRGFCSEWLQRVLSQGHLWQATPDKEQIMTGIRLDNTVAAIAAELPGAAELFRGHDISFCCGGNVQLSEAAVKAGVAPSALLAELQALVVAARRDAPAETSDLIGHILDRYHQTHRAELAWLIPLAQKVERVHGDHPSAPIGLSQVLERLRDDLESHMMKEEQVLFPIMRRGGSAVIAHPITQMRDEHEEEAEHLRTVEHVTHGLSLPPGACGSWTALYTGLRKFTDDLVTHMHLENAVLFPRFETQAQAAV

SEQ ID NO: 7502 - DNA, 672 bp, Ralstonia solanacearum GMI1000
  CDS (1)..(672): transl_table=11
atgccgttactggaccagccgctggggcacctggcccgcaacatcccgggcgcaacggggatctttcacgaatatcagctcgatttctgctgcggtggccagcacagcctgcgcgacgccgcgcaggccaaggggatcgatgccgcgccgatcgcagcgcgcttgcaggcgctgcaggccgaggccacgccggatggggcggtcgactggtccgcggtgtcgcccagcatgctgatcgaccacattctcgagcgctttcacgagcgccaccgcgagcaactgcccgaactgatccgcctggcccgtcgggtggaacacgtccacggcgatcgcccggagtgcccggttggcttgagcgagttgctcgaggccatgtggcaggaactcgaaagccatatgcagaaagaggagcagatcctgtttccgatgctggcgcgcggccatggcctgcgcgccggtggcccgatcgccgtgatgcgcatggagcatgaccagcacggcgaagcgctgcagcggctgatgacgctgaccaacgacatcacgccgccgcgcgcagcgtgcacgacgtggcgggcgctctatctcggcttgagcgtgttccgtgaagacctgatggagcatatccatctggagaacaacattctgttcgagggtgctgtcgcggcggattga

SEQ ID NO: 7503 - protein, 223 aa, Ralstonia solanacearum GMI1000
MPLLDQPLGHLARNIPGATGIFHEYQLDFCCGGQHSLRDAAQAKGIDAAPIAARLQALQAEATPDGAVDWSAVSPSMLIDHILERFHERHREQLPELIRLARRVEHVHGDRPECPVGLSELLEAMWQELESHMQKEEQILFPMLARGHGLRAGGPIAVMRMEHDQHGEALQRLMTLTNDITPPRAACTTWRALYLGLSVFREDLMEHIHLENNILFEGAVAAD

SEQ ID NO: 7504 - DNA, 669 bp, Shewanella oneidensis MR-1
  CDS (1)..(669): transl_table=11
atgggcgagctggtcgcggaggattttcgccgcgcccatgtgtttagccaatttggtatcgatttctgttgtggcggtggtagagcactgatcaacgcctgtgagcgagcgcaagccgacccctataaagttgtcgctgcattagagtacatgacaaattcaggcgccaaggaagatgaactgaatcaactgccacttgaacaactgattgattatattgagcgtactcaccatcaatatgtccgtgctaaagcaccgttattactggaatactccgaaaaaatggtacgcgcccatggcgagcattatgccgaaattgttccctttgcgggttgggttcgagcgttgatagaagacttaatgccgcatttgatgaaggaagaaaacattctcttccccgcaattcgcgccatgagccaaggtgagcaagtgcaaggctgctttggtcatatcggcaatcctatcaatgcgatgcaacacgagcatgaagacgctgggctgattttacaaaagctacatgagttaaccaacggctttacgcctccagaatatgcctgtaccacttggcgggtttgttatgccacgctcgcagaatttgaggcggatctacacaggcacattcacttagagaacaacattctcttccccaaggcgctgcaactcacctaa

SEQ ID NO: 7505 - protein, 222 aa, Shewanella oneidensis MR-1
MGELVAEDFRRAHVFSQFGIDFCCGGGRALINACERAQADPYKVVAALEYMTNSGAKEDELNQLPLEQLIDYIERTHHQYVRAKAPLLLEYSEKMVRAHGEHYAEIVPFAGWVRALIEDLMPHLMKEENILFPAIRAMSQGEQVQGCFGHIGNPINAMQHEHEDAGLILQKLHELTNGFTPPEYACTTWRVCYATLAEFEADLHRHIHLENNILFPKALQLT

SEQ ID NO: 7506 - DNA, 699 bp, Clostridium tetani E88
  CDS (1)..(699): transl_table=11
atgaaaaatattattaatataaatcaaaaacttggagaagttgtttctatatttccaggttcaagtagaatatttaatgatgctaaaatagattattgctgcggtggacatgatactctaggggaagctttaaagggaaaaggaatgaatttagatgaattcatacaaaaacttaatgaagaatatgaaaagtttataagttctaatgaagagcatatagattggagaaaggaaaaacctgtagttcttatgaggcacatagtagatactcatcatgattatacaaaaaaggaacttaaagaaatagatggattactatcaaaaatattaaaagttcactttgaacatcatggagaagaattattaaaagttcatagactgtttggacttttaaagatagaattagaagaacatttaataaaagaagaagaaaatctatttccattaatagaagaatatgaactaactaaaaataaaaatgtaaaagaagaaatagataaatttataaaagaaacagaaaatgaacacgatgaagcgggagatatattaaaagaattagaaaaaataacaagagactttacagtaccagaaggggtttgtacaacatttaaactaacctatgataaaattcatgccttagaaaaagatttatttattcatatatataaagaaaatagtgtgttatttaatatgttctaa

SEQ ID NO: 7507 - protein, 232 aa, Clostridium tetani E88
MKNIININQKLGEVVSIFPGSSRIFNDAKIDYCCGGHDTLGEALKGKGMNLDEFIQKLNEEYEKFISSNEEHIDWRKEKPVVLMRHIVDTHHDYTKKELKEIDGLLSKILKVHFEHHGEELLKVHRLFGLLKIELEEHLIKEEENLFPLIEEYELTKNKNVKEEIDKFIKETENEHDEAGDILKELEKITRDFTVPEGVCTTFKLTYDKIHALEKDLFIHIYKENSVLFNMF

SEQ ID NO: 7508 - DNA, 708 bp, Bacillus cereus ATCC 14579
  CDS (1)..(708): transl_table=11
atggaacatacatttactgaaacttctattgtcggtgagattgttacacaatttccaaaagctagtaatctttttaaatcatatagaatagacttttgttgtggtggtaataaaccacttattgatgcaattcatgaaagaaatttatcagcaacagaagtacttacagaattaaatacgctttatcataatacgaaacgattaaatgaatctgaaattgattggaaaaatgcttcttatcgtgaattgattgattatgttataaataagcatcatcgctatttaaatgaagaattaccacagttaagtccgtatgtgacgaaagtattacgcgtccacggagcaagtcagcctcacttagctcaaattcataagctatttcacgaattaaagatggaattagaacagcatttaattaaagaagaaacagaagatttcccattaattttagaatttgaacaaaatccaattgacgaaaactatgtgaaattacgtaaaatagtagatgagttggaaaatgaacataaccacgcaggcaacattattaaagaacttcgtaaagttacaaatgactttactcctccagaaggagcttgcggtacttatcgacttgtttaccaacgtcttgaagcgctagagtctgatttatttgagcacattcatttagaaaataatattttatttccacgtgccattacgagagcataa

SEQ ID NO: 7509 - protein, 235 aa, Bacillus cereus ATCC 14579
MEHTFTETSIVGEIVTQFPKASNLFKSYRIDFCCGGNKPLIDAIHERNLSATEVLTELNTLYHNTKRLNESEIDWKNASYRELIDYVINKHHRYLNEELPQLSPYVTKVLRVHGASQPHLAQIHKLFHELKMELEQHLIKEETEDFPLILEFEQNPIDENYVKLRKIVDELENEHNHAGNIIKELRKVTNDFTPPEGACGTYRLVYQRLEALESDLFEHIHLENNILFPRAITRA

SEQ ID NO: 7510 - DNA, 750 bp, Geobacter sulfurreducens PCA
  CDS (1)..(750): transl_table=11
atgaacgagccgaagaatccacgaggggaagaaacagcaggcaagaccatcggcgagtttgttgccgaggactaccggacggcgggcgttttcgagaaatacgggattgacttctgctgcggcggaaatagtgcgctttctgccgcctgccggcaaaagggaatcgacccggctctgatcgtgctggaaattgaggctgcgaagaccgaccccgtcgcacggagcgagaactttgcggcgtgggaacttccgtttttggcagactatatcgtcgctgttcaccatgggtacatcaaagagaatatcgggcagattgtctcccatacccacaagattgccgaggtccacggcccccggcatcccgagttggccgaaatcgccgctatgttcgagaagattgcagccgatctggcagcccatttgcgcgaggaggaagaaatcttttttccggccctgaagcgggccgactcagcaggaaaggcagggaagaaaccagcgcaacaggatgtcgacgcaatcaggggagatttgataaggctgcgccgggagcacgaggaggtgggcgatagggttcacgccattcgccatctcgccagagattttacggtccccggcgacgcttgtaacacctacgcggtcacgtacaagcaacttaaggaattcgaggatgatctccacaagcatgtgcacctcgaaaacaatatcctttttctgaaagcagaaagagacctgatcccctcgctggtatga

SEQ ID NO: 7511 - protein, 249 aa, Geobacter sulfurreducens PCA
MNEPKNPRGEETAGKTIGEFVAEDYRTAGVFEKYGIDFCCGGNSALSAACRQKGIDPALIVLEIEAAKTDPVARSENFAAWELPFLADYIVAVHHGYIKENIGQIVSHTHKIAEVHGPRHPELAEIAAMFEKIAADLAAHLREEEEIFFPALKRADSAGKAGKKPAQQDVDAIRGDLIRLRREHEEVGDRVHAIRHLARDFTVPGDACNTYAVTYKQLKEFEDDLHKHVHLENNILFLKAERDLIPSLV

SEQ ID NO: 7512 - DNA, 675 bp, Herminiimonas arsenicoxydans
  CDS (1)..(675)
atggacatactcgatcaatcactgggtcaactggcctgtagcgtcgctggtgcgaccagaattttcaatgattaccaactggatttttgctgtggcggcaaatacagcttgcgtaatgccgcgcaagaaaaaggcattgacgcagaggaagtcgcccggcgtctggcaagcctgcaaggcgccacggatgtaaccgactggaatgccgaatcgtcggagaccttgatcgttcatatcctgctgcgcttccatgaccgtcatcgccagcaattgcctgaactcataagactggcacgcaaggtcgagcggacacatggcaatcgcaaagattgtccggttggcctgacggatcacttgagcgagatgcagcaggaactggaaagtcatatgaaaaaagaggagcagatactgtttcccttgctgttgtgcgggcaggcggcactggtaggcggcccgatcaccatcatgcgcatggaacacgagcagcacggagacgccttgcagcatctgctggcgctgacaaacgatatcaacttgccgtcggcagcctgcaatacatggcgggcgctgtattttgcactgcgcgtatttcgagaagacctgatggagcacatccatctggaaaacaatatcctgttcgaaaacgctgcattgatgcgttcggcgcatgcataa

SEQ ID NO: 7513 - protein, 224 aa, Herminiimonas arsenicoxydans
MDILDQSLGQLACSVAGATRIFNDYQLDFCCGGKYSLRNAAQEKGIDAEEVARRLASLQGATDVTDWNAESSETLIVHILLRFHDRHRQQLPELIRLARKVERTHGNRKDCPVGLTDHLSEMQQELESHMKKEEQILFPLLLCGQAALVGGPITIMRMEHEQHGDALQHLLALTNDINLPSAACNTWRALYFALRVFREDLMEHIHLENNILFENAALMRSAHA

SEQ ID NO: 7514 - DNA, 663 bp, Klebsiella pneumoniae subsp. pneumoniae MGH 78578
  CDS (1)..(663): transl_table=11
atggctttccgtgaccaacctttaggcgagctggcgctgaccatcccgcgcgcctccgccctgttccgtcaatacgatatggattactgctgcggcggcaaacagaccctggcgcgcgccgcgtcgcgcaaagcgctggatgtcgcggtgattgaagccgagctggcgaaactggccgaacagcctctctcccgcgactggcgcgcggcgcccctcgcggagattatcgaccatatcatcgttcgctatcacgaccggcaccgtgaacagctgccggagctgatcctgcaggccaccaaggttgaacgcgtccatgccgataaaccgaacgtaccgaaaggactgactaagtacctgaccatgctgcatcaggagctttccagccacatgatgaaagaggaacagatcctgttcccgatgatcaaacagggaatgggcgcccaggccggggggccgatcagcgtgatggaaagcgagcatgatgaagcgggtgaactgctggaagtcattaagcacatcacccacaacgtgacgccgccgccggaagcctgtaccacctggaaggcgatgtataacggtatcaacgagatgatcgacgatctgatggaacacatcagcctggaaaataatgtgctgttcccgcgcgccctcggcggaaagtaa

SEQ ID NO: 7515 - protein, 220 aa, Klebsiella pneumoniae subsp. pneumoniae MGH 78578
MAFRDQPLGELALTIPRASALFRQYDMDYCCGGKQTLARAASRKALDVAVIEAELAKLAEQPLSRDWRAAPLAEIIDHIIVRYHDRHREQLPELILQATKVERVHADKPNVPKGLTKYLTMLHQELSSHMMKEEQILFPMIKQGMGAQAGGPISVMESEHDEAGELLEVIKHITHNVTPPPEACTTWKAMYNGINEMIDDLMEHISLENNVLFPRALGGK

SEQ ID NO: 7516 - DNA, 708 bp, Bacillus thuringiensis serovar konkukian str. 97-27
  CDS (1)..(708): transl_table=11
atggaacatacatttactgaaacttctattgtcggtgagattgttacacaatttccgaaagctagtgatctttttaaatcctatagaatagatttttgttgtggcggtaataagccacttattgatgcaattcatgaaagaaatttatcagctactgaagtaattacagagttaaatacgctttatcataatacgaaacgattaaatgaatctgaaattgattggaaaaatgcttcttatcgtgaattgattgattatgtgattcataagcatcatcgttatttaaatgaagagttaccacagttaagtccttatgtgacgaaagtattacgtgttcatggagcaaatcagccgcatttagctaaaattcataagctatttcatgaacataaaatggaattagaacagcatttaattaaagaagaaacagaagatttcccattaattttagaatttgaaaaaaatccaactgatgaaaactatgcaaagttacgtaaagtagtagatgaactagaaaatgaacataaccacgctggcaacattattaaagagcttcgtaaagttacaaatgactttactcccccagaaggagcttgcggcacttatcgacttgtttacaatcgccttgaagcgttagagtctgatttatttgagcacattcatttagaaaataatattttatttccacgtgccattacgagagcgtaa

SEQ ID NO: 7517 - protein, 235 aa, Bacillus thuringiensis serovar konkukian str. 97-27
MEHTFTETSIVGEIVTQFPKASDLFKSYRIDFCCGGNKPLIDAIHERNLSATEVITELNTLYHNTKRLNESEIDWKNASYRELIDYVIHKHHRYLNEELPQLSPYVTKVLRVHGANQPHLAKIHKLFHEHKMELEQHLIKEETEDFPLILEFEKNPTDENYAKLRKVVDELENEHNHAGNIIKELRKVTNDFTPPEGACGTYRLVYNRLEALESDLFEHIHLENNILFPRAITRA

SEQ ID NO: 7518 - DNA, 708 bp, Bacillus cereus E33L
  CDS (1)..(708): transl_table=11
atggaacatacatttactgaaacttctattgtcggtgagattgttacacaatttccgaaagctagtgatctttttaaatcctatagaatagatttttgttgtggcggtaataagccacttattgatgcaattcatgaaagaaatttatcagctactgaagtaattacagagttaaatacgctttatcataatacaaaacgattaaatgaatctgaaattgattggaaaaatgcttcttatcgtgaattgattgattatgtgattcataagcatcatcgttatttaaatgaagagttaccacagttaagtccttatgtgacgaaagtattacgtgttcatggagcaaatcagccgcatttagctaaaattcataagctatttcatgaacttaaaatggaattagaacagcatttaattaaagaagaaacagaagatttcccattaattttagaatttgaaaaaaatccaactgatgaaaactatgcaaagttacgtaaagtagtagatgaactagaaaatgaacataaccacgctggcaacattattaaagagcttcgtaaagttacaaatgactttactcccccagaaggagcttgcggcacttatcgacttgtttacaatcgccttgaagcgttagagtctgatttatttgagcacattcatttagaaaataatattttatttccacgtgccattacgagagcgtaa

SEQ ID NO: 7519 - protein, 235 aa, Bacillus cereus E33L
MEHTFTETSIVGEIVTQFPKASDLFKSYRIDFCCGGNKPLIDAIHERNLSATEVITELNTLYHNTKRLNESEIDWKNASYRELIDYVIHKHHRYLNEELPQLSPYVTKVLRVHGANQPHLAKIHKLFHELKMELEQHLIKEETEDFPLILEFEKNPTDENYAKLRKVVDELENEHNHAGNIIKELRKVTNDFTPPEGACGTYRLVYNRLEALESDLFEHIHLENNILFPRAITRA

SEQ ID NO: 7520 - DNA, 672 bp, Mannheimia succiniciproducens MBEL55E
  CDS (1)..(672): transl_table=11
atgtcttttgcaaatcaaaaactaagtgacatcgcattaaccgttcccggcgcaattcaattgtttcgagaatatgatttagattattgctgcggaggtgcagtagaattggccgttgccgtacaggaaaaaaatttagatattaatgaaatcaacgctcgcttaaccgaattacaaaataatccggtaaacgcagaagaacgggattggacaagcgcctcgtttgatgagctgattgactatattgtgcctcgttttcatgacggtcaccgtagtcagttgcccgaactaattaccctggcggaaaaagttgagcaggtacacggcgatcgtccggactgcccgaccggggttgccgccgaattacgcaatatgctgacggatcttactcagcatatgatgaaagaagagcagattttattcccgatgattaaggcgggcaattacatgatggcaagaatgccgattcaggtaatggaaatggaacatgcggaaatgggtgatcagctggaagtattaaaatccttgaccgacaatctgacgccgcccgccgacgcctgtaccagctggctggcattatatagcggtattgaacactttattgatgaattaatgttgcatacccatacggaaaataatattctttttcctcgcgtgcgtaatgccgcttaa

SEQ ID NO: 7521 - protein, 223 aa, Mannheimia succiniciproducens MBEL55E
MSFANQKLSDIALTVPGAIQLFREYDLDYCCGGAVELAVAVQEKNLDINEINARLTELQNNPVNAEERDWTSASFDELIDYIVPRFHDGHRSQLPELITLAEKVEQVHGDRPDCPTGVAAELRNMLTDLTQHMMKEEQILFPMIKAGNYMMARMPIQVMEMEHAEMGDQLEVLKSLTDNLTPPADACTSWLALYSGIEHFIDELMLHTHTENNILFPRVRNAA

SEQ ID NO: 7522 - DNA, 729 bp, Bacteroides fragilis NCTC 9343
  CDS (1)..(729): transl_table=11
atgaaagttatgaaagattataaactaatggcggttggacaaattgtagccgattgttttgattatgcaaaggtcttcaataagtatggtattgatttttgctgtaatggagatgtttccctggctgatgcttgcgggaaaatggggatagacgcagattgtttgcttgaagaattgaagcaaataaaatcggaacagtccttaactcttgactttaaaagttggcctatagatttattagtagattacattttgaagttccatcatcgtaatatccgttatcaggggccgcaaattctccagttgcttgatagggtttgtgaagcacatgccggaaagcacccggaactttatgaagtgcgtgaactgtttcaggaatcctggatagatttgaacaatcatcttactaaggaggagatggttttgtttccttatatatatgatttatttgatgcggtggctcaacatcgtcctattccggctttccattgtggaagtgtgagtagccctatttcggtaatgatgagcgaacatgatgccgaaggagaacgttttcgcaggatttccgggttaactcatggatatctggtacctggtgatgcttgtagtagttataggttgctacttgagatgttgaggacgtttgaagataatttgcaccatcatattcatttggagaacaatattgttttcccaaaggctatagagttacaagagaattgtgaatga

SEQ ID NO: 7523 - protein, 242 aa, Bacteroides fragilis NCTC 9343
MKVMKDYKLMAVGQIVADCFDYAKVFNKYGIDFCCNGDVSLADACGKMGIDADCLLEELKQIKSEQSLTLDFKSWPIDLLVDYILKFHHRNIRYQGPQILQLLDRVCEAHAGKHPELYEVRELFQESWIDLNNHLTKEEMVLFPYIYDLFDAVAQHRPIPAFHCGSVSSPISVMMSEHDAEGERFRRISGLTHGYLVPGDACSSYRLLLEMLRTFEDNLHHHIHLENNIVFPKAIELQENCE

SEQ ID NO: 7524 - DNA, 678 bp, Ralstonia eutropha JMP134
  CDS (1)..(678): transl_table=11
atgcgcttgcaagaccagcctctgggccagctggcccgccggattcctggtgccaccggcatcttccacggctatgacctcgacttctgctgcggcggcaagcagacgctgcgcgatgccgcggttgccaagggactcgacgccgatgccatcgaatcgcgtttgcagaccctgcagcgcgacagcgagcccgtgcagaccgattggggtgcggtgccgccggcctcactgattgcccacatcctcacgcgtttccacgagcgtcatcgcgaacagcttccggaactgatccgcctcgcccgccgcgtggagcacgtgcacggcgaccggccggattgtccggtcgggctggccgaccatctggtggcgatgcgcagcgaactggaagcgcatatgcagaaggaagaacagatcctgttcccgatgctcgcgcgcgggctgcaggcggccgccacggcgccgatcacggtcatgcgcatggagcatgacgaccacggcgaagcgctgcagcggctggccgcactgaccaacgacatcacgctgccgcgcgctgcatgcaatacctggcgcgcgctgtacctgggcctgcgcacgctgcgtgaagacctgatggaacacatccatctggaaaacaacatcctgttcgagccggccgcagtggtcgcagcgaacgactga

SEQ ID NO: 7525 - protein, 225 aa, Ralstonia eutropha JMP134
MRLQDQPLGQLARRIPGATGIFHGYDLDFCCGGKQTLRDAAVAKGLDADAIESRLQTLQRDSEPVQTDWGAVPPASLIAHILTRFHERHREQLPELIRLARRVEHVHGDRPDCPVGLADHLVAMRSELEAHMQKEEQILFPMLARGLQAAATAPITVMRMEHDDHGEALQRLAALTNDITLPRAACNTWRALYLGLRTLREDLMEHIHLENNILFEPAAVVAAND

SEQ ID NO: 7526 - DNA, 750 bp, Geobacter metallireducens GS-15
  CDS (1)..(750): transl_table=11
atgatggaagacacaaagacgcagcaggaagatgcaggcgccgtcaggaccatcggtgggttcgtggccgaggattaccggacggcggaggtgttcgagcggcacgggatcgacttctgctgcggcggaaatgttccccttgatactgcctgccgacagaaagggatcgacccggccgttatcctggacgagatcgaagcagcgaagagggaaccgatggagcggagccagaactttgcggtgtgggaactctcgttcctggccgactacatcgttgccgtccaccatgcctacatcaaggacaatgccgggcagatcgtcttgtacgcccgcaaggttgccgaggtccatggcggccgccatgccgaagtgaaggagatcgccgcgatcttcgagaaggtcgccgccgatctggcaacccatctgcgcgaggaggaggaaatcttctttccggccgtcaagcgggccgatgcggcgaaaaaagcggggaagaggccggaacggcaggatatcgacgccatccggggggatctggcaaggctccgccgggagcacgaagaggtgggggatgcgattcacaccatccgccgccttgccggggatttcgcgatccccgacgacgcctgcaacacctacgcggtcacctaccggaaactgaaggagttcgaggacgacctccacaagcacgtgcacctagaaaacaacatcctttttctgaacgcggaaagggatctgggggactatgactga

SEQ ID NO: 7527 - protein, 249 aa, Geobacter metallireducens GS-15
MMEDTKTQQEDAGAVRTIGGFVAEDYRTAEVFERHGIDFCCGGNVPLDTACRQKGIDPAVILDEIEAAKREPMERSQNFAVWELSFLADYIVAVHHAYIKDNAGQIVLYARKVAEVHGGRHAEVKEIAAIFEKVAADLATHLREEEEIFFPAVKRADAAKKAGKRPERQDIDAIRGDLARLRREHEEVGDAIHTIRRLAGDFAIPDDACNTYAVTYRKLKEFEDDLHKHVHLENNILFLNAERDLGDYD

SEQ ID NO: 7528 - DNA, 729 bp, Acidobacteria bacterium Ellin345
  CDS (1)..(729): transl_table=11
atggtagatacgaacaagacagtcagggacatcgcggttgagctgccctacgctcccaaggttttcgagaaactcggaattgacttttgctgtgggggcaagcgcccactttctgaagcctgtcacgctagcggcatcgcggtcggcgaagtcgtcaatcacctggagagcgccgagaaggcgatccaggaaggccgcgagtctgccgcgaagaattggtccatcagcacggtcagcgaagtcctcgaccagatcctcagccgtcatcacgtttacgtgcgcgaagaatcccctcgcatccagcaactttttgcgaaggtcgcctcgaagcacggcgagaaccatcccgaactggtgcaggcgaaggaactgtttgatgcgcttgccggcgagctgatggtccacctgatgaaggaagagcaaatcctcttcccgtacgtgcgacgcatggaagagtcacaggtttccggcgagccgctgccgccctcctgcttcggcaccgtgcgcaatccgatccagatgatgttcatggagcacgatagcgccggcgaactgctgaaggaaattcgcaagcagaccaatgacctgaaggcgccgcccgatgcctgcatcagcttccagtcgctctatcgcgacctgttggcgttcgaagccgacctgcaccagcacattcacctcgagaacaacgtgctcttcccgaaggtcctggaaatggaaggcgcggagtag

SEQ ID NO: 7529 - protein, 242 aa, Acidobacteria bacterium Ellin345
MVDTNKTVRDIAVELPYAPKVFEKLGIDFCCGGKRPLSEACHASGIAVGEVVNHLESAEKAIQEGRESAAKNWSISTVSEVLDQILSRHHVYVREESPRIQQLFAKVASKHGENHPELVQAKELFDALAGELMVHLMKEEQILFPYVRRMEESQVSGEPLPPSCFGTVRNPIQMMFMEHDSAGELLKEIRKQTNDLKAPPDACISFQSLYRDLLAFEADLHQHIHLENNVLFPKVLEMEGAE

SEQ ID NO: 7530 - DNA, 705 bp, Rubrobacter xylanophilus DSM 9941
  CDS (1)..(705): transl_table=11
atgatctcggcggagagaagggtggacgagctggtggtggagcgtcctgcgcggtcgcgggtgttcgagcgcttcgggatcgactactgctgcgggggaggggtaccgctgcgggaggcgtgtgaggttgcgggggtggagccggaggtggtgatctcggagctggagcggttggatttcggtccggaggaggggccggccgtcgccgagatgggcgtggaggagatggtggaccacatagtgcgggtgcaccacgactacctgcgggaggagctgccgcggctcggggcgatggtcgagaaggtcgccagggtgcacggcggctcccaccccgagctctacgagctctgcgaggtcttcgcggagctcaggggcgagctcgaggagcacacggagaaagaggagcgggtgctgttcccggcctgcatcgagctcgcctccgggcggcgccccgccgccctcgggtacgtacgggccctcgtctcctcgctcgtctccgagcacgtcgaatccggcgaggggctgcggtccatccgcgagatcacgcggggctacagggtgcccgaggacgcctgcaacacctaccgggcgatgctcgacgggctcgccgagctcgagcgggacacccacgagcacgtcttcaaggagaacagcctgctcttcccgcgggtcgtggccgcggaggaggctctggagaggaggtga

SEQ ID NO: 7531 - protein, 234 aa, Rubrobacter xylanophilus DSM 9941
MISAERRVDELVVERPARSRVFERFGIDYCCGGGVPLREACEVAGVEPEVVISELERLDFGPEEGPAVAEMGVEEMVDHIVRVHHDYLREELPRLGAMVEKVARVHGGSHPELYELCEVFAELRGELEEHTEKEERVLFPACIELASGRRPAALGYVRALVSSLVSEHVESGEGLRSIREITRGYRVPEDACNTYRAMLDGLAELERDTHEHVFKENSLLFPRVVAAEEALERR

SEQ ID NO: 7532 - DNA, 699 bp, Clostridium perfringens ATCC 13124
  CDS (1)..(699): transl_table=11
atggaaaagttaattagaaaagattatagtttaggagaagttgttactgtttacccagcagttgttaagaaatttaatgatatggaattagattattgttgtggtggaagtaagagtttagaattagcacttaaggaaaaaggtgttgatgttgataaatttgttgaagatttaaataaagaattcaaagagtttaaatttgaaaactctcaatatgtagattggagagaaaaatcttcagaagatttaattaatcatatagttgaaactcatcatgcagagactttcagattattaaaagaaatagatccattgatggttaaggtatttagagtacatttttcacatggtccagaacttttaatgaaagttcatagcctttttggaaagctaaaatgtgaattagaagaacatttacttaaagaagagaatattttatttccattaatgattaagtatgaccaagcaaaggataaagaagaaaagaaagaaatagaagaggatataagaatcatagttaatgaacatgaagctgctggtgatatattaaaagaattagcagaagtaactgatgattataaagttccagaatggggatgcataagttttaaactactatatgattatttacacgacttagaaaaagatttattcatacatattcataaagaaaataatatattattcccaagatattag

SEQ ID NO: 7533 - protein, 232 aa, Clostridium perfringens ATCC 13124
MEKLIRKDYSLGEVVTVYPAVVKKFNDMELDYCCGGSKSLELALKEKGVDVDKFVEDLNKEFKEFKFENSQYVDWREKSSEDLINHIVETHHAETFRLLKEIDPLMVKVFRVHFSHGPELLMKVHSLFGKLKCELEEHLLKEENILFPLMIKYDQAKDKEEKKEIEEDIRIIVNEHEAAGDILKELAEVTDDYKVPEWGCISFKLLYDYLHDLEKDLFIHIHKENNILFPRY

SEQ ID NO: 7534 - DNA, 747 bp, Shewanella sp. MR-4
  CDS (1)..(747): transl_table=11
atgttatctgcccatctctcatccgaaaacccagttgaagcaccgtcagcctcaatcaccccatggcttgaacgcaaagtgggggaattggtcgcagaggattttcgccgcgcccacgtgtttagccaatttggtatcgatttctgctgcgggggtggtcgagcactcgttaatgcctgcgagcgagcagaggccaatcctgagcaagtcgtcgccgcactggaggccgtttcccactcgggagctaaagaagatgaactcaatcaattgccactcgaccagttgatcgattatatcgagcgtacccaccatcaatacgttcgcgctaaggcgccgttattgctcgaatattcagagaaaatggttcgcgcccatggtgagcattatgccgagattattcccttcgctggctgggtgcgcgccttaattgaagacttaatgccgcatttgatgaaggaagaaaatatcctcttcccggcgatccgcgccatgagccaaggtgaacaagtgcaaggttgttttggccatataggcaaccccatcaatgcgatgcaatacgagcacgaagaagctgggcaaattttgcaaaagctacacgagttaaccaatgactttacgccgccggaatacgcctgcaccacatggcgcgtttgttacgcgactctggtcgaatttgaggcagacttgcaccgacacatccatttagagaacaacattctcttccctaaggcgctacaactcgcctag

SEQ ID NO: 7535 - protein, 248 aa, Shewanella sp. MR-4
MLSAHLSSENPVEAPSASITPWLERKVGELVAEDFRRAHVFSQFGIDFCCGGGRALVNACERAEANPEQVVAALEAVSHSGAKEDELNQLPLDQLIDYIERTHHQYVRAKAPLLLEYSEKMVRAHGEHYAEIIPFAGWVRALIEDLMPHLMKEENILFPAIRAMSQGEQVQGCFGHIGNPINAMQYEHEEAGQILQKLHELTNDFTPPEYACTTWRVCYATLVEFEADLHRHIHLENNILFPKALQLA

SEQ ID NO: 7536 - DNA, 747 bp, Shewanella sp. MR-7
  CDS (1)..(747): transl_table=11
atgttatctgcccatctctcatccgaaaacccagttgaagcacagtcagcctcaatcaccccattgcttgaacgcaaagtgggggaactggtcgcagaggattttcgccgcgcccacgtgtttagccaatttggtatcgatttctgctgcgggggtggtcgagcactcgccaatgcctgcgagcgagcagaggccaatcctgagcaagtcgtcgccgcattggaggccgtttcccactcgggagccaaagaagatgaactcaatcaattgccactcgaccagttgatcgattacatcgagcgcacccatcatcaatatgttcgcgctaaggcgccgttattgctcgaatattcagagaaaatggtacgcgcccatggtgagcattatgcggagatcattcccttcgctggctgggtgcgcgccttaattgaagacttaatgccgcatttgatgaaggaagaaaatatcctcttccccgcgatccgcgccatgagccgaggtgagcaagtgcaaggttgttttgggcacataggcaaccccatcaatgcgatgcaatacgagcacgaagaagctgggcaaattttgcaaaagctacacgagttaaccaatgattttacgccgccggaatacgcctgcaccacatggcgcgtttgttacgcgactctggtcgaatttgaggcagacttgcaccgacacatccatttagagaacaacattctcttccctaaggcgctacaactcgcctag

SEQ ID NO: 7537 - protein, 248 aa, Shewanella sp. MR-7
MLSAHLSSENPVEAQSASITPLLERKVGELVAEDFRRAHVFSQFGIDFCCGGGRALANACERAEANPEQVVAALEAVSHSGAKEDELNQLPLDQLIDYIERTHHQYVRAKAPLLLEYSEKMVRAHGEHYAEIIPFAGWVRALIEDLMPHLMKEENILFPAIRAMSRGEQVQGCFGHIGNPINAMQYEHEEAGQILQKLHELTNDFTPPEYACTTWRVCYATLVEFEADLHRHIHLENNILFPKALQLA

SEQ ID NO: 7538 - DNA, 738 bp, Solibacter usitatus Ellin6076
  CDS (1)..(738): transl_table=11
atggaagagaaggaacaaggagatccgatgacaacaaccatgactttggccgatctggccgccaactcattgaacgccgtacgcattctggaacaacacggcctggattactgctgcggcggaaagcaaccatttgaagacgcatgcttggcgaagggaatcaagccggagtccatcctgcgcgagatcgaggaggcgcaggttgcaactgtcgctggcagagactggcacacggcgccgctggatgagctggtgaagcacattgttggaacgcaccacgagtacctgaagctggatctgcctgtcttggcgcaccgcatggagaaagtggcctcggtccacggcgcccgcgacccgaaagtgctccctcgcatggcggaagtattcgcgggcttgcgtgccgagatggaaatgcacatgcacaaagaggaaaccatcctgtttcccttcatcgagcagcacggtcgcgccgaggtgcagaaccggccggtgccgccggtgccatttggaacgatcgccaaccccatcgcgatgatggagcgcgagcatgccggcgctggggacgccctcggcgagatccgcagcttgaccaacgatttcgagttgccgccttacgcttgcagcacggttcgcgcgctatatgaagggctgaaggtgctggaagcagatctgcacgtccacatccacctggaaaacaacattctgttcccgcgcgccatcgcattagaaaagcggtag

SEQ ID NO: 7539 - protein, 245 aa, Solibacter usitatus Ellin6076
MEEKEQGDPMTTTMTLADLAANSLNAVRILEQHGLDYCCGGKQPFEDACLAKGIKPESILREIEEAQVATVAGRDWHTAPLDELVKHIVGTHHEYLKLDLPVLAHRMEKVASVHGARDPKVLPRMAEVFAGLRAEMEMHMHKEETILFPFIEQHGRAEVQNRPVPPVPFGTIANPIAMMEREHAGAGDALGEIRSLTNDFELPPYACSTVRALYEGLKVLEADLHVHIHLENNILFPRAIALEKR

SEQ ID NO: 7540 - DNA, 681 bp, Solibacter usitatus Ellin6076
  CDS (1)..(681): transl_table=11
atgacaacactcactccggaacgcaccgtcggacagatcgccgccgctcttcccgcctccgtcagggtcttcgaaaagcacggcattgatttctgctgcggtggctccgttccgatcaccgacgcgtgccgccgcgccggcgtggatgcggcgctcctgctccacgaaatcgaccaggccggccaggctcccgccgcggacgccaccgattggctgaccgcaccgctgccggcgctcatggaccacatcctcgacacccatcacgtatatatgaaggcccagcttccccggctcgaggccatgctcgccaaggtcctcgaggctcacggcgaccgccacggcgaaaccctccgtgccctcgccgcagtttacggccccatgaaagccgagctcgatgcccatctgctcaaggaggagaggatcctcttccccatgatccgcaccggccaatccaactgcggcggcgtccagaaccccatccgcgtcatgctgttcgagcacgattccgccggcgatgcgctggccgggatgcgccgcctcaccgccggctacacgcccccacccgacgcctgcaacaccttccgcgccctgtactacgagctctccgagatggagcgcgacctgcaccgccacatccacctcgagaacaacatcctcttcccgcgtgcgctagccgaatag

SEQ ID NO: 7541 - protein, 226 aa, Solibacter usitatus Ellin6076
MTTLTPERTVGQIAAALPASVRVFEKHGIDFCCGGSVPITDACRRAGVDAALLLHEIDQAGQAPAADATDWLTAPLPALMDHILDTHHVYMKAQLPRLEAMLAKVLEAHGDRHGETLRALAAVYGPMKAELDAHLLKEERILFPMIRTGQSNCGGVQNPIRVMLFEHDSAGDALAGMRRLTAGYTPPPDACNTFRALYYELSEMERDLHRHIHLENNILFPRALAE

SEQ ID NO: 7542 - DNA, 747 bp, Shewanella sp. ANA-3
  CDS (1)..(747): transl_table=11
atgttatctgcccatctctcatccgaaaacccagttgaagcacagtcagcctcaatcaccccatggcttgaacgcaaagtgggggaattggtcgcagaggattttcgccgcgcccacgtgtttagccaatttggtatcgatttctgctgcgggggtggtcgagcactcgttaatgcctgcgagcgagcagaggccaatcctgagcaagtcgtcgccgcactggaggccgtttcccactcgggagccaaagaagatgaactcaatcaattgccactcgaccagttgatcgattacatcgagcgcacccatcatcaatatgttcgcgctaaggcgccgttattgctcgaatattcagagaaaatggtacgcgcccatggtgagcattatgcggagatcattcccttcgctggctgggtgcgcgccttaattgaagacttaatgccgcatttgatgaaggaagaaaatatcctcttccccgcgatccgcgccatgagccgaggtgagcaagtgcaaggttgttttgggcacataggcaaccccatcaatgcgatgcaatacgagcacgaagaagctgggcaaattttgcaaaagctacacgagttaaccaatgattttacgccgccggaatacgcctgcaccacatggcgcgtttgttacgcgactctggtcgaatttgaggcagacttgcaccgacacatccatttagagaacaacattctcttccctaaggcgctacaactcgcctag

SEQ ID NO: 7543 - protein, 248 aa, Shewanella sp. ANA-3
MLSAHLSSENPVEAQSASITPWLERKVGELVAEDFRRAHVFSQFGIDFCCGGGRALVNACERAEANPEQVVAALEAVSHSGAKEDELNQLPLDQLIDYIERTHHQYVRAKAPLLLEYSEKMVRAHGEHYAEIIPFAGWVRALIEDLMPHLMKEENILFPAIRAMSRGEQVQGCFGHIGNPINAMQYEHEEAGQILQKLHELTNDFTPPEYACTTWRVCYATLVEFEADLHRHIHLENNILFPKALQLA

SEQ ID NO: 7544 - DNA, 723 bp, Acidovorax sp. JS42
  CDS (1)..(723): transl_table=11
atgaataccgccacctctccctccctcgacccccgtcaggccatcggccagattgccgttgaactgcctggcgcgaccgccgtgttccgccgcctgaagctggacttctgctgcggcggccaagtgccgctggagcaggcggccgcggacaaaggcctggacctgcaggccgtggtggatgagctttccgccctgcaacgccccaacgaactgcccgacgcgggcacacccacggaactgatcgaccacatcgtcacgcgctaccacgaggtgcaccgcgcccagttgcccgagctggtgcgcatggcgcgccgcgtggaagccgtgcaccgcgacaaccccaacaccccgcacggcctggccgacgcgctggaagagatgcagcaggagctgctgacccacatgcacaaggaggaagccatcctgttccccatgctgcgcagcggcggcaacgccttcgtgacccagcccatcggcatgatgcgcagcgagcacgtggaccacggcgaggcactggagcagatcgcgcgcctgaccaacgacatcaccccgcccatgggcgcctgcaacacctggcgcgcgctgtatgcgggcctcgcgcagctcagcgacgacctggtgaaccacatccacctggagaacaacgtgctgttcccgcagttcgaggccggcgcctcgcagggctgcggcagcggctcggcatgttcgtgcagcggcggctga

SEQ ID NO: 7545 - protein, 240 aa, Acidovorax sp. JS42
MNTATSPSLDPRQAIGQIAVELPGATAVFRRLKLDFCCGGQVPLEQAAADKGLDLQAVVDELSALQRPNELPDAGTPTELIDHIVTRYHEVHRAQLPELVRMARRVEAVHRDNPNTPHGLADALEEMQQELLTHMHKEEAILFPMLRSGGNAFVTQPIGMMRSEHVDHGEALEQIARLTNDITPPMGACNTWRALYAGLAQLSDDLVNHIHLENNVLFPQFEAGASQGCGSGSACSCSGG

SEQ ID NO: 7546 - DNA, 672 bp, Haemophilus influenzae R2846
  CDS (1)..(672): transl_table=11
atgtcttttgcccaacaaaaacttagcgaactcgctgtttcaattccaggtgcaactaaaatttttcgtgaatatgatttagatttttgctgcggaggttctgtattattagaagtcgcaacacaacgaaagaatcttaaccttactgaaattgaaaaacgtttaactgatttacaacaaagtacagcagaaaataatgataaagattggacttcggcatcttatgcggagatgatcgatcacattattactcgttttcataatcgccaccgtgaacaactccctgaattaattacattggcggagaaagtagaaaatgtacatggtgatcgtgatgactgtcctataggcgtagtcgcacagttagaaaaaatttatgctgaacttagccagcatttaatgaaagaagaacaaattttgttcccaatgatcaaaatggggaattatgctatggcctcaatgccaattcgtgtaatgaaaatggaacacgatgaagcgggacaagatgtggaagtgatcaaatcgcttactaataactgcacaccacctgcagatgcttgtttcagttggaaagccttatatagcggtattaatgaatttattgatgatttaatgcaccatattcatttggaaaataatattttatttccacgtgtattaaacgaaaaataa

SEQ ID NO: 7547 - protein, 223 aa, Haemophilus influenzae R2846
MSFAQQKLSELAVSIPGATKIFREYDLDFCCGGSVLLEVATQRKNLNLTEIEKRLTDLQQSTAENNDKDWTSASYAEMIDHIITRFHNRHREQLPELITLAEKVENVHGDRDDCPIGVVAQLEKIYAELSQHLMKEEQILFPMIKMGNYAMASMPIRVMKMEHDEAGQDVEVIKSLTNNCTPPADACFSWKALYSGINEFIDDLMHHIHLENNILFPRVLNEK

SEQ ID NO: 7548 - DNA, 672 bp, Haemophilus influenzae R2866
  CDS (1)..(672): transl_table=11
atgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaagtaaagcagaaaataatgataaagattggacttcggcatcttatgcggagatgatcgatcacattattactcgttttcataatcgccaccgtgaacaactccctgaattaattacattggcggagaaagtagaaaatgtacatggagatcgtgatgactgccctataggcgtaaccgcacagttagaaaaaatttatgctgaacttagccagcatttaatgaaagaagaacaaattttgtttccaatgatcaaaatggggaattatgctatggcctcaatgccaattcgtgtaatggaaatggaacacgatgaagcaggacaagatgtggaagtgatcaaatcccttactaataactgcgcgctaccagcagatgcttgtttcagttggaaagccttatatagcggtattaatgaatttattgatgatttaatgcatcatattcatttggaaaataatattttatttccacgtgtattaaacgaaaaataa

SEQ ID NO: 7549 - protein, 223 aa, Haemophilus influenzae R2866
MSFAQQKLSELAVSIPGATKIFREYDLDFCCGGSVLLEVAAQQKNLNLAEIEKRLTDLQQSKAENNDKDWTSASYAEMIDHIITRFHNRHREQLPELITLAEKVENVHGDRDDCPIGVTAQLEKIYAELSQHLMKEEQILFPMIKMGNYAMASMPIRVMEMEHDEAGQDVEVIKSLTNNCALPADACFSWKALYSGINEFIDDLMHHIHLENNILFPRVLNEK

SEQ ID NO: 7550 - DNA, 708 bp, Bacillus cereus G9241
  CDS (1)..(708): transl_table=11
atggaacatacatttactgaaacttcgcttgttggtgagattgttacacaatttccgaaagctagtgatctttttaaatcatatagaattgatttttgttgtggtggtaataaaccacttattgatgcaattcatgaaagaaatttatcagcaacagaagtacttacagagttaaatacgctttatcataatatgaaacaattaaatgaatctgaaattgattggaaaagtgcttcttatcgtgaattgattgattttgtaattcataaacatcatcgttatttaaatgaagagttaccgcagttaagtccatatgtgacgaaagtattacgtgttcatggagccaatcagcctcatttagctcaaattcataagctatttcatgaacttaaaatggaattagaacagcatttaattaaagaagaaacggaagatttcccattaattttagcattcgaacaaaatccaactgatgaaaactatgcaaagttacgtaaagtagtagatgaactagaaaatgagcacaatcatgccggaaatattataaaagaacttcgtaaaatgacaagtgactttactcctccagaaggagcttgcggcacttatcgacttgtttacaatcgccttgaagcgttagagtctgatttatttgagcacattcatttagaaaataatattttatttccacgtgccattacgagagcataa

SEQ ID NO: 7551 - protein, 235 aa, Bacillus cereus G9241
MEHTFTETSLVGEIVTQFPKASDLFKSYRIDFCCGGNKPLIDAIHERNLSATEVLTELNTLYHNMKQLNESEIDWKSASYRELIDFVIHKHHRYLNEELPQLSPYVTKVLRVHGANQPHLAQIHKLFHELKMELEQHLIKEETEDFPLILAFEQNPTDENYAKLRKVVDELENEHNHAGNIIKELRKMTSDFTPPEGACGTYRLVYNRLEALESDLFEHIHLENNILFPRAITRA

SEQ ID NO: 7552 - DNA, 699 bp, Desulfitobacterium hafniense DCB-2
  CDS (1)..(699): transl_table=11
atgacgcaattcaatgctggtcaaaaaattggcgatattgtcaccaagtttcccaaggcggcagatatctttaaggaatatcgtattgacttctgctgcggaggagagcggattctcagggaggttctgcagagggaaggtcataatgaaacagagattttagggcgaattaatgacctctatgcagagctcaaaaacatcagggacacggaacaggattggagtcaagaagagtccggtcccttaagtgactacgtggttaacacccatcatgcctatcttaatgcagagcttcccagaataagtaaattgatcaccatgattttaagggttcatggggagagccatccggaacttaaaggggtgcatcgtttgtttcatcatttaaagctggagctggaacagcaccttattaaagaagaagcaatcgagttccccttgatgaaggagcaggagacaaaaccttcggcaaatattcaaaaagaaatccgccgtatcatccaggaactcaaggcggagcatgatggggctggagacattctcaaagagttaagaacgattaccaatgattttgcggtgccggcggatgcctgcaattcctacagaatcacctatcaaaagttggcggagttggaaagcgatattttccagcatgttcatctcgaaaataatattctgtttcccagatatctaggttaa

SEQ ID NO: 7553 - protein, 232 aa, Desulfitobacterium hafniense DCB-2
MTQFNAGQKIGDIVTKFPKAADIFKEYRIDFCCGGERILREVLQREGHNETEILGRINDLYAELKNIRDTEQDWSQEESGPLSDYVVNTHHAYLNAELPRISKLITMILRVHGESHPELKGVHRLFHHLKLELEQHLIKEEAIEFPLMKEQETKPSANIQKEIRRIIQELKAEHDGAGDILKELRTITNDFAVPADACNSYRITYQKLAELESDIFQHVHLENNILFPRYLG

SEQ ID NO: 7554 - DNA, 684 bp, Ralstonia eutropha
  CDS (1)..(684): transl_table=11
atgaccctgcaagaccaatccctcggccagttggcccgccgcattcccggcgccacgcggatctttcatgactattcgctggatttctgctgcggcggcaagcacacgctgcgcgaggcggcgcaggagaaagggctcgatgccacagccatcgaggcgcgcctgctggcgttgcaagggggcgccgagccggtggagaacgactggaacactgtatcgcccgctgcgctgattgcccatatccagacgcgttttcatgaccgccatcgcgagcagctgcccgagctgatccggctcgcgcgccgcgtggagcatgtccatggcgaccgccccgactgcccgctcgggctggccgatcacctggcggaaatgcagagcgagctggaagcgcacatgcagaaggaggaacaggtcctgttcccaatgctcgcgcgtggcttccatgccgcagccggtgcgcccatcaccgtgatgcgcatggagcatgacgaccacggcgcggcattgcagcggctggcggacctcaccaacgacatcacgctgcctcgcgcggcttgcaatacctggcgggcgctctacctcgggctgcgcacgctgcgcgaacacctgatggaacacatccacctggaaaacaacgtgctgttcgagccgggcctgcccgccacgcacggggcaaacgactga

SEQ ID NO: 7555 - protein, 227 aa, Ralstonia eutropha
MTLQDQSLGQLARRIPGATRIFHDYSLDFCCGGKHTLREAAQEKGLDATAIEARLLALQGGAEPVENDWNTVSPAALIAHIQTRFHDRHREQLPELIRLARRVEHVHGDRPDCPLGLADHLAEMQSELEAHMQKEEQVLFPMLARGFHAAAGAPITVMRMEHDDHGAALQRLADLTNDITLPRAACNTWRALYLGLRTLREHLMEHIHLENNVLFEPGLPATHGAND

SEQ ID NO: 7556 - DNA, 714 bp, Bacillus licheniformis
  CDS (1)..(714): transl_table=11
atggaagcagtttttgatcaaaacacaaaaacgggtgatattgttacccattttccaagagccagccggctgctgaaagaatatcgcatcgacttttgctgcgggggcaaccgtccgatcggtgaagcgataaaagagcaggatttaaatgaagaagagatcttagctagaatcaatacattatatcaagagacaaaggcattaaacgcaaaagagacgaactggagtgaagccccgtattcacagctgatcgaccatgtgattcatacgcaccatgcctacctgtatgaggtgcttcctgaactgtcaggctttgttacaaaagtataccgggttcatggcatccatcatccggagctcgcccaggtccatcaattgttccatcagctgaaaacagaactcgaacatcacctcttccaggaagaggaacatattttcccgaaagtgatggcctatgaagagacgcgatcaatggaccgcttagcagaagcggttcagacgatcgacgtccttgaacaagagcatgaagccgcaggcagcatcctgaaggaactgagaagagtgaccaatgactatacccttcctgaaggggcatgcacaacatatacactgacttacttaaagcttgatgaattggaaacggatctttttcagcacattcacctggaaaacaatattttgttcccgcggcttgaagcggaagccaatcaataa

SEQ ID NO: 7557 - protein, 237 aa, Bacillus licheniformis
MEAVFDQNTKTGDIVTHFPRASRLLKEYRIDFCCGGNRPIGEAIKEQDLNEEEILARINTLYQETKALNAKETNWSEAPYSQLIDHVIHTHHAYLYEVLPELSGFVTKVYRVHGIHHPELAQVHQLFHQLKTELEHHLFQEEEHIFPKVMAYEETRSMDRLAEAVQTIDVLEQEHEAAGSILKELRRVTNDYTLPEGACTTYTLTYLKLDELETDLFQHIHLENNILFPRLEAEANQ

SEQ ID NO: 7558 - DNA, 720 bp, Pseudomonas stutzeri
  CDS (1)..(720): transl_table=11
atgaccaccgaccttatcgaccacaccctcggccatctcgcatgttcggtacccggtgccacacgcgtatttcgtcaatttcgactggatttctgctgcggcggtgacctgtcgctgcgcgaggccgcacagctcatagacgtcgacccgcaagtcatcgccggcgctctactggcactggagccagaggactctgaaaaggactggcgcgcagctcccgcgggagagctgatcgaatacatcctggcgcgctttcacgagcgccaccgcgatcagttcccggagctgattcgcctggccagccgcgtcgaacatgtccatggcggccgtcctgaatgccctaatggtctcgccgaacacctgtggaacatgcagcaggaactggagagccatatgctcaaggaggagcagatcctcttccccatgctgcagcgcggcatgcgcttcccccaggcgcaaggaccgatctcggtgatgcgctacgagcatcaggagcacggcaacgctctggagcaattggcagcgctgaccgatgacatcactccgccggcaaatgcctgcaatacctggcgcgcgctgtatcgcggcctggaggaaatgcgcagcgatctgatgcagcacatccacctggagaataacgtgctgtttcgcaatgccgaggcgtcgatgccggtacagagcgcccaggtcgtcgaaccagtcgtggagattcgcccatga

SEQ ID NO: 7559 - protein, 239 aa, Pseudomonas stutzeri
MTTDLIDHTLGHLACSVPGATRVFRQFRLDFCCGGDLSLREAAQLIDVDPQVIAGALLALEPEDSEKDWRAAPAGELIEYILARFHERHRDQFPELIRLASRVEHVHGGRPECPNGLAEHLWNMQQELESHMLKEEQILFPMLQRGMRFPQAQGPISVMRYEHQEHGNALEQLAALTDDITPPANACNTWRALYRGLEEMRSDLMQHIHLENNVLFRNAEASMPVQSAQVVEPVVEIRP

SEQ ID NO: 7560 - DNA, 708 bp, Ralstonia eutropha
  CDS (1)..(708): transl_table=11
atgaccttgcaggaccactcgcttggccaactggcccgcctgatccctggtgccacccggatcttccacggctacgggctggacttctgctgcggaggcaagcagaccctgcgcgacgccgcgcagcaaaagggtctcgatgcggctgccgtcggcaccatcgacgcccaactgcgcgcgctgcaggacgaagggtcgtcggcacaggactggaacacggcggcgccggccgagctgatcgaacatatcctcacgcgcttccatgcgcgccaccgcgagcagttgcccgagctgatccgcctggcgcggcgcgtcgagcaggtgcacggtgaccggcccgattgcccgcttggcctggccgaccacctgagcgagatgctgggcgagctggaaacgcatatgcagaaggaagagcaggtgctgttcccgatgttgtcgcgcggcctgcatgccgccgcgggccggcagatcacggtgatgcgcgccgagcatgacgaccacggcgtggcgttgcagcggctggcggcgctgaccaacgacatcacgttgccgcgcgcggcctgcaatacctggcgcgcgctctacctgggcctgcgcacgctgcgcgaagacctgatggaacacatccacctggaaaacaacgtgctgttcgaggtcgccaccgccgccgcgcaagccactggctgcggttgctcgacgcacgcctga

SEQ ID NO: 7561 - protein, 235 aa, Ralstonia eutropha
MTLQDHSLGQLARLIPGATRIFHGYGLDFCCGGKQTLRDAAQQKGLDAAAVGTIDAQLRALQDEGSSAQDWNTAAPAELIEHILTRFHARHREQLPELIRLARRVEQVHGDRPDCPLGLADHLSEMLGELETHMQKEEQVLFPMLSRGLHAAAGRQITVMRAEHDDHGVALQRLAALTNDITLPRAACNTWRALYLGLRTLREDLMEHIHLENNVLFEVATAAAQATGCGCSTHA

SEQ ID NO: 7562 - DNA, 663 bp, Escherichia coli O157
  CDS (1)..(663): transl_table=11
atggcttatcgcgaccaacctttaggtgaactggcgctctctattcctcgcgcttcggctctgtttcgtaaatatgatatggattactgctgcggcggtaagcaaacgctggcgcgtgcggcggcacgtaaagaactggatgttgaggtcattgaagctgagctggcaaagcttgctgaacaaccgattgagaaagactggcgtagcgccccgctggcagaaatcatcgaccatatcatcgtgcgctaccacgctcgtcaccgcgagcaactgccggagctgattctgcaagcgactaaagtcgagcgcgttcacgccgacaaaccgagcgtgccaaaagggctgacaaaatacctgaccatgctgcatgaagagctttccagccacatgatgaaagaagagcagatcctcttcccgatgatcaaacaaggcatgggcagccaggcaatggggccaatcagcgtaatggaaagcgagcacgatgaagcgggtgaactgctggaagtgatcaaacacaataccaataacgtcacaccgccgccggaagcctgcaccacctggaaagcgatgtataacggcattaatgaactgattgatgacctgatggatcacatcagcctggaaaacaatgtactgttcccaagggcgctggcgggtgagtga

SEQ ID NO: 7563 - protein, 220 aa, Escherichia coli O157
MAYRDQPLGELALSIPRASALFRKYDMDYCCGGKQTLARAAARKELDVEVIEAELAKLAEQPIEKDWRSAPLAEIIDHIIVRYHARHREQLPELILQATKVERVHADKPSVPKGLTKYLTMLHEELSSHMMKEEQILFPMIKQGMGSQAMGPISVMESEHDEAGELLEVIKHNTNNVTPPPEACTTWKAMYNGINELIDDLMDHISLENNVLFPRALAGE

SEQ ID NO: 7564 - DNA, 666 bp, Erwinia carotovora subsp
  CDS (1)..(666): transl_table=11
atggcataccgcgatcaatccctgggtgagttggctatcgctattccgcgcgccactaaactctttcgtgaactcaatctggatttctgctgcggcggaaaacaaacgctaagccgcgcagctggcaaaaaagatctcaatatcgacgaactggaagcgcagttagagaaactggccgcacagccttctgacgcacgagactggcgtgaagcaccgttggctgacatcatcgcgtacattatcccccgttttcatgaccgccaccgtgaacaattgccggagctgattctgatggcaaaaaaagtcgagcgcgtgcatcacgacaaagcagactgcccgcacggccttgcaaaccaactgaccgcgatttacaacgagctgtctcagcacatgatgaaagaagagcgcatcctcttcccaatgatcggtcagggaatgggcgcgaatgctgccgcaccgatttcagtgatggagcatgagcacgatgacgctgggcgtgatgtggaagtggtcaaagagctgaccaacggcgtcgtaccgccggaaggtgcctgcaatacctggcgtgcactgtactccggtattaacgagtttattaccgatctgatggaacacatccatctggaaaacaatttgctgttcccacgcgcgctgcgcggtgagtaa

SEQ ID NO: 7565 - protein, 221 aa, Erwinia carotovora subsp
MAYRDQSLGELAIAIPRATKLFRELNLDFCCGGKQTLSRAAGKKDLNIDELEAQLEKLAAQPSDARDWREAPLADIIAYIIPRFHDRHREQLPELILMAKKVERVHHDKADCPHGLANQLTAIYNELSQHMMKEERILFPMIGQGMGANAAAPISVMEHEHDDAGRDVEVVKELTNGVVPPEGACNTWRALYSGINEFITDLMEHIHLENNLLFPRALRGE

SEQ ID NO: 7566 - DNA, 663 bp, Salmonella choleraesuis
  CDS (1)..(663): transl_table=11
atggcttatcgcgatcaacctttaggcgaactggcgctctctattccccgcgcatcggcgctgtttcgccagtacgatatggattactgctgcggcggaaaacagacgctggcgcgcgccgccacgcgtcacgacgtcgatattgacatcattgaagcgcaactggcgcagttggctgaacagcccatcgaaaaagactggcgcgccgttccgctggcagacattattgaccatatcgttgtgcgctatcatgaccgacaccgcgagcaactgccggagcttatcctgcaggcaaccaaagtggaacgcgtccacgcggataagccaaacgtcccacgcggcctgacaaaatatctcaccgcgctgcatgaagagctttccagccatatgatgaaagaagaacagatcctgttccccatgatcaaacagggtatgggtcgccaggcaacgggcccgataagcgtaatggaaagcgagcatgacgaggcgggagagctggtagacgtcatcaaacacgtcacccaaaatgtaacgccgccgccagaagcttgtaccacctggaaagcgatgtataacggcattaatgagatgattgatgatctgatggagcacatcagcctggagaataacgtgctgttcccacgcgcgctggccggggaataa

SEQ ID NO: 7567 - protein, 220 aa, Salmonella choleraesuis
MAYRDQPLGELALSIPRASALFRQYDMDYCCGGKQTLARAATRHDVDIDIIEAQLAQLAEQPIEKDWRAVPLADIIDHIVVRYHDRHREQLPELILQATKVERVHADKPNVPRGLTKYLTALHEELSSHMMKEEQILFPMIKQGMGRQATGPISVMESEHDEAGELVDVIKHVTQNVTPPPEACTTWKAMYNGINEMIDDLMEHISLENNVLFPRALAGE

SEQ ID NO: 7568 - DNA, 663 bp, Salmonella paratyphi
  CDS (1)..(663): transl_table=11
atggcttatcgcgatcaacctttaggcgaactggcgctctctattccccgcgcatcggcgctgtttcgccagtacgatatggattactgctgcggcggaaaacagacgctggcgcgcgccgccgctcgtcacgacgtcgatattgacattattgaagcgcaactcgcgcagttggctgaacagcccatcgaaaaagactggcgcgccgttccgctggcggacattattgaccatatcgttgtgcgctatcatgaccgacaccgcgaacaactgccggagcttatcctgcaggcaaccaaagtggaacgcgttcacgcggataagccaaacgtcccacgcggcctgacaaaatatctcaccgcgctgcatgaagagctttccagccatatgatgaaagaagaacagatcctgttccccatgatcaaacagggtatgggtcgccaggcaacgggcccgataagcgtaatggaaagcgagcatgacgaggcgggagagctggtagacgtcatcaaacacgtcacccaaaatgtaacgccgccgccagaagcctgcaccacttggaaagcgatgtataacggcattaatgagatgattgatgatctgatggagcacatcagcctggagaataacgtgctgttcccacgcgcgctggccggggaataa

SEQ ID NO: 7569 - protein, 220 aa, Salmonella paratyphi
MAYRDQPLGELALSIPRASALFRQYDMDYCCGGKQTLARAAARHDVDIDIIEAQLAQLAEQPIEKDWRAVPLADIIDHIVVRYHDRHREQLPELILQATKVERVHADKPNVPRGLTKYLTALHEELSSHMMKEEQILFPMIKQGMGRQATGPISVMESEHDEAGELVDVIKHVTQNVTPPPEACTTWKAMYNGINEMIDDLMEHISLENNVLFPRALAGE

SEQ ID NO: 7570 - DNA, 663 bp, Salmonella typhi
  CDS (1)..(663): transl_table=11
atggcttatcgcgatcaacctttaggcgaactggcgctctctattccccgcgcatcggcgctgtttcgccagtacgatatggattactgctgcggcggaaaacagacgctggcgcgcgccgccgctcgtcacgacgtcgatattgacattattgaagcgcaactcgcgcagttggctgaacagcccatcgaaaaagactggcgcgccgttccgctggcggacattattgaccatatcgttgtgcgctatcatgaccgacaccgcgaacaactgccggagcttatcctgcaggcaaccaaagtggaacgcgttcacgcggataagccaaacgtcccacgcggcctgacaaaatatctcaccgcgctgcatgaagagctttccagccatatgatgaaagaagaacagatcctgttccccatgatcaaacagggtatgggtcgccaggcaacgggcccgataagcgtaatggaaagcgagcatgacgaggcgggagagctggtagacgtcatcaaacacgtcacccaaaatgtaacgccgccgccagaagcctgcaccacctggaaagcgatgtataacggcattaatgagatgattgatgctctgatggagcacatcagcctggagaataacgtgctgttcccacgcgcgctggccggggaataa

SEQ ID NO: 7571 - protein, 220 aa, Salmonella typhi
MAYRDQPLGELALSIPRASALFRQYDMDYCCGGKQTLARAAARHDVDIDIIEAQLAQLAEQPIEKDWRAVPLADIIDHIVVRYHDRHREQLPELILQATKVERVHADKPNVPRGLTKYLTALHEELSSHMMKEEQILFPMIKQGMGRQATGPISVMESEHDEAGELVDVIKHVTQNVTPPPEACTTWKAMYNGINEMIDALMEHISLENNVLFPRALAGE

SEQ ID NO: 7572 - DNA, 663 bp, Salmonella typhimurium
  CDS (1)..(663): transl_table=11
atggcttatcgcgatcaacctttaggcgaactggcgctctctattccccgcgcatcggcgctgtttcgccagtacgatatggattactgctgcggcggaaaacagacgctggcgcgcgccgccgcgcgtcacgacgtcgatattgacatcatagaagcgcaactggcgcagttggctgaacagcccatcgaaaaagactggcgcgccgttccgctggcggacattattgaccatatcgttgttcgctatcatgaccgacatcgcgaacaactgccggagcttattctgcaggcaaccaaagtggaacgcgtccacgcggataagccaaacgtcccacgcggcctgacaaaatatctcaccgcgctgcatgaagagctttccagccatatgatgaaagaagaacagatcctgttccccatgatcaaacagggtatgggtcgccaggcaacgggcccgataagcgtaatggaaagcgagcatgacgaggcgggagagctggtagacgtcatcaaacacgtcaccaaaaatgtaacgccgccgccagaagcctgcaccacctggaaagcgatgtataacggcattaatgagatgattgatgatctgatggagcacatcagcctggagaataacgtgctgttcccacgcgcgctggccggggaataa

SEQ ID NO: 7573 - protein, 220 aa, Salmonella typhimurium
MAYRDQPLGELALSIPRASALFRQYDMDYCCGGKQTLARAAARHDVDIDIIEAQLAQLAEQPIEKDWRAVPLADIIDHIVVRYHDRHREQLPELILQATKVERVHADKPNVPRGLTKYLTALHEELSSHMMKEEQILFPMIKQGMGRQATGPISVMESEHDEAGELVDVIKHVTKNVTPPPEACTTWKAMYNGINEMIDDLMEHISLENNVLFPRALAGE

SEQ ID NO: 7574 - DNA, 666 bp, Yersinia pseudotuberculosis
  CDS (1)..(666): transl_table=11
atggattaccgcaatcagtctctgggcgcactggctatcgctattcctcgggccacaaagttattccgtcaacatcagctcgatttctgctgtggcggcaaacaaacactcttacgggccgccaataagttgaatctggatattgatgcgctggaagcacaattgagtgcattgcaaaccgaacctcactcatctgaagattggcaacaacagccactgacaaacctcattagttttatcatcagccgctaccatgatcgccatcgtgagcagctaccagaactggttctcatggcggaaaaggttgaacgggtacacggcgataaacccacctgtcctcgtgggctggcagcagaactcagtgcgattttagaagagttgactcaacatatgtataaagaggagcagatcctgttcccgatgatccaacgaggcatgggttctcaggccagtgggccaatatttgtgatggaagcggagcacgatgcggttgggcagcaattagacgtggtaaaacaactcacacaaaatgtgacaccaccagaaggggcctgtaatacctggcgggcgctttacaccggtatcaatgaattcattactgacctgatggaacatattcatctggaaaataatttactgtttccccgtgcgctaaggggcgaataa

SEQ ID NO: 7575 - protein, 221 aa, Yersinia pseudotuberculosis
MDYRNQSLGALAIAIPRATKLFRQHQLDFCCGGKQTLLRAANKLNLDIDALEAQLSALQTEPHSSEDWQQQPLTNLISFIISRYHDRHREQLPELVLMAEKVERVHGDKPTCPRGLAAELSAILEELTQHMYKEEQILFPMIQRGMGSQASGPIFVMEAEHDAVGQQLDVVKQLTQNVTPPEGACNTWRALYTGINEFITDLMEHIHLENNLLFPRALRGE

SEQ ID NO: 7576 - DNA, 675 bp, Staphylococcus aureus
  CDS (1)..(675): transl_table=11
atgataaataaaaatgacatagtagcagatgtagtaactgattatccgaaagcagcggatatttttagaagtgtgggaatagatttttgttgtggcggacaagtaagtatagaagcagcagccttagaaaagaaaaatgtagatttgaacgaattattacagcgtctcaacgacgttgaacaaacgaatacaccaggttcgttaaatcctaaatttttaaatgtttcatcacttattcaatatattcaatcagcatatcatgaacctctaagagaagaatttaaaaatttaacaccttatgtgacgaagttatcgaaagtacatggacctaatcatccatatttagttgagttaaaagaaacatacgatacatttaaaaatggcatgttagagcatatgcaaaaagaagacgatgtcgattttccaaaactcattaaatatgagcaaggtgaggtagtagacgatattaatactgtgatagatgatttagtttcagaccacattgcaacgggagaattgttagtaaaaatgagcgaattaacatctagttatgaacctccgatagaagcgtgtggtacttggcgacttgtttatcagagattaaaagcacttgaagtgttaacacatgaacacgtacatttagagaatcacgtattatttaaaaaagtatcataa

SEQ ID NO: 7577 - protein, 224 aa, Staphylococcus aureus
MINKNDIVADVVTDYPKAADIFRSVGIDFCCGGQVSIEAAALEKKNVDLNELLQRLNDVEQTNTPGSLNPKFLNVSSLIQYIQSAYHEPLREEFKNLTPYVTKLSKVHGPNHPYLVELKETYDTFKNGMLEHMQKEDDVDFPKLIKYEQGEVVDDINTVIDDLVSDHIATGELLVKMSELTSSYEPPIEACGTWRLVYQRLKALEVLTHEHVHLENHVLFKKVS

SEQ ID NO: 7578 - DNA, 675 bp, Staphylococcus aureus
  CDS (1)..(675): transl_table=11
atgataaataaaaatgacatagtagcagatatagtaatagattatccgaaagcagcagatatttttagaagcgtaggtatagacttttgttgcggtggacaagtaagtatagaagcagcatccttagaaaagaaaaatgtagatttgaacgaattattacagcgtctcaatgacgttgaacaaacgaatacaccaggttcgcttaaccctaaatttttaaatgtttcgtcacttattcaatatattcaagcagcatatcatgaacctcttagagaagaatttaaaaatttaacaccttatgtgacgaaattatcgaaagtacatggacctaaccatccatatttagtcgagttaaaagaaacatatgatacatttaaaagtggcatgttagagcatatgcaaaaagaagatgatgttgattttccaaaactaattaaatatgaacaaggtgaagtagtaaacgatattaatacagtgattgatgatttagtatctgatcacattgcaacgggacaattgttagtgaaaatgagcgatttaacatctagctatgaaccaccgatagaggcatgtggtacgtggcgactcgtttatcagagattaaaagcacttgaagtgttaacacatgagcatgttcatttagagaatcatgttttatttaaaaaagtatcataa

SEQ ID NO: 7579 - protein, 224 aa, Staphylococcus aureus
MINKNDIVADIVIDYPKAADIFRSVGIDFCCGGQVSIEAASLEKKNVDLNELLQRLNDVEQTNTPGSLNPKFLNVSSLIQYIQAAYHEPLREEFKNLTPYVTKLSKVHGPNHPYLVELKETYDTFKSGMLEHMQKEDDVDFPKLIKYEQGEVVNDINTVIDDLVSDHIATGQLLVKMSDLTSSYEPPIEACGTWRLVYQRLKALEVLTHEHVHLENHVLFKKVS

SEQ ID NO: 7580 - DNA, 675 bp, Staphylococcus epidermidis
  CDS (1)..(675): transl_table=11
atgattacaaaagaagatattgttgcagatgttgtaacagattatcctaaaagtgcagatatatttagaaatgctggaatagatttttgttgtggcggacaagagagtatcgcttcagctgtcaatcataaaccaaatattgacttaaattccttattaaataagttgaatcatattgataatacagaaggtaacagtaccattaatcctaaatttttaaatgttgaatctcttatacaatatatacaatcagcttatcacgaaacgcttaaagaagaatttaagaatcttacaccttacatgactaaattggcaaaagtacatggtcctagtcacccatacttattaaaattacaagacttatatcgcgagtttcgtgatagtatgttggatcatatacgtaaagaagatgaggaagattttcctaaactcattcaatatagtcaaggacaagatgtacaaaacattaaaatcatattagaagatttaattaatgaccacgaagatactgggcaattattaaatgttatgaatcaactaacctctgattatcaaaccccagaagaagcatgtggaacatggaagcttgtttaccaaagattacaaaatatcgaacgtcaaacacaccaacatgtacatcttgaaaaccatgtgttatttaaaaaggtaagttaa

SEQ ID NO: 7581 - protein, 224 aa, Staphylococcus epidermidis
MITKEDIVADVVTDYPKSADIFRNAGIDFCCGGQESIASAVNHKPNIDLNSLLNKLNHIDNTEGNSTINPKFLNVESLIQYIQSAYHETLKEEFKNLTPYMTKLAKVHGPSHPYLLKLQDLYREFRDSMLDHIRKEDEEDFPKLIQYSQGQDVQNIKIILEDLINDHEDTGQLLNVMNQLTSDYQTPEEACGTWKLVYQRLQNIERQTHQHVHLENHVLFKKVS

SEQ ID NO: 7582 - DNA, 672 bp, Haemophilus influenzae
  CDS (1)..(672): transl_table=11
atgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaagtaaagcagaaaataatgataaagattggacttcggcatcttatgcggagatgatcgatcacattattactcgttttcataatcgccaccgtgaacaactccctgaattaattacattggcggagaaagtagaaaatatacatggtgatcgtgatgactgtcctataggcgtagtcgcacagttagaaaaaatttatgctgaacttagccagcatttaatgaaagaagaacaaattttgttcccaatgatcaaaatggggaattatgctatggcctcaatgccaattcgtgtaatggaaatggaacacgatgaagcaggacaagatgtggaagtgatcaaatcgcttactaataactgcacgccaccagcagatgcttgtttcagttggaaagccttatatagcggtattaatgaatttattgatgatttaatgcatcatattcatttggaaaataatattttatttccacgtgtattaaacgaaaaataa

SEQ ID NO: 7583 - protein, 223 aa, Haemophilus influenzae
MSFAQQKLSELAVSIPGATKIFREYDLDFCCGGSVLLEVAAQQKNLNLAEIEKRLTDLQQSKAENNDKDWTSASYAEMIDHIITRFHNRHREQLPELITLAEKVENIHGDRDDCPIGVVAQLEKIYAELSQHLMKEEQILFPMIKMGNYAMASMPIRVMEMEHDEAGQDVEVIKSLTNNCTPPADACFSWKALYSGINEFIDDLMHHIHLENNILFPRVLNEK

SEQ ID NO: 7584 - DNA, 23 bp, Artificial sequence
  primer
atggcttatcgcgaccaaccttt

SEQ ID NO: 7585 - DNA, 21 bp, Artificial sequence
  primer
ttactcacccgccagcgcgcg

SEQ ID NO: 7586 - protein, 218 aa, Artificial sequence
  consensus sequence
  Variant (2)..(6): Xaa in position 2 to 6 is any amino acid
  Variant (8)..(12): Xaa in position 8 to 12 is any amino acid
  Variant (14)..(14): Xaa in position 14 is any amino acid
  Variant (19)..(21): Xaa in position 19 to 21 is any amino acid
  Variant (23)..(24): Xaa in position 23 to 24 is any amino acid
  Variant (26)..(58): Xaa in position 26 to 58 is any amino acid
  Variant (59)..(66): Xaa in position 59 to 66 is any or no amino acid
  Variant (68)..(69): Xaa in position 68 to 69 is any amino acid
  Variant (71)..(74): Xaa in position 71 to 74 is any amino acid
  Variant (76)..(82): Xaa in position 76 to 82 is any amino acid
  Variant (84)..(84): Xaa in position 84 is any amino acid
  Variant (86)..(90): Xaa in position 86 to 90 is any amino acid
  Variant (92)..(94): Xaa in position 92 to 94 is any amino acid
  Variant (97)..(116): Xaa in position 97 to 116 is any amino acid
  Variant (117)..(117): Xaa in position 117 is any or no amino acid
  Variant (119)..(120): Xaa in position 119 to 120 is any amino acid
  Variant (122)..(123): Xaa in position 122 to 123 is any amino acid
  Variant (127)..(129): Xaa in position 127 to 129 is any amino acid
  Variant (132)..(144): Xaa in position 132 to 144 is any amino acid
  Variant (145)..(157): Xaa in position 145 to 157 is any or no amino acid
  Variant (159)..(163): Xaa in position 159 to 163 is any amino acid
  Variant (166)..(168): Xaa in position 166 to 168 is any amino acid
  Variant (170)..(178): Xaa in position 170 to 178 is any amino acid
  Variant (180)..(184): Xaa in position 180 to 184 is any amino acid
  Variant (186)..(187): Xaa in position 186 to 187 is any amino acid
  Variant (190)..(195): Xaa in position 190 to 195 is any amino acid
  Variant (197)..(204): Xaa in position 197 to 204 is any amino acid
  Variant (207)..(208): Xaa in position 207 to 208 is any amino acid
  Variant (216)..(216): Xaa in position 216 is any amino acid
PXXXXXFXXXXXDXCCGGXXXLXXAXXXXXXXXXXXXXXXXXXXXXXXXXXXXXXXXXXXXXXXXXIXXIXXXXHXXXXXXXPXLXXXXXKXXXVHXXXXXXXXXXXXXXXXXXXXXLXXHXXKEEXXXFPXXXXXXXXXXXXXXXXXXXXXXXXXXIXXXXXEHXXXGXXXXXXXXXTXXXXXPXXACXXXXXXYXXXXXXXXDLXXHIHLENNXLF

SEQ ID NO: 7587 - protein, 38 aa, Artificial sequence
  protein pattern
  Variant (2)..(3): Xaa in position 2 to 3 is any or no amino acid
  Variant (5)..(7): Xaa in position 5 to 7 is any amino acid
  Variant (9)..(10): Xaa in position 9 to 10 is any amino acid
  Variant (11)..(11): Xaa in position 11 is Ile, Leu or Val
  Variant (12)..(13): Xaa in position 12 to 13 is any amino acid
  Variant (14)..(14): Xaa in position 14 is Ile, Leu, Met or Val
  Variant (15)..(17): Xaa in position 15 to 17 is any amino acid
  Variant (19)..(19): Xaa in position 19 is any amino acid
  Variant (20)..(20): Xaa in position 20 is Asp, Gly or Asn
  Variant (21)..(22): Xaa in position 21 to 22 is any amino acid
  Variant (23)..(23): Xaa in position 23 is Ala, Leu, Pro or Val
  Variant (25)..(26): Xaa in position 25 to 26 is any or no amino acid
  Variant (29)..(29): Xaa in position 29 is any amino acid
  Variant (30)..(30): Xaa in position 30 is Ser or Thr
  Variant (31)..(37): Xaa in position 31 to 37 is any amino acid
  Variant (38)..(38): Xaa in position 38 is Ile or Leu
EXXHXXXGXXXXXXXXXTXXXXXPXXACXXXXXXXXXX

SEQ ID NO: 7588 - protein, 27 aa, Artificial sequence
  protein pattern
  Variant (2)..(5): Xaa in position 2 to 5 is any amino acid
  Variant (6)..(6): Xaa in position 6 is Ile, Leu or Met
  Variant (7)..(7): Xaa in position 7 is Asp or Ser
  Variant (8)..(8): Xaa in position 8 is Phe or Tyr
  Variant (13)..(15): Xaa in position 13 to 15 is any amino acid
  Variant (17)..(18): Xaa in position 17 to 18 is any amino acid
  Variant (20)..(23): Xaa in position 20 to 23 is any amino acid
  Variant (24)..(24): Xaa in position 24 is Ala, Asp, Glu, Gly, Asn or Gln
  Variant (25)..(25): Xaa in position 25 is any amino acid
  Variant (26)..(26): Xaa in position 26 is Ala, Asp, Glu, Asn or Ser
  Variant (27)..(27): Xaa in position 27 is Ala, Ile, Leu, Pro or Val
FXXXXXXXCCGGXXXLXXAXXXXXXXX

SEQ ID NO: 7589 - protein, 10 aa, Artificial sequence
  protein pattern
  Variant (2)..(2): Xaa in position 2 is Ile or Val
  Variant (3)..(3): Xaa in position 3 is any amino acid
  Variant (8)..(8): Xaa in position 8 is Ile, Leu or Val
  Variant (9)..(9): Xaa in position 9 is Leu or Val
HXXLENNXXF

SEQ ID NO: 7590 - protein, 16 aa, Artificial sequence
  protein pattern
  Variant (2)..(3): Xaa in position 2 to 3 is any amino acid
  Variant (5)..(5): Xaa in position 5 is Leu or Met
  Variant (6)..(6): Xaa in position 6 is any amino acid
  Variant (10)..(11): Xaa in position 10 to 11 is any amino acid
  Variant (12)..(14): Xaa in position 12 to 14 is any or no amino acid
  Variant (16)..(16): Xaa in position 16 is Phe or Ile
LXXHXXKEEXXXXXLX

SEQ ID NO: 7591 - DNA, 816 bp, SYNECHOCYSTIS SP.
  CDS (1)..(816): transl_table=11
atgcttgagcttcatcagtttgaactgtcccaatattcggaaaaagtccgcctgattctcgactttaaagggttggattatcggacagtggaagtggtgccgggggttggtcagctcgatttgctccgtctttctggacaaacaaaggttccagtgctcaaggatggggacattgtcattgcagattcgacggaaattgccctctacctagaccgtaaataccccgaaaattcccttttaccccacgatccggtgcaacggggacaatgcttgctgatggaagaatgggccgacgaatccattggtctgaagggtcgggttgccatggtgggggcgttgaaccaaaatcctggtctgcgggcttctattttgcccaaacaaaccccaggcattttcaaaaatttagtcagtgcagtacccccggctatgttagacctattgggcagtggcgttggttttggtggtgatgcggtcaaggaagccatgcggggcttgcatcaggacttggaggctttaactctgattctgcaacatcagccctacctaattggcgatcgcccaacgttggcagatttaacggtggcggcattgagtatggtgatcaaaatccccggcggaaattacttaaacattgcccaggagttgaagggtaagggcattcctggcttggcggataacagtgcctacagtgcattttttgaatggcgcgatcgcctttatcgggaatatcgccgcagtcatcaacaggacaataatcagaacaacggcagcggtagcagtaacaatagttcccccaccacaatcaccattgagtaa

SEQ ID NO: 7592 - protein, 271 aa, SYNECHOCYSTIS SP.
MLELHQFELSQYSEKVRLILDFKGLDYRTVEVVPGVGQLDLLRLSGQTKVPVLKDGDIVIADSTEIALYLDRKYPENSLLPHDPVQRGQCLLMEEWADESIGLKGRVAMVGALNQNPGLRASILPKQTPGIFKNLVSAVPPAMLDLLGSGVGFGGDAVKEAMRGLHQDLEALTLILQHQPYLIGDRPTLADLTVAALSMVIKIPGGNYLNIAQELKGKGIPGLADNSAYSAFFEWRDRLYREYRRSHQQDNNQNNGSGSSNNSSPTTITIE

SEQ ID NO: 7593 - DNA, 663 bp, Pseudomonas aeruginosa PAO1
  CDS (1)..(663): transl_table=11
atgagcctgacactctacggagccccgctgtctccgttcgtccgcaaggtccgcctgctcctggccgaaaagggcctcgactaccagttggaagcgatcgccccgttcggccagccggcctggtatcgcgagatcagtccgctgggccgcatcccggcgttgcgcgacggcgacctggccctcgccgactccagcgtgatctgccagtacctggaagaacgctatcccgaaccgccgaatctccagggcgacgcccccgccagccgcgcagcggtgcgctggctggaaaaatacgccgactacgagatcgctcccctggccacgctgacgatcttccgcaaccggatactcaagccggcgatgggccaggcctgcgaggagaacgacgtgcgtcgcgcgctggaggaaaagctgccagcgcacttcgattacctggaaaaccatctcgacggccgggccttcttcgtcggcgagcgactgaccctcgccgacctggcgatcgccagccagttggtcaacctgcgtcacgccggcgaaaacctggacgagcaacgctggccggccctcgccgcgcatttcgcgcggatgctcgaacgcccggcgatgcaagcgctgctgccgggggaacgacggaccctcgacaagctcgcagcgaaagcctga

SEQ ID NO: 7594 - protein, 220 aa, Pseudomonas aeruginosa PAO1
MSLTLYGAPLSPFVRKVRLLLAEKGLDYQLEAIAPFGQPAWYREISPLGRIPALRDGDLALADSSVICQYLEERYPEPPNLQGDAPASRAAVRWLEKYADYEIAPLATLTIFRNRILKPAMGQACEENDVRRALEEKLPAHFDYLENHLDGRAFFVGERLTLADLAIASQLVNLRHAGENLDEQRWPALAAHFARMLERPAMQALLPGERRTLDKLAAKA

SEQ ID NO: 7595 - DNA, 792 bp, Nostoc sp. PCC 7120
  CDS (1)..(792): transl_table=11
atgttaaaattataccaatgggaattatctcaatactcagaaaaagtgcggctaattctcgattacaaaggattggaataccgcaaaattgaggttacaccaggaattggacaagtagaattattcaggttaactggacaaaaacaagtaccagtattgaaagatggtaacagatatattgccgattcgacagcgatcgccaagtatttagacttagaatatccagaccgtcccctcataccacaagaccccaaacaaaggggtttaactttattaatagaagaatgggctgatgagtccatcggtattaaagggagaaaagcactattttctgctatcagtcaagaccaaagtttccgcaaagccttattacctacctcaacaccagacgttcttaaaaccttagttgaaggcgtacccaccgattttctgacagtgttgggttttggtgttggttacagtccagatgcggttaagtcagcgatcgcagatttaaaacaagacctagaagcacttacactattgttagcagacagtccttatttaactggagacgaacccactctagctgatttagccgtagctggtttatcaatactgttaaaattcccagagggttcttatttagacctacccgccagtattgcaggtaaaggtgtaccatcattagccgataaccctgattatgcagccttttttgcctggcgcgatcgcatctacacccaattccgcaaaccattaattggtaaatcacccatcggtggcgcgccaacctctattcaaattgattag

SEQ ID NO: 7596 - protein, 263 aa, Nostoc sp. PCC 7120
MLKLYQWELSQYSEKVRLILDYKGLEYRKIEVTPGIGQVELFRLTGQKQVPVLKDGNRYIADSTAIAKYLDLEYPDRPLIPQDPKQRGLTLLIEEWADESIGIKGRKALFSAISQDQSFRKALLPTSTPDVLKTLVEGVPTDFLTVLGFGVGYSPDAVKSAIADLKQDLEALTLLLADSPYLTGDEPTLADLAVAGLSILLKFPEGSYLDLPASIAGKGVPSLADNPDYAAFFAWRDRIYTQFRKPLIGKSPIGGAPTSIQID

SEQ ID NO: 7597 - DNA, 675 bp, Drosophila melanogaster
  CDS (1)..(675)
atgtcgagctctggaattgtactctatgggacagatctcagtccctgtgtgaggaccgtcaaacttaccctaaaggtcctgaatctggactacgagtacaaggaggtgaatcttcaggcgggcgagcacctgagcgaggaatatgtgaagaagaatccccaacacacggtaccgatgctcgatgataatggcactttcatctgggactcccatgccattgccgcctacttggtggacaagtatgccaagtcggatgagctgtatcccaaggatctggccaagcgtgcgatcgtcaatcagcgtctcttcttcgatgccagtgtaatctatgccagtatagccaatgtcagccgcccgttttggataaacggtgttaccgaagtgccccaggaaaaactggacgccgtacaccagggtctgaagctgctggagacgttcctgggcaacagcccctacctggccggcgattcgctaaccctagccgatctgtccaccggacccactgtaagcgccgtgcccgctgccgtggacatagatcctgctacatatcccaaggtcaccgcctggttggatcgcctcaataagctgccctactacaaggagatcaacgaagctccggcccagagctacgtcgccttcctgcgcagcaagtggaccaagctgggcgacaagtga

SEQ ID NO: 7598 - protein, 224 aa, Drosophila melanogaster
MSSSGIVLYGTDLSPCVRTVKLTLKVLNLDYEYKEVNLQAGEHLSEEYVKKNPQHTVPMLDDNGTFIWDSHAIAAYLVDKYAKSDELYPKDLAKRAIVNQRLFFDASVIYASIANVSRPFWINGVTEVPQEKLDAVHQGLKLLETFLGNSPYLAGDSLTLADLSTGPTVSAVPAAVDIDPATYPKVTAWLDRLNKLPYYKEINEAPAQSYVAFLRSKWTKLGDK

SEQ ID NO: 7599 - DNA, 726 bp, Prochlorococcus marinus subsp. marinus str. CCMP1375
  CDS (1)..(726): transl_table=11
atgttggaactctatcaatttgagcattcagcattttgtctgaaggtccggttgttcttgcaagccaaaaacctgcaatacaaagtcgttgaaatcactcctggaatcggccaaattaatgtatttaaactttctggtcaaaggcaggtgcctgttttaaaagatggtgaaactattgtctctgactcaagtgaaattattcaatatatagaaactatcacaaatgaacctgagcttttacctaaaaaacctcacgaagcagcaatggctcatcttatcgaagattgggcagatacaaccttggcaaaagcggctcgtttggaactcatcaaagcagcagcaatagacccatcattaagaaaagcgctattacctaatgatttaccaaactcatttaaaggtttaattgacaacttgccttgtgaatttatgaatggtttaacagaagttctgaatcaagggcaaagtactgcattactcaacagtcttgaaaaactatcaaattctgtttcttcacaaccatggctggttggagattctctaagtattgcagatatagcagtagcagctcaattgtccttactaagatttcctttttcatcaggagaatctctttttggcaaaggatgtcttggttttgcagacaatcctcgattagatcctttatttacttggcgtgatcagcttgaaaagaaattaatagagactgatccagcaattttataa

SEQ ID NO: 7600 - protein, 241 aa, Prochlorococcus marinus subsp. marinus str. CCMP1375
MLELYQFEHSAFCLKVRLFLQAKNLQYKVVEITPGIGQINVFKLSGQRQVPVLKDGETIVSDSSEIIQYIETITNEPELLPKKPHEAAMAHLIEDWADTTLAKAARLELIKAAAIDPSLRKALLPNDLPNSFKGLIDNLPCEFMNGLTEVLNQGQSTALLNSLEKLSNSVSSQPWLVGDSLSIADIAVAAQLSLLRFPFSSGESLFGKGCLGFADNPRLDPLFTWRDQLEKKLIETDPAIL

SEQ ID NO: 7601 - DNA, 726 bp, Prochlorococcus marinus subsp. pastoris str. CCMP1986
  CDS (1)..(726): transl_table=11
atgattacattatatcaatttagacatagcgctttttgcttaaagacaagaatggctcttcacgcaaagaaattgcaatatagagttgaagaagttacaccaggcttaggtcaatttgaaatctttaagatatcaggtcaaaaacaagtcccaataattgttgatgataatgatcaaattattagtgactctacaattatttgcgaatatataaataaaaaaaatgataataatccactttttccaaaagatcctttattgtttgcacaatgcaaattaatagaagattgggctgacactactatggcttcaacttgtagaaaagctctgattaaatcagcaatagagaatccacaactacgcactgctttacttccagacgaaataccatcttcagtaaaaggtttagttgataaattaccttttaaaaatcttagtaaaatttctaatgtagttttttctaccaaagacaatttagaactgcaaaaaatattagaggctttatctaaagccctaattaataaaaaatatttgataggcgataatttatcaatagctgatattgcaattagtgcacaattatctcttcttaaatttccaaaatcatcgggaccaattctttcaggggaaggttgtcaagaatacataaataatccttatttagaaaatatatttatttggagaaacaacatagaagaatatctttttagtgctaactctcaataa

SEQ ID NO: 7602 - protein, 241 aa, Prochlorococcus marinus subsp. pastoris str. CCMP1986
MITLYQFRHSAFCLKTRMALHAKKLQYRVEEVTPGLGQFEIFKISGQKQVPIIVDDNDQIISDSTIICEYINKKNDNNPLFPKDPLLFAQCKLIEDWADTTMASTCRKALIKSAIENPQLRTALLPDEIPSSVKGLVDKLPFKNLSKISNVVFSTKDNLELQKILEALSKALINKKYLIGDNLSIADIAISAQLSLLKFPKSSGPILSGEGCQEYINNPYLENIFIWRNNIEEYLFSANSQ

SEQ ID NO: 7603 - DNA, 726 bp, Prochlorococcus marinus str. MIT 9313
  CDS (1)..(726): transl_table=11
atgatggaactgcatcaattccgccattccgccttctgtctcaaggtgcggatggtcttgcaggccaagggtttgacttaccaggtggtggaagttacccccgggttaggacagctcaacgtgtttcgcttgtcaggtcagcgtcaggtcccggtacttgtcgatggcgatgttgttttggcagattccagcactattgctcgacatctagaggctaagcagccggaaccacccctcattccggttgatccacagcaggccgcgcaggtgtacttgattgaagattgggctgatacgacattggcgcgggcaggccggtcagctttgttgcaggctgctgccttggattctgagttgcgtttagctcttcttccagaagatttgccaactcccttgcgtcaggtcatgggagatctccctggggggttgttgaacggtgcctctgagatcattggcaaggcagagagggttgagttattaacgagcctcgaacaattggctgatttgatgcagaaaaggtcctggctagtaggagatgcgatgagcttggctgatttagctgtagccgctcagatttctttaatgcgtttcccagcctcggctggggcagcacttgccggtaaaggtgtgttcggcctgagtgatcacccgcggctgcagcccttattccactggagggatcagcttgagttgtcattgcttgagaaggatgactcagcccgatga

SEQ ID NO: 7604 - protein, 241 aa, Prochlorococcus marinus str. MIT 9313
MMELHQFRHSAFCLKVRMVLQAKGLTYQVVEVTPGLGQLNVFRLSGQRQVPVLVDGDVVLADSSTIARHLEAKQPEPPLIPVDPQQAAQVYLIEDWADTTLARAGRSALLQAAALDSELRLALLPEDLPTPLRQVMGDLPGGLLNGASEIIGKAERVELLTSLEQLADLMQKRSWLVGDAMSLADLAVAAQISLMRFPASAGAALAGKGVFGLSDHPRLQPLFHWRDQLELSLLEKDDSAR

SEQ ID NO: 7605 - DNA, 726 bp, Synechococcus sp. WH 8102
  CDS (1)..(726): transl_table=11
atgctggagctccatcaattcagccactccgccttctgcctaaaggtgcggatggtgctgcaggccaaagggctcagcttccgcaccgtggaggtgacgccgggcatcggtcaggtggcggtgttccgcctttcgggacaacggcaggtgccggtgctcgttgatggcgaccaggtgattgccgattcttctgcagttgcccgtcatctggaacagcgcgaagccgatccggcgctgattcctgccgatccgcgtcaggcggctcagatgcatctgatcgaagactgggctgacaccaccctggccatggccggtcgcacggccctggtgcaggcggcggcgctggatccagagctgcgggtggcgctgcttcccgatgacctgcccgaccccgtgcggtcggtgatgggagccatccccggcggctgggtgaacaacgtcaccgaactggtgaaccaaggggagcgtgctgatctgctggcgagcctggaccagttggcggcctcggttgaggtgtccccctggctggtgggcgaaagcatgaccctggcagatatcgctgtggctgctcagctgtcgttgctgcgcttcccctcatccgccggtgcggctcttgctggcaagggggttccgggcctgagcgatcaccccaagctgcagccgctgttccagtggcgtgatcagatcgaactcaaattgatggagcggaccctggaagaagtgtga

SEQ ID NO: 7606 - protein, 241 aa, Synechococcus sp. WH 8102
MLELHQFSHSAFCLKVRMVLQAKGLSFRTVEVTPGIGQVAVFRLSGQRQVPVLVDGDQVIADSSAVARHLEQREADPALIPADPRQAAQMHLIEDWADTTLAMAGRTALVQAAALDPELRVALLPDDLPDPVRSVMGAIPGGWVNNVTELVNQGERADLLASLDQLAASVEVSPWLVGESMTLADIAVAAQLSLLRFPSSAGAALAGKGVPGLSDHPKLQPLFQWRDQIELKLMERTLEEV

SEQ ID NO: 7607 - DNA, 726 bp, Prochlorococcus marinus str. AS9601
  CDS (1)..(726): transl_table=11
atgattacattatatcaatttaggcatagtgctttttgtttaaaaacaagaatggctcttcatgcaaaaaaaatacaatatcgagttgaagaagtaacacctggaataggccaatttgaaatctttaaattatcaggtcaaaaacaagtacctgtaatagttgatagtaatgatcaagttattaatgactcttcaactatttgcgaatatatagataaaaaaaatgataacaatccactatttccagaggacccaatattatttgcacaatgcaaactaattgaagactgggcagatactacaatggctacaacttgtagaaaagcattaataaaatctgcaatagaaaatccacagctaagaacagcattacttccagatgaactaccttctacagttaaaagtattgttgataaattacctcttgaaaatcttagtaaaatttctaatgtagttttgtcttctaaagataatttagaactccaaaaattactggaagctttatcaaaatccttgatcaacaagaaatatttagttggagatcgtttatcaattgcagatatttcaattgctgctcaattatcccttcttaaatttccaaagtctgcaggaccaattctttcaggagaggggagccaagaatatataaacaacccttatttagaaaatcttttcatttggaggaacaacttagaggaatatctatttagtgctaactctcaataa

SEQ ID NO: 7608 - protein, 241 aa, Prochlorococcus marinus str. AS9601
MITLYQFRHSAFCLKTRMALHAKKIQYRVEEVTPGIGQFEIFKLSGQKQVPVIVDSNDQVINDSSTICEYIDKKNDNNPLFPEDPILFAQCKLIEDWADTTMATTCRKALIKSAIENPQLRTALLPDELPSTVKSIVDKLPLENLSKISNVVLSSKDNLELQKLLEALSKSLINKKYLVGDRLSIADISIAAQLSLLKFPKSAGPILSGEGSQEYINNPYLENLFIWRNNLEEYLFSANSQ

SEQ ID NO: 7609 - DNA, 720 bp, Prochlorococcus marinus str. NATL1A
  CDS (1)..(720): transl_table=11
atgttggaacttcatcaatttaggcactctccttattgcttaaaagtaagaatggctttggctgcaaaaaagcttgaatatcgaaccgttgagataactccagccattgggcaaatagatatctttcaaaaaacaggacaaaaaaaattacccgtactttttgataacgaaacaacaattcatgattcaagttcaataatacgacacttagagaaaattgaaatagagccaaaattaattccagagggtctaaaggaagcttgtcaggtccaaataattgagaattgggcagatacaactttggcaaaatctataaaaattgtctttttggaagagctgacgaagaatccaaaattgatttcctctttattctccaacaaaatttcggattctatgcaaaaacctctttttaatattcctacaaagattgctagtcaaatttctggattaataaaccagaaagaaaaagaatctctaaaattaaatctagaaaacctatcaaatttaattaatcaagaaaactttcttataggagacaagctttctattgctgatatttctgtagcatcacacttatcactactcaaatttccaaattcatctggagaaaatctaactggccaaggttgttctatatatctaaacgatccaagtctgcaaaatctttttaaatggagagacttcattgaagatcaattagcaatagctaatcatcattag

SEQ ID NO: 7610 - protein, 239 aa, Prochlorococcus marinus str. NATL1A
MLELHQFRHSPYCLKVRMALAAKKLEYRTVEITPAIGQIDIFQKTGQKKLPVLFDNETTIHDSSSIIRHLEKIEIEPKLIPEGLKEACQVQIIENWADTTLAKSIKIVFLEELTKNPKLISSLFSNKISDSMQKPLFNIPTKIASQISGLINQKEKESLKLNLENLSNLINQENFLIGDKLSIADISVASHLSLLKFPNSSGENLTGQGCSIYLNDPSLQNLFKWRDFIEDQLAIANHH

SEQ ID NO: 7611 - DNA, 726 bp, Prochlorococcus marinus str. MIT 9215
  CDS (1)..(726): transl_table=11
atgattacattatatcaatttaggcatagtgctttttgtttaaaaacaaggatggctcttcatgcaaaaaaactacaatatcgagttgaagaagtaacacctggaataggccaatttgaaatctttaaattatcaggtcaaaaacaagtacctgtaatagtcgatagtaatgatcaagttattaatgactcttcaactatttgcgaatatatagataaaaaaaatgaaaacaatccactttttccggaggatccaatattatttgcacaatgcaaactaattgaggactgggcagatactacaatggcttcaacttgtagaaaagctttaataaaatctgcaatagaaaatccacagctaagaactgcattacttccagatgaaatgccaacttcagttaaaagtattgttgataaattaccttttgaaaatcttagtaaaatttctaatgtagttttgtcttctaaagataatttagaactccaaaaattactggaagctttatcaaaatccttgatcaacaagaaatatttagttggagatagtttatcaattgcagatatttcaattgctgctcaattatcccttattaaatttccaaagtctgcaggaccaattctttcaggagaggggagccaagaatacataaacaacccttatttagaaaatcttttcatttggaggaacaacttagaagaatatctttttagtgctaactctcaataa

SEQ ID NO: 7612 - protein, 241 aa, Prochlorococcus marinus str. MIT 9215
MITLYQFRHSAFCLKTRMALHAKKLQYRVEEVTPGIGQFEIFKLSGQKQVPVIVDSNDQVINDSSTICEYIDKKNENNPLFPEDPILFAQCKLIEDWADTTMASTCRKALIKSAIENPQLRTALLPDEMPTSVKSIVDKLPFENLSKISNVVLSSKDNLELQKLLEALSKSLINKKYLVGDSLSIADISIAAQLSLIKFPKSAGPILSGEGSQEYINNPYLENLFIWRNNLEEYLFSANSQ

SEQ ID NO: 7613 - DNA, 726 bp, Prochlorococcus marinus str. MIT 9211
  CDS (1)..(726): transl_table=11
atgttggaactatatcaatttcgccattcgtccttttgcttaaaggtaagaatggcgttacaggcaaaagcaataagttacagagttattgaagtgatgcctggaataggtcaaatgaatgtatttcgtctgtctggacaaaggcaagtgccagtcatagtagacaacggaaatataatcgctgattcaagtgaaattattaaatatttagaaggcattgaggctgaacctaagcttttccctaatgaccccaaagaagcagctcaggctcatatcattgaagattgggcagataccactttagcgaaggctgccagaagagccctcttacaagcagcagctattgacgaagacttaagagtagctcttttaccagacgagcttccagcttcactcaagcaaatcattggtggtattccttgccaattcattaatgaaattagtgacttagtaaataatgaacaagaggcatctctcctagaaagcttagaaaagttgtcaagtctggtgaatacaaaaaaatggttagtgggtaatgaacttagtattgcggaccttgcagtagcagcgcagttatcgctaataaagtttccgacttcttcagggatacgccttgccaacaaaggctgtaaaggttttagtgataatccaatactcaagaacttatttgattggcgcgatcaattagaaatagatttaatggaattttcttctgccggatcataa

SEQ ID NO: 7614 - protein, 241 aa, Prochlorococcus marinus str. MIT 9211
MLELYQFRHSSFCLKVRMALQAKAISYRVIEVMPGIGQMNVFRLSGQRQVPVIVDNGNIIADSSEIIKYLEGIEAEPKLFPNDPKEAAQAHIIEDWADTTLAKAARRALLQAAAIDEDLRVALLPDELPASLKQIIGGIPCQFINEISDLVNNEQEASLLESLEKLSSLVNTKKWLVGNELSIADLAVAAQLSLIKFPTSSGIRLANKGCKGFSDNPILKNLFDWRDQLEIDLMEFSSAGS

SEQ ID NO: 7615 - DNA, 681 bp, Acinetobacter sp. ADP1
  CDS (1)..(681): transl_table=11
atgagtacagtggttttacatcaatgggaaatttcaccattctgcaaaaaagtcgcgcggatgttgcagtttaaaggcattgcatttgaaactgtgaattataatggggtattgggggctaaagtcccaagactcagcaaagtcggcaaagtccctgtgctagatatcaacggacaacgcattcaggacagtactaaaattgcccgttatctggatgaggcatatccagatttgccacttttatatcctgtagatccattacaaaaagcctatgtcgaattgtgggaagactggtcggacgaattgttatatttctatgaagtatattttcgggtcagtgatgccgatgccttaaatcgtgcggtcgcgattagtgcggaaggtcgtcccaagcatgagattgtattgatgaaacctttgcttaaagccgcgttgaatctgcaggtgaagatgcaaggcacaggacgaatggcgaaggcggatatcgaggcagaatttactcggcatttagagcgcattgagttggtattgggccaaacgggctggctcgtcggtgagagcaaaaccattgccgatattgcagtgggttcacaactgttagaagtggtgcgtaccagtaaaatctgggggccaaaaattaacagttatccgcatattcagcattggatacaacaattatga

SEQ ID NO: 7616 - protein, 226 aa, Acinetobacter sp. ADP1
MSTVVLHQWEISPFCKKVARMLQFKGIAFETVNYNGVLGAKVPRLSKVGKVPVLDINGQRIQDSTKIARYLDEAYPDLPLLYPVDPLQKAYVELWEDWSDELLYFYEVYFRVSDADALNRAVAISAEGRPKHEIVLMKPLLKAALNLQVKMQGTGRMAKADIEAEFTRHLERIELVLGQTGWLVGESKTIADIAVGSQLLEVVRTSKIWGPKINSYPHIQHWIQQL

SEQ ID NO: 7617 - DNA, 771 bp, Acinetobacter sp. ADP1
  CDS (1)..(771): transl_table=11
atgcatatgcgggttttataccagtttcctttatcccattactgtgaaaaagctcgctggttgctggatcataaagagttagattatattgcacacaatcttattcctggatttcatcgtgcttttgcccagttaaaaacaggacaaaacaagcttcccatacttaaagatgactctcgttgggtcgctcaatctacacccattgcactatatttagatgacacttatcctgagcattctttattacgtagagatcagttgttaagagacaatgcgctcaaaatagatgaaattgctgatgaactaggcattcatgtacgtcgctggacattggcacaggcattgtcctatagcgatgaacctattgaaatcatgatgggtgagcagggttatttacgtcaatttgaaaagttttccaaaccaattttaaaaacattggtgaaaaaaagttatgagttggagcaggataagattgcattatcaaagcaacgcatggatgaattgatcatcgaattaaatgatagactgattgaaaattatgggcgttattttgttggagacagactaggtttggcagatatcgctgtatgttcaatcgttgcacctcttttacatatcaagggaacaccttgggaaattgaaagtagtgaggtcatttctaccgaattggaagaatacaaacaatatattttaagtctcccgctgggtcagtatgtacaaagaatctatgagaccgagcgtaatgcgcgtgtagattggcgtggtatgtag

SEQ ID NO: 7618 - protein, 256 aa, Acinetobacter sp. ADP1
MHMRVLYQFPLSHYCEKARWLLDHKELDYIAHNLIPGFHRAFAQLKTGQNKLPILKDDSRWVAQSTPIALYLDDTYPEHSLLRRDQLLRDNALKIDEIADELGIHVRRWTLAQALSYSDEPIEIMMGEQGYLRQFEKFSKPILKTLVKKSYELEQDKIALSKQRMDELIIELNDRLIENYGRYFVGDRLGLADIAVCSIVAPLLHIKGTPWEIESSEVISTELEEYKQYILSLPLGQYVQRIYETERNARVDWRGM

SEQ ID NO: 7619 - DNA, 720 bp, Prochlorococcus marinus str. NATL2A
  CDS (1)..(720): transl_table=11
atgttggaacttcatcaatttaggcactcaccttattgcttgaaagtaagaatggctttggctgcaaaaaagcttgcatatcgaaccgttgagataactccagccgttgggcaaatagatatctttcaaaaaacaggacaaaaaaaattacccgtgctttttgataacgaaacaataatccatgattcaagctcaataatacgacacttagagaaaattgaaatagaaccaaaattaattccagagggtctaaaggaagcctctcaagtccaaataattgagaattgggcagatacaactttggcaaaatctataaaaattgtctttttggaagagctgtcgaagaatccaaaattgatttcctctttattctcaaataaaatttcggattctatgcaaaaacctctttttaatattcctacaaagattgctagtcaaatttctggattaataaaccagaaagaaaaagaatctctaacattaaatctagaaaacctatcaaatttaattaatcaagaaaactttcttattggagacaagctttctattgctgatatttctgtagcatcacacttatcactactcaaatttccaaattcatctggagaaaatctaactggccaaggttgttctatatatgtaaaagatccaagtctgcaaaatctttttaaatggagagacttcattgaagatcaattagcaataactaatcatcattag

SEQ ID NO: 7620 - protein, 239 aa, Prochlorococcus marinus str. NATL2A
MLELHQFRHSPYCLKVRMALAAKKLAYRTVEITPAVGQIDIFQKTGQKKLPVLFDNETIIHDSSSIIRHLEKIEIEPKLIPEGLKEASQVQIIENWADTTLAKSIKIVFLEELSKNPKLISSLFSNKISDSMQKPLFNIPTKIASQISGLINQKEKESLTLNLENLSNLINQENFLIGDKLSIADISVASHLSLLKFPNSSGENLTGQGCSIYVKDPSLQNLFKWRDFIEDQLAITNHH

SEQ ID NO: 7621 - DNA, 792 bp, Anabaena variabilis ATCC 29413
  CDS (1)..(792): transl_table=11
atgttagaattataccaatgggagttctcccaatactcagaaaaagtacggctaattctcgattacaaaggattagaatatcgcaaaattgaggttaccccaggaattggacaggtagagttattcaggttaactggacaaaaacaagtgccagtcttgaaagatggtaacagatatatttccgactcaacagcgatcgccaaatatttagacttagaatatccagaccgtcctcttttaccaacagaccccaaacaaagaggtttaactttattaatagaagaatgggctgatgagtccatcggtattaaaggaagaaaagcactattttcagctatcagtcaagaccaaagtttccgcaaagctttattacccacctccacaccagacgtactcaaaaccttagttgaaggcgtacccacagatttgctgacagttttgggatttggtgttggttatagtccagatgtggttaagtcagcgatcgcagatttaaaacaagacctagaagcacttacactattgttagcagatagtccttatttaaccggggacgaacccactttggctgatttagccgtagctggtttatcaatactgttaaaattcccagagggttcttatttagacttacccgccagtattgcaggtaaaggtgtaccatcattagccgataaccctgattatgcagccttttttgcctggcgcgatcgcatctacacccaattccgcaaacccctaattggtaaaccacccaccggtggcgcgcctacgtctattcaaattgattag

SEQ ID NO: 7622 - protein, 263 aa, Anabaena variabilis ATCC 29413
MLELYQWEFSQYSEKVRLILDYKGLEYRKIEVTPGIGQVELFRLTGQKQVPVLKDGNRYISDSTAIAKYLDLEYPDRPLLPTDPKQRGLTLLIEEWADESIGIKGRKALFSAISQDQSFRKALLPTSTPDVLKTLVEGVPTDLLTVLGFGVGYSPDVVKSAIADLKQDLEALTLLLADSPYLTGDEPTLADLAVAGLSILLKFPEGSYLDLPASIAGKGVPSLADNPDYAAFFAWRDRIYTQFRKPLIGKPPTGGAPTSIQID

SEQ ID NO: 7623 - DNA, 741 bp, Synechococcus sp. CC9605
  CDS (1)..(741): transl_table=11
atggctgttttggacatgttggagctgcatcaattccgccattccgcgttttgtctcaaggtgcggatggtgttacaggccaagggactgagtttccgcaccgtggaggtgacccctggcgtcggccaggtggccgtgttccgcctgtccggccaacgccaagttcccgtgcttgtggatggggatcaggtgattgccgactccaccgccattgctttgcacctggttcagcgggagcccgatcccgccctaattcctaacgacccacgtcaggcagcccaggtgtatctgttggaggactgggccgacaccaccctcgcgatggctggccgttcctccttggtgcaggccgccgcgctggatcctgagctgcgggttgccctgctccccgacgatctaccggaccccgtgcgttcggtcatgggtgtgatccccggcggttgggtcagcaacatcaccgaactggtcaaccagaaggagcgcactgagctgctggccagcctggagcagctcgccacatcagtgcaggccagtccctggttggtgggcgacagcatgaccctggccgatatcgccgttgctgctcagttgtcactgcttcgcttcccctcctcagcaggttcgcccctggctggcaaaggggtgcctgggctgagcgaccaccccaagctccagccgctgttccagtggcgcgaccagatcgaactcaaattgatggagcggaccctggaagaggtgtga

SEQ ID NO: 7624 - protein, 246 aa, Synechococcus sp. CC9605
MAVLDMLELHQFRHSAFCLKVRMVLQAKGLSFRTVEVTPGVGQVAVFRLSGQRQVPVLVDGDQVIADSTAIALHLVQREPDPALIPNDPRQAAQVYLLEDWADTTLAMAGRSSLVQAAALDPELRVALLPDDLPDPVRSVMGVIPGGWVSNITELVNQKERTELLASLEQLATSVQASPWLVGDSMTLADIAVAAQLSLLRFPSSAGSPLAGKGVPGLSDHPKLQPLFQWRDQIELKLMERTLEEV

SEQ ID NO: 7625 - DNA, 726 bp, Prochlorococcus marinus str. MIT 9312
  CDS (1)..(726): transl_table=11
atgattacattatatcaatttaggcatagtgctttttgtttaaaaacaagaatggctcttcatgcaaaaaaactacaatatcgagtggaagaagtaacacctggaataggtcaatttgcaattttcaaattatcaggtcaaaaacaagtccctgtaatagtcgatagtaatgatcaaattattaatgactcttcaaatatttgcgaatatatagataaaaaaaatgataacaatcaactctttcctgaagacccaatattatttgcgcaatgcaaactaattgaagactgggcagatactacaatggctacaacttgtagaaaaactttaataaaatctgcgatagagaatccacagctaagagctgcattacttccagatgaaataccttcttcagttaaaagtatttttgataaattaccttttaaaaatcttagtaaaatctctaatgtagttttgtcttctaaagataatttagaactccaaaaattactagaagctttatctaaatcgttgatcaacaaaaaatatttagttggagatagtttatcaattgcagatatttcaattgcagctcaattatcccttcttaaattcccaaagtcagcagggccaattctttcaggagaaggaagtcaagaatacataaataacccttatctagaaaatcttttcatatggaggaataatctagaagaatatcttttcagtgctaactctcaataa

SEQ ID NO: 7626 - protein, 241 aa, Prochlorococcus marinus str. MIT 9312
MITLYQFRHSAFCLKTRMALHAKKLQYRVEEVTPGIGQFAIFKLSGQKQVPVIVDSNDQIINDSSNICEYIDKKNDNNQLFPEDPILFAQCKLIEDWADTTMATTCRKTLIKSAIENPQLRAALLPDEIPSSVKSIFDKLPFKNLSKISNVVLSSKDNLELQKLLEALSKSLINKKYLVGDSLSIADISIAAQLSLLKFPKSAGPILSGEGSQEYINNPYLENLFIWRNNLEEYLFSANSQ

SEQ ID NO: 7627 - DNA, 795 bp, Synechococcus elongatus PCC 7942
  CDS (1)..(795): transl_table=11
atgctggagctttaccagtttgagctatcaccctacagcgaaaaggttcggctgattctcgacttcaagggtctggagtatcgcaaacaggaagtgaccccgggcattggtcaattcgaggtctttcgcctgtcgggacagcgccaagtcccagttttgaaagatggcagcgaagcgatcgctgattccaccgcgatcgcgcagtacctcgatcaaaagtttccagagccgccattgactttggctgatccgcagcagcaagccctgaatgtcttgctcgaagattgggccgatcgcagttttgcgacggatgtccgcaccgtactcctcggcgctctcggctgggatcctagtctgcgggaagcagcattgccaaaccaggtgccgggtccgctgcgcaacttggtcagcgctgtcccgagtgaggtttttagcgtccttggcagtggcgtaggtctcagccccgaaaccctccgcactgctcgtctcaaccttgagcagggcctacaggcactctgtcagcgcctacagaaccaaccctatctcttaggcgatcgccccgtgctggcagatttagcgatcgcagcgcacagtctcttcctgaagtttccgaccactgccgcgatcgatattcccgctggtctgcgcgggcgtgggattcctggcctcgtcgataaccctgactatacggtcttcttcgagtggcgcgatcgcctctatcgcgatttccgccgtggtgcagctgtcaccccgcccagcagcggaaatggccccaccaaaatctcgatcgactag

SEQ ID NO: 7628 - protein, 264 aa, Synechococcus elongatus PCC 7942
MLELYQFELSPYSEKVRLILDFKGLEYRKQEVTPGIGQFEVFRLSGQRQVPVLKDGSEAIADSTAIAQYLDQKFPEPPLTLADPQQQALNVLLEDWADRSFATDVRTVLLGALGWDPSLREAALPNQVPGPLRNLVSAVPSEVFSVLGSGVGLSPETLRTARLNLEQGLQALCQRLQNQPYLLGDRPVLADLAIAAHSLFLKFPTTAAIDIPAGLRGRGIPGLVDNPDYTVFFEWRDRLYRDFRRGAAVTPPSSGNGPTKISID

SEQ ID NO: 7629 - DNA, 768 bp, Myxococcus xanthus DK 1622
  CDS (1)..(768): transl_table=11
atgacgtggaccctggttggcgaggccgcttctccctggtccgaaaaggcccgctgggcgctggaccaccaccgcctcgcgtatgcgtaccgcgagcactacccgctcatcggcgaactctcgctgcggctgcgggcgcggcggctgaagggccgcgtgagcacgcccatgctgctcacgcccgaaggcccgctcatcgactccttccacatcgcccgctacgcggacgcgcacggcagcgcgcccacgctctttccggccgagcacgccgaggagatcgccgcctggaacgcccgcagcgaggccgcgctcggcgcggcgcgagtgcgctacctcgaccggctcgcgaacgaccgcgccgcgaagctggagcagcagccacccgccttccctggtttcgtgcgccagctctcggtgcccgcggtggacctcgccatgaccttcctgcgcaggaagtacgggatgccggacagcacggcggcggaggccacgctggtattcgagttggaggcgctgcagcgtgcgctcgcgggcggcaagcgccacctcgtcgcgaaccgcctcacctacgcggacctcgcgatggcggtgacgctgcagttcgtgtcacccgtggacggcgggcacatcgcggtaggccccgccacgcgcgcggcgggcatccacccacaactgtgcgcgcgctatccggacatcgtcgcctggcgcgacgcgctctacgcgcggcaccggcgcagcgagcagcccgccgagcccgtccaggagtag

SEQ ID NO: 7630 - protein, 255 aa, Myxococcus xanthus DK 1622
MTWTLVGEAASPWSEKARWALDHHRLAYAYREHYPLIGELSLRLRARRLKGRVSTPMLLTPEGPLIDSFHIARYADAHGSAPTLFPAEHAEEIAAWNARSEAALGAARVRYLDRLANDRAAKLEQQPPAFPGFVRQLSVPAVDLAMTFLRRKYGMPDSTAAEATLVFELEALQRALAGGKRHLVANRLTYADLAMAVTLQFVSPVDGGHIAVGPATRAAGIHPQLCARYPDIVAWRDALYARHRRSEQPAEPVQE

SEQ ID NO: 7631 - DNA, 771 bp, Myxococcus xanthus DK 1622
  CDS (1)..(771): transl_table=11
gtggcgcatgcgcccgggcgtactgtcccgggcggcatgcgcacactctatggactcagttactcgccctggacggagaagacccgttgggcgttggaccaccaccgtgtcgcctatcgctaccgcgaacacctgccgctcatcggcgagccgctgctgcgctggcgtacgccgcgtggtgtgcggcccgccgtgccgctgctcatcgacgagggcgaggcctttcccggctcgttcgtcatcgcgcggcgcgcggaggagctgggacagggggagccgctcttccccgcaacggacctcccggtgattcagcgctgggacgatgacagtgagcaggtgcactccgcggcgcgcgccaaggtggtggcggcgttgttggagaatcggcaggcgcaggcggagagcctccccgccttcctgcccatgggactccggtctctgctggccccgtccgcgaggctgggcgcgcgcttcgtggcccgcaaacaccaggcgcccacggacatcggcgcggccgtccaggagaaggtcatccccacgctggagcgcctgcgtgagtcactgggcggccggccctacctgctggcgcgcttcagcttcgcggacatcgcggccgcgctgatgctccagttcgtgcggccggtggacgacagctacctccccctgggccccggcacgcgagcggtgtggagtgacgcggagctcgcctcccgcttcccggacctgctcgagtggcgggacggcctgtatgcgaagcaccgccgtccctga

SEQ ID NO: 7632 - protein, 256 aa, Myxococcus xanthus DK 1622
MAHAPGRTVPGGMRTLYGLSYSPWTEKTRWALDHHRVAYRYREHLPLIGEPLLRWRTPRGVRPAVPLLIDEGEAFPGSFVIARRAEELGQGEPLFPATDLPVIQRWDDDSEQVHSAARAKVVAALLENRQAQAESLPAFLPMGLRSLLAPSARLGARFVARKHQAPTDIGAAVQEKVIPTLERLRESLGGRPYLLARFSFADIAAALMLQFVRPVDDSYLPLGPGTRAVWSDAELASRFPDLLEWRDGLYAKHRRP

SEQ ID NO: 7633 - DNA, 726 bp, Synechococcus sp. CC9311
  CDS (1)..(726): transl_table=11
atgctggagctgcatcaattccgtcattccgccttctgcctcaaggtgaggatggcattgcatgccaagggtttgagctttcgagaagtggaggtcacacctggaatcgggcaactcgccgtgttccgtttgtcagggcaaagacaagttccggtgctcgtggatggcgacacggtggtggcagattccagcgcgatctgtcgttatttggatgagctgcagcccgaaccaccgctcttcccgaaggaccctcgatctgtggcccagattcatttgattgaagactgggctgatacaacgcttgccggatccgtccgcgcggctctgcttcaagcggcggtggatgatcctgatttgcgtgcggccctcttgcctgatgacgtacctggcccaattaggcaggtgatgaccggagtgccgacgggttggctgagtggggtgaatgagctgtttggccaggaggagcgttccgccatgctccacaacctgatcgcgattgctgatggcctgactccagacagcgtcttggttggcgattccctcagccttgcggatttggcagtagcggcgcagctctccctgttgcgctttcccgcttcatcagggtcccaattggctggtcgaggcgttgccgggctcagtgatcatcctcgccttcagcctttgtttgagtggcgcgatcgactggaggctcgtgtgttcaagcaggatcctgcagccgtgtga

SEQ ID NO: 7634 - protein, 241 aa, Synechococcus sp. CC9311
MLELHQFRHSAFCLKVRMALHAKGLSFREVEVTPGIGQLAVFRLSGQRQVPVLVDGDTVVADSSAICRYLDELQPEPPLFPKDPRSVAQIHLIEDWADTTLAGSVRAALLQAAVDDPDLRAALLPDDVPGPIRQVMTGVPTGWLSGVNELFGQEERSAMLHNLIAIADGLTPDSVLVGDSLSLADLAVAAQLSLLRFPASSGSQLAGRGVAGLSDHPRLQPLFEWRDRLEARVFKQDPAAV

SEQ ID NO: 7635 - DNA, 795 bp, Nostoc punctiforme PCC 73102
  CDS (1)..(795): transl_table=11
atgctggaattataccaatgggaactatctcaatactcagaaaaagtgcgcctaattctagattttaaaggactagattaccgcaaaatagaagttacgcctgggattggacaagtagaactgttccggctgactggtcagaaacaagtcccagtattaaaggatcgtaataaatatattgcggattctacggaaatagctaagtatttagacttagagtatcccgatcgccccataataccccaagatcccaaaaaacggggtttaactttattgatagaagaatgggcggatgaatctataggtatcaaaggtaggaaagcgctatttgcagctgtaagtcaagatcaaaatttccgcaagtctttattacccacctcaacaccagatatatttaaaagtctggttggaggagtacctactgacttactgacagtgttgggttttggggtaggttatagtccagatgtgatccagtcagcgatcgcatctttaaaacaagacttggaagctctaacgttattattggcagatagtccttatttaactggagatgagccgactttagctgacttgtcagtggctggcttatcgatattactcaagttccctcctggaccctatctggatttaccagcttctattagaggaaaaggattgccaatcttttcagagaatatagattatgaaccattctttacctggcgcgatcgcatttacgctcaattccgtaaaccattaatcagtaccacctcagccgcagggggtgcgccaacttcgattcagattgattag

SEQ ID NO: 7636 - protein, 264 aa, Nostoc punctiforme PCC 73102
MLELYQWELSQYSEKVRLILDFKGLDYRKIEVTPGIGQVELFRLTGQKQVPVLKDRNKYIADSTEIAKYLDLEYPDRPIIPQDPKKRGLTLLIEEWADESIGIKGRKALFAAVSQDQNFRKSLLPTSTPDIFKSLVGGVPTDLLTVLGFGVGYSPDVIQSAIASLKQDLEALTLLLADSPYLTGDEPTLADLSVAGLSILLKFPPGPYLDLPASIRGKGLPIFSENIDYEPFFTWRDRIYAQFRKPLISTTSAAGGAPTSIQID

SEQ ID NO: 7637 - DNA, 792 bp, Crocosphaera watsonii WH 8501
  CDS (1)..(792): transl_table=11
atgttagaactgtatcaatttgaggtttctcaatattctgagaaagtgcgcttaattcttgattacaaaggattagaatatcgtaaaatcgaagttactccaggtgtgggacaactggacttgtataaaatgtcgggacaaagacaagttcctgtcttaaaggatggagaaactattgttgctgattccactgagatagccttttatttagatagaaaatacccagaaaaaccaattatccctgcagatcctcttaaacgaggacaatgtttactgatagaagaatgggctgatgaatctatcggaatcaaaggaagatttgctttagtcggagcattaaatcaaaaccccaattttcgtagttctgttttaccaaaagaagtacctgacgtagtaaaaaatattattagtgcggttcctggggatcttttgagtgctttaggaacaggggttggggttggaccagatacagttaaagaagccactaaagccctgaaacaagacctagaagctcttagtcttattttagagcatcaaccctatttagttggggatgaaatcaccttagctgatttagccgtggcaggattaagtattattttaaaacaacctggcggtgactatttagatattcctgataacctcaaaggaaaaggtattcctgggttagcagataacactgcttatgatgctttcttcctctggcgcgatcgcctttacatggactatcgaaaacccctttcttctcaaccctctgaagaagagtcaccgactagcattgagatagaatag

SEQ ID NO: 7638 - protein, 263 aa, Crocosphaera watsonii WH 8501
MLELYQFEVSQYSEKVRLILDYKGLEYRKIEVTPGVGQLDLYKMSGQRQVPVLKDGETIVADSTEIAFYLDRKYPEKPIIPADPLKRGQCLLIEEWADESIGIKGRFALVGALNQNPNFRSSVLPKEVPDVVKNIISAVPGDLLSALGTGVGVGPDTVKEATKALKQDLEALSLILEHQPYLVGDEITLADLAVAGLSIILKQPGGDYLDIPDNLKGKGIPGLADNTAYDAFFLWRDRLYMDYRKPLSSQPSEEESPTSIEIE

SEQ ID NO: 7639 - DNA, 621 bp, Erythrobacter sp. NAP1
  CDS (1)..(621): transl_table=11
atgaaactctaccacttcccgctctctggccacgctcaccgcgcccggctctttctgtcgcttcttaacgtcgaggccgagatcgtcgatgtcgatcttgccaatggcgagcacaagtcggccccgtatctggcgctcaactcctttggccaagttcctgtgctggtcgacggtgacaccgtgatctcagactccaacgccattcttgtctatgtcgcaaagaagttcggccgcagtgactggcttcctgaagcacccgctgctgcagcccgcgtccagcgctggctttcggtcgccgcgggggaactcgcagctgggccaggtgctgctcgcctgattaccgtcttcggcgccgatttcgatccggaaaagacgatcgcaaaggctcatgccattctcaagctgatcgatagcgagctggaaggccgcaactggattactggcagcgcccagccgacgatcgctgacgtcgcgctctacagctacatcgtcaacgctcccgaagggaacgtagatctgtcgagctacaaccgcgtcaacgcctggcttgatcggattgaaaagctcgagggcttcgcacccttccagaccactgaaatcggcctgcgcaaagccgcatga

SEQ ID NO: 7640 - protein, 206 aa, Erythrobacter sp. NAP1
MKLYHFPLSGHAHRARLFLSLLNVEAEIVDVDLANGEHKSAPYLALNSFGQVPVLVDGDTVISDSNAILVYVAKKFGRSDWLPEAPAAAARVQRWLSVAAGELAAGPGAARLITVFGADFDPEKTIAKAHAILKLIDSELEGRNWITGSAQPTIADVALYSYIVNAPEGNVDLSSYNRVNAWLDRIEKLEGFAPFQTTEIGLRKAA

SEQ ID NO: 7641 - DNA, 726 bp, Synechococcus sp. RS9917
  CDS (1)..(726): transl_table=11
atgctggagctccatcagttccgccattccgccttctgcctgaaggtgcgcatggtgctgcaggccaaagccctgagttatcgcgtggtggaggtcaccccgggcgtgggtcagctggctgtttttcgcctctcgggccagcgtcagctgcccgttctggtggatggcgacacggtgatcgctgattcctcggcgatcgcccgccacctcgagtcggtcgaacccgacccttccctgatccctcaggacgcgcgcgacgcggctcaggtgcctctgatcgaagactgggccgacaccaccctggcccatgccgcccgcctcgccctggtgcaggcggcggcgagtgatccggagctgcgggtggcactgctgcctgatgacctgccggaaccgctgcggcgcacactggccggtttgcccggcggttggctgcaggggcttggcgaggtgctcgatcagggggagcgtgccgccatgttcaccagcctgcagcggctggctgcggctgtggagaccacgccctggttggtcggagatcagctttccatggccgatctggcggtggcggcccagctttcgctgctgcgttttcccgcgtccgccggagatggcctggcgggtcggggcgtgccaggactcagtgatcacccccagctgcagccgctgttcgcctggcgggatcgtttggagacccgtctgtttcaggttgatccggcagccgtgtga

SEQ ID NO: 7642 - protein, 241 aa, Synechococcus sp. RS9917
MLELHQFRHSAFCLKVRMVLQAKALSYRVVEVTPGVGQLAVFRLSGQRQLPVLVDGDTVIADSSAIARHLESVEPDPSLIPQDARDAAQVPLIEDWADTTLAHAARLALVQAAASDPELRVALLPDDLPEPLRRTLAGLPGGWLQGLGEVLDQGERAAMFTSLQRLAAAVETTPWLVGDQLSMADLAVAAQLSLLRFPASAGDGLAGRGVPGLSDHPQLQPLFAWRDRLETRLFQVDPAAV

SEQ ID NO: 7643 - DNA, 744 bp, Synechococcus sp. WH 5701
  CDS (1)..(744): transl_table=11
atgctcgagctccaccagttccgccattcctccttctgcgagaaggtgaggttgatcctggccgccaaggggctggagtacagcatcatcgaggtcacccccgggttggggcagctggagctgttccgtctttccggtcagcggcaggtgccggtactggtggatggcggagaggtgatcgccgattccagcgccattgcccagcatctggagagccaggtgccgacccctcccctgattcccgaggatccggccgatcgggcccgggtgcttctgctcgaagactgggccgacaccgccctggcttctggggtgcgtcaggccctgttgcaggcggccggttcggattcggtgatgcgcggtgccctgctgcctgaggccacccccgcgctgcttcgttcgctgttgggggctctgcccaccgatctgctcacccccctgggcgacaccatcggccagacggagcggcgccaactccaggcgaacctcgagcagctggcggtgctgctggcgccgggccgctttctcgtgggtgatcggctctccctggccgatctggccgtggctgcccagttgtcgcttctgctcttcccagccagcgctggtgcccccctggctggccgcggcgtgcccggcctggccgaccatcccctgctcaccagcctgttcgcctggagggatggcctctacctctccctcggccgaggcgccgtcagcgagccggtttcccagccaccgctttga

SEQ ID NO: 7644 - protein, 247 aa, Synechococcus sp. WH 5701
MLELHQFRHSSFCEKVRLILAAKGLEYSIIEVTPGLGQLELFRLSGQRQVPVLVDGGEVIADSSAIAQHLESQVPTPPLIPEDPADRARVLLLEDWADTALASGVRQALLQAAGSDSVMRGALLPEATPALLRSLLGALPTDLLTPLGDTIGQTERRQLQANLEQLAVLLAPGRFLVGDRLSLADLAVAAQLSLLLFPASAGAPLAGRGVPGLADHPLLTSLFAWRDGLYLSLGRGAVSEPVSQPPL

SEQ ID NO: 7645 - DNA, 729 bp, Synechococcus sp. WH 7805
  CDS (1)..(729): transl_table=11
atgctggagctccaccagttccgccactccgccttctgcatgaaggtgcggatgacgctccacgccaaagacctgagttttcgtgaggtggaggtcactccggggctgggtcaactgtctgtttttcggatctcgggtcagcgacaggtcccggttctggttgacggtgatcaggtgttcgctgattccagcgccatctgccggtatctcgaaacgctgcaacccgagcccgtcctgcttccttccgatccgctccagagagcccaggtggaactgattgaagattgggctgacaccaccctggccgcgtcagcccgggcagcgcttctgcaggctgcagctgacgacacccagctcaggtcggctcttctgcctgatgatctgccggcacccttgcgacaggtcatgtctgtggttccaggtgggtggttgagcaacttgggggatttgctcggtcaggagcagagggcgtccatgctttccagtctcatggctctggccgaaggcctcgacaagaacgagcacctggtaggcaacacactcaccttggcggatcttgctgtggccgctcagctctccttgctgcgtttccctggctcctcaggagattctttagctggccgcggcgttcctggtctcagcgatcatccccgccttcagtccctattccattggcgcgatcagttggaggcccagctcattcagcgggatcctgcggcagccgagtga

SEQ ID NO: 7646 - protein, 242 aa, Synechococcus sp. WH 7805
MLELHQFRHSAFCMKVRMTLHAKDLSFREVEVTPGLGQLSVFRISGQRQVPVLVDGDQVFADSSAICRYLETLQPEPVLLPSDPLQRAQVELIEDWADTTLAASARAALLQAAADDTQLRSALLPDDLPAPLRQVMSVVPGGWLSNLGDLLGQEQRASMLSSLMALAEGLDKNEHLVGNTLTLADLAVAAQLSLLRFPGSSGDSLAGRGVPGLSDHPRLQSLFHWRDQLEAQLIQRDPAAAE

SEQ ID NO: 7647 - DNA, 771 bp, Synechococcus sp. RS9916
  CDS (1)..(771): transl_table=11
ttggaatctgatggctactctgccggtcgcaaggcaggtctggccatgttggagctccatcagttccgtcactccgccttttgcttgaaggtgcggatgattcttcaggccaaatccctgagttatcgggtggtggaagtcgttcccggtgtggggcagatcgatgtgttccggttgtcgggccagcgccaggtgcccgtgttggtcgatggcgacacggtggtggccgactccagtgccatcgcccgccatctcgagaccctggaacctgatccggccctccttccctccgatccctggcaccgggcccaagcgcaactgatcgaagattgggcggacaccaccttggccgctgctgcccgaatggccctggcccaggcagcggtgggtgataacgctctgcgggaggccttactgcccgatgggttgccgtcgcccgtgcgtcagaccgtcgcggctctgccgggtgggtggttacaggggcttggcgaggtggtcgaccagggggggcgcgctgagatgctcgccagcctgatcgcaatcgcggattccgtggcgctgaagccctggttggtgggtgacacccttagccttgcggatatcgccgtggcggctcaggtgtcgttgctgcgtttcccggcgtcttccggagagctgctcgccggtcagggagtggcaggtctcagtgatcacccccgcttgcagcctttgttccactggcgcgatcagctggaaacgcagttgatgcagtcggatccggctgccgtttga

SEQ ID NO: 7648 - protein, 256 aa, Synechococcus sp. RS9916
MESDGYSAGRKAGLAMLELHQFRHSAFCLKVRMILQAKSLSYRVVEVVPGVGQIDVFRLSGQRQVPVLVDGDTVVADSSAIARHLETLEPDPALLPSDPWHRAQAQLIEDWADTTLAAAARMALAQAAVGDNALREALLPDGLPSPVRQTVAALPGGWLQGLGEVVDQGGRAEMLASLIAIADSVALKPWLVGDTLSLADIAVAAQVSLLRFPASSGELLAGQGVAGLSDHPRLQPLFHWRDQLETQLMQSDPAAV

SEQ ID NO: 7649 - DNA, 624 bp, Moritella sp. PE36
  CDS (1)..(624): transl_table=11
atgtcagcaatcaaactataccgccatccattatctgggcatgcccacagagtcgaattgctgttatcgttacttggattagaaaccgaacttattgatgtcgacttgctgaaaggtgagcacaaacagcctgaatttttgaaaaaaaataatgccgggcaagtgcctgttattgaagacggtgatgtgaccttgtcagactccaatgctattttgatttacctcgccagtaaatacgatgatgcgcatatttggttgccaattgatcccgtacttgccgctcaagtacaaggttttcttaccattgctgcgagtagtgttgattatggccccgcgacggcgcgtttaattaacatctttcacgcgaaacttgatcaccaaaaagccttagatatcgcacatgcgatgttaaaacaattagacccgcatttagaacaccacccttggttagtgggacataaacccaccattgcagatattgccaattacacctatatcgcacacgcgccggaaggaggggtatcgttacaagactacccgcatgttaggcgttggttatctcgcgttgaggaacttaaaggctttgtgcccatgcaagctactgcggctgggctcattgtctaa

SEQ ID NO: 7650 - protein, 207 aa, Moritella sp. PE36
MSAIKLYRHPLSGHAHRVELLLSLLGLETELIDVDLLKGEHKQPEFLKKNNAGQVPVIEDGDVTLSDSNAILIYLASKYDDAHIWLPIDPVLAAQVQGFLTIAASSVDYGPATARLINIFHAKLDHQKALDIAHAMLKQLDPHLEHHPWLVGHKPTIADIANYTYIAHAPEGGVSLQDYPHVRRWLSRVEELKGFVPMQATAAGLIV

SEQ ID NO: 7651 - DNA, 675 bp, Zea mays
  CDS (1)..(675)
atggccgaggagaagaagcagggcctgcagctgctggacttctgggtgagcccattcgggcagcgctgccgcatcgcgatggacgagaagggcctggcctacgagtacctggagcaggacctggggaacaagagcgagctgctcctccgcgccaacccggtgcataagaagatccccgtgctgctgcacgacggccgccccgtctgcgagtccctcgtcatcgtgcagtacctcgacgaggcgttcccggcggcggcgccggcgctgctccccgccgacccctacgcgcgcgcgcaggcccgcttctgggcggactacgtcgacaagaagctctacgactgcggcacccggctgtggaagctcaagggggacggccaggcgcaggcgcgcgccgagatggtcgagatcctccgcacgctggagggcgcgctcggcgacgggcccttcttcggcggcgacgccctcggcttcgtcgacgtcgcgctcgtgcccttcacgtcctggttcctcgcctacgaccgcttcggcggcgtcagcgtggagaaggagtgcccgaggctggccgcctgggccaagcgctgcgccgagcgccccagcgtcgccaagaacctctacccgcccgagaaggtctacgacttcgtctgcgggatgaagaagaggctgggcatcgagtag

SEQ ID NO: 7652 - protein, 224 aa, Zea mays
MAEEKKQGLQLLDFWVSPFGQRCRIAMDEKGLAYEYLEQDLGNKSELLLRANPVHKKIPVLLHDGRPVCESLVIVQYLDEAFPAAAPALLPADPYARAQARFWADYVDKKLYDCGTRLWKLKGDGQAQARAEMVEILRTLEGALGDGPFFGGDALGFVDVALVPFTSWFLAYDRFGGVSVEKECPRLAAWAKRCAERPSVAKNLYPPEKVYDFVCGMKKRLGIE

SEQ ID NO: 7653 - DNA, 696 bp, Aspergillus oryzae
  CDS (1)..(696)
atggtcctcaaactttacggattccctctttccacttgtactcgtcgagtacgcaccgtcctcgcagaaaagggtgtcgaggccgaattccactcagtcgacctggccaagggcgaacaaaaatcagagtcctacctgaatgacctgcacccattcggcaaagttcccgttctccaagacactgagacgggtgttcagattttcgaaagcagagccatcaaccagtacctttccagcaagtacgccgggcaaggaaccacactctcccctcccgagtccgatctgaaagcctgggctctgtaccaacaggcacgtatacaccccgtcgcatacacgaaccacactaacaggatgcaggctctctctattgaacaatcctacttcgacccgatcgtttcccagatcgctttcgagaaagtcttcaaagtccgcaagggtctcggtgagaccgacgaggctcgcgtccaggtcctcttttcgcagctcacgcccgtcctcgagggctatgagcgcgttctttccaggcacaagtaccttgcgggtgaccaggtgacacttgcggatttggcccatctgccgtatggggtgtttgtggagcagttcggtttcgctgatcttctgccaaagtatccccatgttcagaagtggtgggaggagctgaaggcgagggagagctggaagaaggttactgcttag

SEQ ID NO: 7654 - protein, 231 aa, Aspergillus oryzae
MVLKLYGFPLSTCTRRVRTVLAEKGVEAEFHSVDLAKGEQKSESYLNDLHPFGKVPVLQDTETGVQIFESRAINQYLSSKYAGQGTTLSPPESDLKAWALYQQARIHPVAYTNHTNRMQALSIEQSYFDPIVSQIAFEKVFKVRKGLGETDEARVQVLFSQLTPVLEGYERVLSRHKYLAGDQVTLADLAHLPYGVFVEQFGFADLLPKYPHVQKWWEELKARESWKKVTA

SEQ ID NO: 7655 - DNA, 618 bp, Corbicula fluminea
  CDS (1)..(618)
atgagcaaatatcagctgttttacttcccagttagaggtcgtggccaggctatccgctatctgtttgttgataatggattagactatgaagagatagatgttggaggcaactgggcgaccgaatacaaatccaagatgccgttcggccaggtgccggtagtgaaggacggagatctggacgtagcccagtccaatgccatcatgcggtacctgggcagaaaacacgatatgtaccccacagatccggtggaggccctaaaggtggacatgatcctagaccactcagaggatatcagaggcccttacgtgaggatgatctatcctaactatgaagcaggaaaagatgacttcatcaagagtttaccagaaaagttccagtaccttgagaatcttctcaagaattggggaacagatttcatttcatcaaagatatcattcgccgactacagcctgtttgacctgttggacgacttagtgatcctggctcccggttgcattgatgacttccccaccgtgaaggcctactacgaccgtatcgcttcccggcctgcactccagaagttccgggaatcagaagagttcaagaacatgccagtaaacggaaatgggaaacagtga

SEQ ID NO: 7656 - protein, 205 aa, Corbicula fluminea
MSKYQLFYFPVRGRGQAIRYLFVDNGLDYEEIDVGGNWATEYKSKMPFGQVPVVKDGDLDVAQSNAIMRYLGRKHDMYPTDPVEALKVDMILDHSEDIRGPYVRMIYPNYEAGKDDFIKSLPEKFQYLENLLKNWGTDFISSKISFADYSLFDLLDDLVILAPGCIDDFPTVKAYYDRIASRPALQKFRESEEFKNMPVNGNGKQ

SEQ ID NO: 7657 - DNA, 687 bp, Zea mays
  CDS (1)..(687)
atggccgccaatggaggtgatgagctgaagctgctgggcgtgtgggacagcccgtacgtcaacagggtccagatcgtgctcaacctcaagggcctcagctacgagtacgtggaggaggacctcctcagcaagagcgagctcctcctcaattccaacccggtgcacaagaaagtgcccgtgctcatccacgccggcaagccggtcgccgagtcgcaggccatcgttcagtacctcgacgaggctttccccagcggcacgttcccgtcggtcctcccagccgaaccctacgcacgcgccaccgcccgcttctgggccgccttcgtcgacgacaaggtcgggtctccatggcacacggtcctgttcgcgcgggagcacgggaagaaggcggacgcggcgtcgcggatcgtcgcggcgctggagacgctggagggtgcgttcgaggactgctccggcgggagggactacttcggcggcgacgccatcggcttcgtggacgtggtcctcggcagctacctgggctggttcaaggtgttcgagaagatggtcggcgtcagggtcctggacgtggcgaggacgccgctcctcgccgcgtggggggagcgtttcgcggcggcggaagcggccaaggacgtcctgccggatgacgttgacaaggtgctcgagttccttcagaagttcctggattag

SEQ ID NO: 7658 - protein, 228 aa, Zea mays
MAANGGDELKLLGVWDSPYVNRVQIVLNLKGLSYEYVEEDLLSKSELLLNSNPVHKKVPVLIHAGKPVAESQAIVQYLDEAFPSGTFPSVLPAEPYARATARFWAAFVDDKVGSPWHTVLFAREHGKKADAASRIVAALETLEGAFEDCSGGRDYFGGDAIGFVDVVLGSYLGWFKVFEKMVGVRVLDVARTPLLAAWGERFAAAEAAKDVLPDDVDKVLEFLQKFLD

SEQ ID NO: 7659 - DNA, 648 bp, Arabidopsis thaliana
  CDS (1)..(648)
atggtgttgacaatctatgctcctttattcgcttcttcaaagagagctgttgtgacattggtggagaagggagtatcattcgaaactgtcaatgtcgatctcatgaaaggagaacagagacagcctgagtatctcgcgattcagcctttcggtaaaatcccagtcctcgtcgacggagactacaaaatcttcgagtcgcgtgcgatcatgaggtatatagcagagaagtatagatcacaaggacctgatcttttggggaagactattgaagagagaggacaagtagagcaatggttagacgttgaggctacaagttaccatccaccactattggctttaacgctcaacattgtctttgcaccacttatgggtttccctgctgatgagaaagttattaaggagagtgaagagaagcttgcagaagtgcttgatgtctatgaagctcagctttctaagaacgaatacttggctggtgattttgtgagtctagctgatttggctcaccttcctttcaccgagtatcttgttggccctattgggaaggctcatttgatcaaagataggaagcatgttagcgcttggtgggataagattagtagccgtgctgcgtggaaggaggtttccgctaagtactcactacctgtttaa

SEQ ID NO: 7660 - protein, 215 aa, Arabidopsis thaliana
MVLTIYAPLFASSKRAVVTLVEKGVSFETVNVDLMKGEQRQPEYLAIQPFGKIPVLVDGDYKIFESRAIMRYIAEKYRSQGPDLLGKTIEERGQVEQWLDVEATSYHPPLLALTLNIVFAPLMGFPADEKVIKESEEKLAEVLDVYEAQLSKNEYLAGDFVSLADLAHLPFTEYLVGPIGKAHLIKDRKHVSAWWDKISSRAAWKEVSAKYSLPV

SEQ ID NO: 7661 - DNA, 708 bp, Oryza sativa
  CDS (1)..(708)
atggccggagcaggagatgagctgaagctgctgggcatgtggacgagcccgttcgctctgcgagtgaagcttgcgctcagcttcaagggcctgagctacgagtacgccgaggaggacctcagcaacaagagcgagctgctgctcagctccaacccggtgcacaagaaggtgcccgtgctcatccacaacggcaagcccatctgcgagtcgcaggtcatcgtgcagtacatcgacgaggcgttccccggcgccggcgtgcccctcctcccctccgacccctacgagcgcgccgtcgctcgcttctgggccgcctacatcgacgacaagctgttgaagtcgtggctgcaggcgtcgatgggcaagacggaggaggagaaggcggaggcgttgaaggagacgttcacagcggtggcgaacctggaggcggccttcgaggagtgctccaaggggaagcccttcttcggcggcgacgccgtcgggtacctggacgtcacgctcggcgccctggtcagctgggtgcacgccggcgaggccctgtacgggatgaggctcttcgatgccaccaggagcccgctcctggacgcgtgggtggaccgcttcgccgcactggatgcggccatggcggtcttgccggacgccggcacattagccgagtacgccaagaagaggcaggcggagcgggcagccgccgcggctgcgaacaactga

SEQ ID NO: 7662 - protein, 235 aa, Oryza sativa
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFTAVANLEAAFEECSKGKPFFGGDAVGYLDVTLGALVSWVHAGEALYGMRLFDATRSPLLDAWVDRFAALDAAMAVLPDAGTLAEYAKKRQAERAAAAAANN

SEQ ID NO: 7663 - DNA, 723 bp, Oryza sativa
  CDS (1)..(723)
atggccggcgccggacgcgacgagctgaagctgctcggcatgtgggccagcccgtatgtcagcagagccaagctcgcgctccaactcaagggcgtgagctacgagtacatcgaggaggatctcggcaacaagagcgacctcttcctccgctccaacccggtgcacaagacggtgccggtgctcatccacaacggcaaccccatctgcgagtcgagcatcatcgtgcagtacatcgacgagtccttcccctcctccgccgcctccctcctccccgccgacccctacgaccgcgccgtcgctcgcttctgggccgcctacatcgacgacaagctagcggcgccgtggagaatggtgtacagggtgaagacggaggaggagagggacgagctcatgaagcagacgctcgcggcggtggacgtgctggagggaggactgaaggagtgctccaaggggaagggatgcttcttcggcggcgacagcgtcggctacgtcgacgtcgtgctgggtggcctcgtgtcgtgggtgcacgccagcgacaagctctccggcgccaagctcttcgacgccgccaaggcgccgctgctggcggcgtggctggggcgcttcggcgagctggatgccgccaaggccgtcctgcaggacgtcgacaaggtggtcgagtacgccaagaagttccagccaagggattccggcacggctgcagatcgacaagcagtaaactag

SEQ ID NO: 7664 - protein, 240 aa, Oryza sativa
MAGAGRDELKLLGMWASPYVSRAKLALQLKGVSYEYIEEDLGNKSDLFLRSNPVHKTVPVLIHNGNPICESSIIVQYIDESFPSSAASLLPADPYDRAVARFWAAYIDDKLAAPWRMVYRVKTEEERDELMKQTLAAVDVLEGGLKECSKGKGCFFGGDSVGYVDVVLGGLVSWVHASDKLSGAKLFDAAKAPLLAAWLGRFGELDAAKAVLQDVDKVVEYAKKFQPRDSGTAADRQAVN

SEQ ID NO: 7665 - DNA, 714 bp, Oryza sativa
  CDS (1)..(714)
atggctgcagaagatgagctgaagctcctgggattttgggcgagcccctacgtttgcagagtgaagctcgcactccacctcaaaggcctgatctacgactatgtcaaggaggatgtcttcaccaacaagagcgagctcctcctcagctgcaacccggtgcacgcgaaggtccccgtgctcatccacaacggcaagcccatctgcgagtcgcaggtcatcgtacaatacatcgacgaggtcttccccgacgccggcgtcaccctcctccccgccgacccccacgatcgcgccgccgctcgcttctgggccgcctacatcgacgacaagctactgcccccgtgggtgcacgcgtacaggggaaagacggacgaggagaaggccgagaggatgaagcagacgcttgcggtggtcgacgcgctggagacggcgatggaggagtgctccaaggggaacgccttcttcggcggcgacaccgtcgggtacgtcgacgtcgcgctggggggcttgctctcctggttgcacgggaccgaggagctgtgtggcgccaagatcttggacgccgccaagaccccgctcctgtcggcgtgggcgcggcgcttcggcgagctggatgcagccaacgcggcgctgccggacgtcggcaggttggtcgagttttgcaagatgaggcatgtcgagctggaggctgcagaggcagcagctgcgcgcaactga

SEQ ID NO: 7666 - protein, 237 aa, Oryza sativa
MAAEDELKLLGFWASPYVCRVKLALHLKGLIYDYVKEDVFTNKSELLLSCNPVHAKVPVLIHNGKPICESQVIVQYIDEVFPDAGVTLLPADPHDRAAARFWAAYIDDKLLPPWVHAYRGKTDEEKAERMKQTLAVVDALETAMEECSKGNAFFGGDTVGYVDVALGGLLSWLHGTEELCGAKILDAAKTPLLSAWARRFGELDAANAALPDVGRLVEFCKMRHVELEAAEAAAARN

SEQ ID NO: 7667 - DNA, 22 bp, Artificial sequence
  primer
atgcttgagcttcatcagtttg

SEQ ID NO: 7668 - DNA, 20 bp, Artificial sequence
  primer
ttactcaatggtgattgtgg

SEQ ID NO: 7669 - protein, 200 aa, Artificial sequence
  consensus sequence
  Variant (2)..(5): Xaa in position 2 to 5 is any amino acid
  Variant (6)..(6): Xaa in position 6 is any or no amino acid
  Variant (8)..(16): Xaa in position 8 to 16 is any amino acid
  Variant (18)..(19): Xaa in position 18 to 19 is any amino acid
  Variant (21)..(46): Xaa in position 21 to 46 is any amino acid
  Variant (47)..(51): Xaa in position 47 to 51 is any or no amino acid
  Variant (55)..(55): Xaa in position 55 is any amino acid
  Variant (57)..(63): Xaa in position 57 to 63 is any amino acid
  Variant (64)..(65): Xaa in position 64 to 65 is any or no amino acid
  Variant (67)..(68): Xaa in position 67 to 68 is any amino acid
  Variant (70)..(91): Xaa in position 70 to 91 is any amino acid
  Variant (92)..(103): Xaa in position 92 to 103 is any or no amino acid
  Variant (105)..(132): Xaa in position 105 to 132 is any amino acid
  Variant (133)..(176): Xaa in position 133 to 176 is any or no amino acid
  Variant (178)..(191): Xaa in position 178 to 191 is any amino acid
  Variant (192)..(192): Xaa in position 192 is any or no amino acid
  Variant (194)..(197): Xaa in position 194 to 197 is any amino acid
  Variant (198)..(198): Xaa in position 198 is any or no amino acid
LXXXXXSXXXXXXXXXLXXKXXXXXXXXXXXXXXXXXXXXXXXXXXXXXXXPVLXDXXXXXXXXXSXXIXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXLXXXXXXXXXXXXXXXGXXXXXAD

SEQ ID NO: 7670 - DNA, 750 bp, SYNECHOCYSTIS SP.
  CDS (1)..(750): transl_table=11
atgctgaattcactaattgctgactttaggattatttttgagcgagatcccgctgcccgcaattggttagaggtgctgttttgttatcctggcttgcaagctttactaatacatagattttctcatcgtctttatactctcgggctacctttctttcctcgcctaatgtcccaccttgcccgctttttcaccggcattgaaatccatccaggggcccagattggccagggcgtgttcattgaccatggcatgggggtagtgatcggtgaaacggcgatcgtgggggactattctttgatttaccaaggggtaactctggggggcacaggaaaagaaagtggcaagcgtcacccgaccctgggggaaaatgtggtggtgggagctggtgctaaggtattgggtaacattgccatcggtgataatgtccgcattggggcggggtcagtggtgttacgggacgtgccagcagattttacggtggtgggggtgccagggcgcatggtgcatccttccggggaaagggttaatcctttggaacatggtaagttaccagattcggagggcaaagtaattcgcctattattagaaagaattgaattactagagcaacaggtggccaccttacaacagcaacaatcggaacaggcctgggaatcggattatcgctcctgctctgaaactgaccgggaaccggtgctctgtcgccttggcgatcgcgaaattgaagaatttttggggggcaccctctaa

SEQ ID NO: 7671 - protein, 249 aa, SYNECHOCYSTIS SP.
MLNSLIADFRIIFERDPAARNWLEVLFCYPGLQALLIHRFSHRLYTLGLPFFPRLMSHLARFFTGIEIHPGAQIGQGVFIDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 7672 - DNA, 1239 bp, Glycine max
  CDS (190)..(1050)
atgcacacacatatcagcataagaacaaatgatcatgaagtgaagtgaagtgaagtgtatataaaatactttggaagtgtcgtgaagagccaataacggttttttgtgtgtttctttctctctcatgttgtagtatctcacttgtgtttttcattcgtttctgaaccacacaaacatcaccaccgaacaatgccgacggggttaccggcggcgaattccttagtggcgccggacgaagaggggtgggtgtgggggcagatcaaggcggaggcgcgccgcgacgccgagtcggagcctgctttggcgagctacctctactcgacgatcctctcgcactcgtcgctcgagcgttctctgtcttttcacctcggaaataagctctgttcctccacgcttctctcgacgctcctttacgacctgttcctcaacgccttctcctccgacccctccctccgctccgccgccgtcgccgatctccgcgctgcccgcgaacgcgaccccgcctgcgtctcctactcccactgcctcctcaattacaaaggcttcctcgcttgccaggcgcaccgtgtggcgcatctgttgtggcggcaatcacggcggccgttggctttagcgctgcactctcgcatcgcagatgtgtttgcggtggacattcacccggcggcaaggattgggaaggggattctgttcgaccatgccactggggtggtggtaggggagacagcggtaatcgggaacaatgtgtcgatcctgcaccatgttactctgggtgggactggcaaggttggtggagaccggcatcctaagattggggatggggtgcttattggtgctggtgctaccattctggggaatattaagattggggaaggtgcaaaggttggtgctggttcagtggttttaattgatgtgccaccacggacaacagcagttgggaacccggcgaggttggttggtgggaaggagaagccctctaagcatgaggatgtgcctggggagtctatggaccatacttcctttatctctgagtggtcagattatatcatttgaatttctaaggttaatcaattaatgaatgaatacttcaaatcaaatgctatgtgttctgctgttctagagttttgtaattttatatttggattgagattttgtagagaccacactctgcttaattatactgtattatgactggaaattttggcagcctgcaatatagtgacatattgtgcaacagattat

SEQ ID NO: 7673 - protein, 286 aa, Glycine max
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIADVFAVDIHPAARIGKGILFDHATGVVVGETAVIGNNVSILHHVTLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 7674 - DNA, 1131 bp, Glycine max
  CDS (37)..(897)
gcacgagctgaaccacacaaacatcaccaccgaacaatgccgacggggttaccggcggcgaattccttagtggcgccggacgaagaggggtgggtgtgggggcagatcaaggcggaggcgcgccgcgacgccgagtcggagcctgctttggcgagctacctctactcgacgatcctctcgcactcgtcgctcgagcgttctctgtcttttcacctcggaaataagctctgttcctccacgcttctctcgacgctcctttacgacctgttcctcaacgccttctcctccgacccctccctccgctccgccgccgtcgccgatctccgcgctgcccgcgaacgcgaccccgcctgcgtctcctactcccactgcctcctcaattacaaaggcttcctcgcttgccaggcgcaccgtgtggcgcatctgttgtggcggcaatcacggcggccattggctttagcgctgcactctcgcatcgcagatgtgtttgcggtggacattcacccgccggcaaggattgggaaggggattttgttcgaccatgccactggggttgttgttagggagacagcgtcaatcgggaacaatgtgtcgatcctgcaccatgttactctgggtgggactggcaaggttggtggagaccggcatcctaagattggggatggggtgcttattggtgctggtgctaccattctggggaatattaagattggggaaggtgcaaaggttggtgctggttcggtggttttaattgatgtgccaccacggacaacagcagttgggaacccggcgaggttggttggtgggaaggagaagccctctaagcatgaggatgtgcctggggagtctatggaccatacttcctttatctctgagtggtcagattatatcatttgaatttctaaggttaatcaattaatgaatgaatacttcaaatcaaatgctatgtgttctgctgttctagagttttgtaattttatatttggattgagattttgtagagaccacactctgcttaattatactgtattatgactggaaattttggcagcctgcaatatagtgacatattgtgcaacagattatataaagctggttttgttggttaaaaaaaaaaaaaaaaaaaaaaaa

SEQ ID NO: 7675 - protein, 286 aa, Glycine max
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIADVFAVDIHPPARIGKGILFDHATGVVVRETASIGNNVSILHHVTLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 7676 - DNA, 1308 bp, Zea mays
  CDS (49)..(981)
ccgcacaccccaccggccggccacataggccccgacggcgactcgaagatgacggccgggcagcttctgcgcaccgagccatcagcccagccccagcgggtgcgccacagcaccccgccggcggcactccaagcagacatcgtgccgtcgtacccgccgcccgagtcggacggtgacgagtcgtgggtctggtcccagatcaaggcggaggcgcggcgcgacgcggacgcggagccggcgctggcctccttcctctacgcgacggtgctgtcgcacgcgtccctggaccggtccctggccttccacctggccaacaagctgtgctcctccacgctgctgtcgacgctcctctacgacctcttcgtggcgtcgctcgcggagcacccgtccgtccgcgcggcggcggtggccgacctgatcgccgcgcggtcgcgggacccggcctgcgcgggcttcgcgcactgcctcctcaactacaaggggttcctggccgtgcaggcgcaccgcgtggcgcacgtgctgtgggcgcagggccggcgcgcgctggcgctggcgctccagtcccgcgtcgccgaggtcttcgccgtggacatccacccggccgccaccgtcggcaggggcatcctgctcgaccacgccacgggcgtcgtcgtcggggagacggccgtcgtgggcgacaacgtctccatactccaccacgtgacgctgggcggcaccggcaaggcggtgggcgaccggcaccccaagatcggggacggcgtgctcatcggcgccggcgcgaccgtcctcggaaacgtcaggatcggcgccggcgccaaggtcggcgccgggtccgtcgtgctcatcgacgtgccgcccaggagcaccgccgtggggaaccccgccaggctgatcggcgggaagaagggcgaggaggtgatgccgggggagtccatggaccacacctccttcatacagcagtggtcggactacatcatttgagcccgcaagctagaaaaaaaaagagctcgtcttgctactgttgttatactgctgttgcgttttctgtgtatgtgcgtggatgtgttagctgtatgctcttgttccagtgaggtgaaccgtggacatgctggtgtggtgtccagaaagatatgctcaaagttcgctctgtaattttcgaagcagatgaactgtgttactactttttactctagtaaaaactgtttctttggctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7677 - protein, 310 aa, Zea mays
MTAGQLLRTEPSAQPQRVRHSTPPAALQADIVPSYPPPESDGDESWVWSQIKAEARRDADAEPALASFLYATVLSHASLDRSLAFHLANKLCSSTLLSTLLYDLFVASLAEHPSVRAAAVADLIAARSRDPACAGFAHCLLNYKGFLAVQAHRVAHVLWAQGRRALALALQSRVAEVFAVDIHPAATVGRGILLDHATGVVVGETAVVGDNVSILHHVTLGGTGKAVGDRHPKIGDGVLIGAGATVLGNVRIGAGAKVGAGSVVLIDVPPRSTAVGNPARLIGGKKGEEVMPGESMDHTSFIQQWSDYII

SEQ ID NO: 7678 - DNA, 1294 bp, Triticum aestivum
  CDS (57)..(1010)
gcccacacacccacccaccagcagcaatccatccatccctcgcagctccggcggcgatgccggcgggccagcagccaccggcgcgcgagcccgacggcggcgactccaaccaccacccccacccgccgccccccacgcccgcgctcccgtccgaggtggtgccggcctacccgccgccggagtcggaggacgacgagtcctgggtgtggacgcagatcaaggcggaggcccggcgcgacgccgacgccgagccggcgctcgcctccttcctctacgccacggtgctctcccacccctccctgccccgctccctctccttccacctcgccaacaagctctgctcctccaccctcctctccacgctcctctacgacctcttcctcgcctccctcaccgcgcacccctccctccgcgccgccgtcgtcgccgacctcctcgccgcgcgcgcccgcgaccccgcctgcgtcggattctcccactgcctcctcaactacaagggcttcctcgccatccaggcgcaccgcgtcgcgcacgtgctctgggcgcagaaccgccgcccgctcgcgctcgccctccagtcccgcgtcgccgacgtcttcgccgtcgacatccaccccgccgccgtcgtcggcaaggccatcctcctcgaccacgccaccggcgtcgtcatcggggagaccgccgtcgtcggtgacaacgtctccatcctccaccacgtcaccctgggtgggactggcaaggcggtcggcgaccgccaccccaagattggggacggcgtgctcataggtgccggcgccacaatcctcggcaacgtcatgattggagccggggccaagattggggctggctccgtggtgctgatagatgtgccggcgcggagcacggcggtggggaaccctgccaggctcatcggagggaggaagggcgagtccgacaaggacgaggacatgcccggagagtccatggatcacacctccttcatacggcagtggtccgactacaccatctgagagagccattgtccaaggtctattactcatcctctgtatcagtaaccgtgttgtgctaccaaatacgtagtgattttgttttggtattgttcgcttgtggatgaacatcaactgtagtctaatgtcaagtgtgtatggccaattgtttcttcagctgagcgaccatgctcggatactgatagtggatgattgatcaatgaataattttgtgatctacaatggatttggttgtattttcaatcatttgctggattaaaaaaaaaaaaaaaaaaaaaaaaaaaaaa

SEQ ID NO: 7679 - protein, 317 aa, Triticum aestivum
MPAGQQPPAREPDGGDSNHHPHPPPPTPALPSEVVPAYPPPESEDDESWVWTQIKAEARRDADAEPALASFLYATVLSHPSLPRSLSFHLANKLCSSTLLSTLLYDLFLASLTAHPSLRAAVVADLLAARARDPACVGFSHCLLNYKGFLAIQAHRVAHVLWAQNRRPLALALQSRVADVFAVDIHPAAVVGKAILLDHATGVVIGETAVVGDNVSILHHVTLGGTGKAVGDRHPKIGDGVLIGAGATILGNVMIGAGAKIGAGSVVLIDVPARSTAVGNPARLIGGRKGESDKDEDMPGESMDHTSFIRQWSDYTI

SEQ ID NO: 7680 - DNA, 816 bp, Mesorhizobium loti MAFF303099
  CDS (1)..(816): transl_table=11
ttgcagccggtcgatccgatctggcgttcgatccgcgacgaagcgatggacgcggtcaaccgcgaccccctgctggccgctttcctctattcgacgatcctcaaccaggagagcctggaagaggccgtcatccaccggatcgccgagcggcttgcccatcaggatatcggctccgatctgatccgccagaccttcaagaccatgctggccgacgacaaggaatggccgaccactgtgcgtgtcgacatccaggcctattacgaccgcgacccggcttgcgaccgtttcatcatgccggtgctctatttcaagggctttcacgccatccagacccacaggctggcgcattggctgtggaatcagggccgcaaggatttcgcgctctatctgcaaagccgctcgtcctcggtcttccagaccgacatcaacccggccgcgcggatcggcaagggcatcttcatcgaccacgccaccggcctcgtcgtcggcgagaccgcggtcatcgaggacgatgtgtcgatcctgcatggcgtgacgctgggcggcaccggcaaggctggcggcgaccgccatcccaagatccgccgtggcgtgctgatcggcgccggcgccaagattctcggcaatatcgagattggccattgctccaaggtcgccgccgggtcggtggtgctgtcgcccgtgccgcacaacaagactgtggccggcgtgccggcccgcgtggtcggtgagaccggctgcgaccagccttcgcgccagatggaccagctcctgccgtcgcagtcgatggaccaggtggtcagcttcgatatctga

SEQ ID NO: 7681 - protein, 271 aa, Mesorhizobium loti MAFF303099
MQPVDPIWRSIRDEAMDAVNRDPLLAAFLYSTILNQESLEEAVIHRIAERLAHQDIGSDLIRQTFKTMLADDKEWPTTVRVDIQAYYDRDPACDRFIMPVLYFKGFHAIQTHRLAHWLWNQGRKDFALYLQSRSSSVFQTDINPAARIGKGIFIDHATGLVVGETAVIEDDVSILHGVTLGGTGKAGGDRHPKIRRGVLIGAGAKILGNIEIGHCSKVAAGSVVLSPVPHNKTVAGVPARVVGETGCDQPSRQMDQLLPSQSMDQVVSFDI

SEQ ID NO: 7682 - DNA, 1176 bp, Arabidopsis thaliana
  CDS (1)..(1176)
atgttgccggtcacaagtcgccgccacttcacaatgtccctatatatgctccgttcatcttctccacacatcaatcatcactctttccttcttccttcttttgtttcctccaaattcaaacaccatactttatctcctcctccttctcctcctcctcctcctcctatggctgcgtgcatcgacacctgccgcactggtaaaccccagatttctcctcgcgattcttctaaacaccacgacgatgaatctggctttcgttacatgaactacttccgttatcctgatcgatcttccttcaatggaacccagaccaaaaccctccatactcgtcctttgcttgaagatctcgatcgcgacgctgaagtcgatgatgtttgggccaaaatccgagaagaggctaaatctgatatcgccaaagaacctattgtttccgcttattatcacgcttcgattgtttctcagcgttcgttggaagctgcgttggcgaatactttatctgttaaactcagcaatttgaatcttccaagcaacacgcttttcgatttgttctctggtgttcttcaaggaaacccagatattgttgaatctgtcaagctagatcttttagctgttaaggagagagatcctgcttgtataagctacgttcattgtttccttcactttaaaggcttcctcgcttgtcaagcgcatcgtattgctcatgagctttggactcaggacagaaaaatcctagctttgttgatccagaacagagtctctgaagccttcgctgttgatttccaccctggagctaaaatcggtaccgggattttgctagaccatgctacggctattgtgatcggtgagacggcggttgtggggaacaatgtttcgattctccataacgttacgcttggaggaacggggaaacagtgtggagataggcacccgaagattggcgatggggttttgattggagctgggacttgtattttggggaatatcacgattggtgaaggagctaagattggtgcggggtcggtggtgttgaaagacgtgccgccgcgtacgacggctgttggaaatccggcgaggttgcttggtggtaaagataatccgaaaacgcatgacaagattcctggtttgactatggaccagacgtcgcatatatccgagtggtcggattatgtaatttga

SEQ ID NO: 7683 - protein, 391 aa, Arabidopsis thaliana
MLPVTSRRHFTMSLYMLRSSSPHINHHSFLLPSFVSSKFKHHTLSPPPSPPPPPPMAACIDTCRTGKPQISPRDSSKHHDDESGFRYMNYFRYPDRSSFNGTQTKTLHTRPLLEDLDRDAEVDDVWAKIREEAKSDIAKEPIVSAYYHASIVSQRSLEAALANTLSVKLSNLNLPSNTLFDLFSGVLQGNPDIVESVKLDLLAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKTHDKIPGLTMDQTSHISEWSDYVI

SEQ ID NO: 7684 - DNA, 690 bp, Mycobacterium tuberculosis H37Rv
  CDS (1)..(690): transl_table=11
atgctgacggccatgcggggcgacatccgagcagcccgggagcgggatccggcggcccctaccgcgctggaagtcatcttctgctacccgggcgtgcacgccgtgtggggccaccgcctcgcccactggctgtggcagcgtggcgccaggctgctcgcgcgggcagctgccgaattcactcgcatcctgaccggtgtagatatccaccccggtgccgtcatcggtgctcgcgtgttcatcgaccacgcgaccggcgtggtgatcggagaaaccgcggaggtcggcgacgacgtcacgatctatcacggcgtcactctcggcggcagtggcatggttggcgggaaacgccatcccaccgtcggtgaccgcgtgatcatcggcgccggggccaaggtcctcggtccgatcaagatcggcgaggacagccggatcggcgccaatgccgtcgtggtcaagcccgtcccgccgagcgcggtggtggtcggggtgcccgggcaggtcatcggccaaagccagcccagtcccggcggcccgtttgattggaggctgcccgatctcgtgggagccagcctcgattcgctgctcaccagggtggccaggctggaggccctcggcggcggcccgcaagcagcaggagtcatccggccacccgaagccgggatatggcacggcgaggacttctcgatctga

SEQ ID NO: 7685 - protein, 229 aa, Mycobacterium tuberculosis H37Rv
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLEALGGGPQAAGVIRPPEAGIWHGEDFSI

SEQ ID NO: 7686 - DNA, 663 bp, Thermotoga maritima MSB8
  CDS (1)..(663): transl_table=11
atgcggctgttgttcagaaaggctggtgagtttttcagggatttcgtgagtattttcaagcacatatcagatgatcttgagatgtacctcaagctcgatcccgccgcagagagtaagcttcaggtgtttttcttctacgcttccttccagggtctcatgtggtacagattcgcccatttcttctacaagtggaaactgaaagttctcgcctacctcatttattactttgtgcgtgttgtgttctccatggacatccatccagcggcaaggatcgctccgggagtggtgatagaccacggtatcggtgtggtcatcggaagcactgcctcggtgggaagaggaacactcatctaccacggagtcactcttggaacgagaaagccgtgctccggaaaaaggcaccccgacgtgggtgagaacgtgatgattggaacgggagcgaagatcctcggcccgataagggtgggaaacaacgccgttgtgggtgcgaacgcggtcgtccttgaggatgttccagacggagccgttgtcgtaggtgttcctgcgagaatagtcaagtggaggagggatttctgcgatgatggaaagactgatagggagcactcctatagtgagactcgattcgatagactcgagaatcttcttgaaactggaaaagaataa

SEQ ID NO: 7687 - protein, 220 aa, Thermotoga maritima MSB8
MRLLFRKAGEFFRDFVSIFKHISDDLEMYLKLDPAAESKLQVFFFYASFQGLMWYRFAHFFYKWKLKVLAYLIYYFVRVVFSMDIHPAARIAPGVVIDHGIGVVIGSTASVGRGTLIYHGVTLGTRKPCSGKRHPDVGENVMIGTGAKILGPIRVGNNAVVGANAVVLEDVPDGAVVVGVPARIVKWRRDFCDDGKTDREHSYSETRFDRLENLLETGKE

SEQ ID NO: 7688 - DNA, 690 bp, Bacillus halodurans C-125
  CDS (1)..(690): transl_table=11
atgaaaagaatcttcaaaacgcttttaaatgatattgatgtcgtgtttgagcaagaccctgcggcccggagccggcttgaggtgatcttcacgtattctggagttcatgccatttgggctcatcggttggcccattggctttggaggaaaaagctatactttgtggcccgctttctctcacaggtgagtcgcctcataacaggaattgaaattcatccgggggcaaagattggtcaacggttattcattgaccacggaatgggtgttgttattggtgaaacctgtgagattggcgacaatgtgacgatctatcaaggggtcaccttaggagggacgggaaaagagaaaggaaagcgtcatccaacggtagaggatcatgtattaattgcttcaggtgcaaaggttctcggttcctttacgatcgggaaaaattcacgaattggggctggctctgtcgttctcaatgaagttccgcctaactctaccgtcgtcggaataccaggcaaggtagttattcgagacggcatcaaggtcaatcgagatttggaccatcacctccttcccgaccctgtgtccgataaatttcgtgagctagagaagcaattggaagcattacaaaaggaaattgaggagttgcgaaaaaacaacttgccgaaaagcgcaagtaatcatagcgtgaaagaaggataa

SEQ ID NO: 7689 - protein, 229 aa, Bacillus halodurans C-125
MKRIFKTLLNDIDVVFEQDPAARSRLEVIFTYSGVHAIWAHRLAHWLWRKKLYFVARFLSQVSRLITGIEIHPGAKIGQRLFIDHGMGVVIGETCEIGDNVTIYQGVTLGGTGKEKGKRHPTVEDHVLIASGAKVLGSFTIGKNSRIGAGSVVLNEVPPNSTVVGIPGKVVIRDGIKVNRDLDHHLLPDPVSDKFRELEKQLEALQKEIEELRKNNLPKSASNHSVKEG

SEQ ID NO: 7690 - DNA, 795 bp, Pasteurella multocida subsp. multocida str. Pm70
  CDS (1)..(795): transl_table=11
atgccattagcggtttggactgacatccgtcaggaagcaaaaaccttagcagaaaatgagccaattttggccagtttttttcacgcaacgattttgaaacatcataatcttggtaatgcattaagctatattttagccaacaaattggcaaatacgattatgcccgccattgctttgcgagaaattattgaggaagcttatcaggcggatcctgacatcattgccagtgctgcctgtgatattcgtgcggtgcgtcaacgcgatcccgcggtggaattatattctacgccactgttatatttaaaaggttttcatgccttgcaaagttatcggattacccattatttatggcaacaagagcggaaagccttagctgtttatttacaaaaccaaatctcggtcgcctttgatgtggatatccatcctgcggctaaaattggttgtggcattatgtttgaccatgcgacaggcatcgtggtgggagaaacctcggtgattgaaaatgatgtgtcgattttacaaggcgtcaccttgggggggacgggtaaagagtgtggcgatcgtcatcctaaagtacgcgaaggtgtaatgattggtgctggggcgaaaatcttgggtaacattgaagtgggacgttatgccaaaattggggcaaactcggttgttttacaacctgtccctgaatataccaccgcagcgggggtaccggcacgtgtgattgctcgcgatcaagcggcgaaacccgcttttgatatgaaccaatattttaatgacgatcatgcctctaaggtgtaa

SEQ ID NO: 7691 - protein, 264 aa, Pasteurella multocida subsp. multocida str. Pm70
MPLAVWTDIRQEAKTLAENEPILASFFHATILKHHNLGNALSYILANKLANTIMPAIALREIIEEAYQADPDIIASAACDIRAVRQRDPAVELYSTPLLYLKGFHALQSYRITHYLWQQERKALAVYLQNQISVAFDVDIHPAAKIGCGIMFDHATGIVVGETSVIENDVSILQGVTLGGTGKECGDRHPKVREGVMIGAGAKILGNIEVGRYAKIGANSVVLQPVPEYTTAAGVPARVIARDQAAKPAFDMNQYFNDDHASKV

SEQ ID NO: 7692 - DNA, 777 bp, Pseudomonas aeruginosa PAO1
  CDS (1)..(777): transl_table=11
atgttcgaacgtgtgcgtgaagatatccaaagcgtattccaccgtgatccggcggctcgcaacgcactcgaggtcctcacctgttatccgggcctgcacgccgtctggctgcatcggctggcccacggcttgtggacgtccggctggaagtggctggcgcgcctggtgtccaatttcggccgctggatgaccggcatcgagatccacccgggggccaggatcggccggcgcttcttcatcgaccacggcatgggcatcgtcatcggcgaaaccgccgagatcggcgacgacgtcaccctctatcagggtgttaccctgggcggcaccacctggaacaagggcaagcgccaccccaccctcggcaacaacgtagtggtcggtgccggtgccaaggtgctcggcccgttcaccgtcggcgagggcgccaaggtcggctccaacgccgtggtgaccaaggaagtcccgccgggtgccaccgtggtcggcattcccgggcggatcatcatgcgcgaggactccgagcagcaggccaagcgccaggcgatggcggagaagctcggcttcgatgcctatggggtcagccaggacatgccggacccggtggcgcgtgccattggtcagttgctcgatcacctgcaggccgtcgacggccggctcgagggcatgtgccaggcgctcaccgccctgggtagcgactactgcgcgaaggacctgccggtattgcgcgaggaagatttcgccggagtcaaggatgaggacggcaatccggccgcgtaa

SEQ ID NO: 7693 - protein, 258 aa, Pseudomonas aeruginosa PAO1
MFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDSEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 7694 - DNA, 600 bp, Lactococcus lactis subsp. lactis Il1403
  CDS (1)..(600): transl_table=11
atgaacgaaaaaaagaaaggtttttggtctgaagcaattcgagtgaccaaagaaaatgatccggcagctagaactgccctggaagtctttttgacctatccaggagtaaaagctcttgcagctcaccgaatttcacattttctttggcgtcatcatttgaaacttttggctcggatgcactcacaattttggcgattttggactcaaattgaaattcatccaggagcagaaattgcccatggagtctttattgaccatggttctggattagttattggtgaaactgccattgttgaaaaggacgtcaagctttatcatggagttaccttgggggggacaggaaaagataaagggaaacgtcatccaacaattagacaaggggcattaatttctgcccattctcaacttttaggtcctattgaagttggagaaaatgcaaaagtaggggcgagtgctgttgtggtaacagatgttccgccagaagtaactgttgttggaatacctgcaaaagttgttcgagttaaaggtaaaaaagatgtcgagcgcatcacaagccttgaagaaaaaagagaagcaagctatcattcatcacatttgtga

SEQ ID NO: 7695 - protein, 199 aa, Lactococcus lactis subsp. lactis Il1403
MNEKKKGFWSEAIRVTKENDPAARTALEVFLTYPGVKALAAHRISHFLWRHHLKLLARMHSQFWRFWTQIEIHPGAEIAHGVFIDHGSGLVIGETAIVEKDVKLYHGVTLGGTGKDKGKRHPTIRQGALISAHSQLLGPIEVGENAKVGASAVVVTDVPPEVTVVGIPAKVVRVKGKKDVERITSLEEKREASYHSSHL

SEQ ID NO: 7696 - DNA, 516 bp, Halobacterium sp. NRC-1
  CDS (1)..(516): transl_table=11
atgtacgcacgcatccgtgaggacgtccgtgcgatgcggcgacgcgaccccgcagccgggagtcgcctcgacgtcgcgctcacgtatcccggcctgcacgccgtctgggcgcacgtcttcctcgccggcccgctgtacgaccggtggccgaccgccggccgcctggtcgcgtactgggtgcggctgctcactggcatcgagatccatcccgacgccgacatcggccgccgggtcaccatcgatcacggccacggcgtcgtcatcggcgaaacggcagtcgtcggcgacgacgtgcacatgtaccacggcgtcacgctggggggcaacgactcccggccggtcgaccgacaccccacggtgcgcgccggcgtgacgctgggcgcgaacgcgacgctgctcggtgacatcgaaatcggcgcgaacgccagcgtcggcgcggcgtcggtcgtcaccgacgacgtggcggccggcgcaacggtgaccggcgtgcccgcacagcgggtcgacgacgcgtag

SEQ ID NO: 7697 - protein, 171 aa, Halobacterium sp. NRC-1
MYARIREDVRAMRRRDPAAGSRLDVALTYPGLHAVWAHVFLAGPLYDRWPTAGRLVAYWVRLLTGIEIHPDADIGRRVTIDHGHGVVIGETAVVGDDVHMYHGVTLGGNDSRPVDRHPTVRAGVTLGANATLLGDIEIGANASVGAASVVTDDVAAGATVTGVPAQRVDDA

SEQ ID NO: 7698 - DNA, 639 bp, Campylobacter jejuni subsp. jejuni NCTC 11168
  CDS (1)..(639): transl_table=11
atgaatttttggggtattataaaagaagatttttctcagccaaaggcacaagatccagcttttaattcttgtatagaacttttttttaattaccctggagtatgggctgtagtaaattaccgctttgcacattttttttacataagaaattttaaacgcattgctagaatgattagcggaatttcacaattcttaactggggtagatttgcaccctggagcagaacttggaaggcgtatttttatagatcatgccaatggagtggttataggtcaaacagcaattatagaagatgatgttttaatttatcaaggcgttactttaggtggaacaagccttgaaaaaggtactaaacgccatccaaccataaaaaaaggagtgatcataggctcaggcgcaaaagtgcttggcaatatcaccataggagaaaatgccaaaataggctcaaatgctgtagtggttaaagatataggtgcaaatttaactgccgttggaattcctgcttatattatcgaagagcgtaaaaataaaaacattagagccatagatgcaaattgcgatgacaaactagaaaagttagaaaagaaaattttagaacttgaaaatcttatattaaaacaacctgaatcacaaaaataa

SEQ ID NO: 7699 - protein, 212 aa, Campylobacter jejuni subsp. jejuni NCTC 11168
MNFWGIIKEDFSQPKAQDPAFNSCIELFFNYPGVWAVVNYRFAHFFYIRNFKRIARMISGISQFLTGVDLHPGAELGRRIFIDHANGVVIGQTAIIEDDVLIYQGVTLGGTSLEKGTKRHPTIKKGVIIGSGAKVLGNITIGENAKIGSNAVVVKDIGANLTAVGIPAYIIEERKNKNIRAIDANCDDKLEKLEKKILELENLILKQPESQK

SEQ ID NO: 7700 - DNA, 684 bp, Mycobacterium leprae TN
  CDS (1)..(684): transl_table=11
atgtttgcggcaatccggcgtgatatccaggcagcaagacagcgagatccggcacagcccacggtgctggaggtcatctgctgctacccaggcgtgcacgccgtctggggtcatcgaatcagtcactggttgtggaatcgtcgcgccagactggccgcgcgggcgttcgccgaactcacccgcatcctgactggggtcgacatccaccccggtgccgtgctcggagccggcctgttcatcgatcacgcgaccggcgtggtgatcggggaaaccgcggaagtgggcgatgacgtcaccatcttccatggagtcactctcggcggcaccggccgggaaacgggtaaacgtcacccaaccatcggggatcgagtaaccatcggcgccggcgccaaggtcctcggtgccatcaagatcggcgaggacagccggattggcgccaacgcagtcgtggtcaaggaggtcccagccagcgctgtggccgtcggggttcccggacaaatcatcagcagcgacagcccggccaacggggacgattctgtgctgcccgacttcgtgggcgtcagcctgcaatccctgctcaccagggtggccaagctggaagccgaagacggcggttcgcaaacctaccgcgtcatccggctacccgaagccggggtttggcacggcgaggacttctcaatctga

SEQ ID NO: 7701 - protein, 227 aa, Mycobacterium leprae TN
MFAAIRRDIQAARQRDPAQPTVLEVICCYPGVHAVWGHRISHWLWNRRARLAARAFAELTRILTGVDIHPGAVLGAGLFIDHATGVVIGETAEVGDDVTIFHGVTLGGTGRETGKRHPTIGDRVTIGAGAKVLGAIKIGEDSRIGANAVVVKEVPASAVAVGVPGQIISSDSPANGDDSVLPDFVGVSLQSLLTRVAKLEAEDGGSQTYRVIRLPEAGVWHGEDFSI

SEQ ID NO: 7702 - DNA, 690 bp, Mycobacterium tuberculosis CDC1551
  CDS (1)..(690): transl_table=11
atgctgacggccatgcggggcgacatccgagcagcccgggagcgggatccggcggcccctaccgcgctggaagtcatcttctgctacccgggcgtgcacgccgtgtggggccaccgcctcgcccactggctgtggcagcgtggcgccaggctgctcgcgcgggcagctgccgaattcactcgcatcctgaccggtgtagatatccaccccggtgccgtcatcggtgctcgcgtgttcatcgaccacgcgaccggcgtggtgatcggagaaaccgcggaggtcggcgacgacgtcacgatctatcacggcgtcactctcggcggcagtggcatggttggcgggaaacgccatcccaccgtcggtgaccgcgtgatcatcggcgccggggccaaggtcctcggtccgatcaagatcggcgaggacagccggatcggcgccaatgccgtcgtggtcaagcccgtcccgccgagcgcggtggtggtcggggtgcccgggcaggtcatcggccaaagccagcccagtcccggcggcccgtttgattggaggctgcccgatctcgtgggagccagcctcgattcgctgctcaccagggtggccaggctggacgccctcggcggcggcccgcaagcagcaggagtcatccggccacccgaagccgggatatggcacggcgaggacttctcgatctga

SEQ ID NO: 7703 - protein, 229 aa, Mycobacterium tuberculosis CDC1551
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLDALGGGPQAAGVIRPPEAGIWHGEDFSI

SEQ ID NO: 7704 - DNA, 561 bp, Clostridium acetobutylicum ATCC 824
  CDS (1)..(561): transl_table=11
atgtttaagtcaataaggtatgatataaatagagttttgcagaatgatcctgctgcgaggaacggacttgaagtttttttgttgtatccatgtatacatgcacttatttggtatagaatagcccacgttttttataaacataagatgttttttattgcaagactattatcacaaattgtaagagcttttacaggaatagagattcatccaggagcgactataggaaaaggactttttattgatcatggtatgggagttgtaataggagaaacagctgaaataggtgataatgttgttatgtatcatggttctaccttagggggaactggaaaggaaactggcaagagacatccaactgttggaaataatgtgtttataggttcaggtgcaaaggtgttaggaccaataaaacttggtgatggatgtaagataggtgctaatgctgttgttcttaaagatgtaccttccaatagtacagctgtaggtattccagcaaaagtaattttgcccagtagtaaaaaagaaaaagtaattgattttaatgattattgcaataaataa

SEQ ID NO: 7705 - protein, 186 aa, Clostridium acetobutylicum ATCC 824
MFKSIRYDINRVLQNDPAARNGLEVFLLYPCIHALIWYRIAHVFYKHKMFFIARLLSQIVRAFTGIEIHPGATIGKGLFIDHGMGVVIGETAEIGDNVVMYHGSTLGGTGKETGKRHPTVGNNVFIGSGAKVLGPIKLGDGCKIGANAVVLKDVPSNSTAVGIPAKVILPSSKKEKVIDFNDYCNK

SEQ ID NO: 7706 - DNA, 828 bp, Sinorhizobium meliloti 1021
  CDS (1)..(828): transl_table=11
atggtcgccaagacagaacttcgtcatacggaatcgctcgaagcgatcgatccgatctgggatagcctgcgcgaggaggcgcgtctggcggccgagcgcgacccgatgctggcggcctttctctattcgacggtggtcaatcagcattccctggaagattgcgtcatctaccggatctgcgagaggctggaccatcccgacctacaggcgagcctcctgcaccagaccttcgccgaaatgctcgaggactggcccgaatggggcgccgtcctgcgcgtcgatatacaggcggtctacgaccgcgacccggcctgcacgcgcttcatggagcccgtgctttatttcaagggcttccatgccatacagacgcaccgtctggctcactggctgtggaaccgcggccggaaagactttgcgctctatctccagagccgctcctccagtgttttccaaaccgacatcaacccggccgcccgcatcgggcgcggcatcttcctcgatcatgcaacggggctcgtcgtcggcgaaaccgcggtcatcggcgacaacgtatctatcttgcatggcgtgacgcttggcggcaccggcaaggaaggcagcgaccgtcatccgaagatcggcaacggcgtgctgatcggcgccggcgcaaagattctcggcaacatccacatcggccactgctcgcgcgtggccgccggttccgtcgtgctgaaggcggtccctcccaaatcgacggttgccggggtgccggcgaaggtcgtcggcgaggccggctgttccgagccgtcgcgtcaaatggaccagatcctggcgtcgttcgatatctga

SEQ ID NO: 7707 - protein, 275 aa, Sinorhizobium meliloti 1021
MVAKTELRHTESLEAIDPIWDSLREEARLAAERDPMLAAFLYSTVVNQHSLEDCVIYRICERLDHPDLQASLLHQTFAEMLEDWPEWGAVLRVDIQAVYDRDPACTRFMEPVLYFKGFHAIQTHRLAHWLWNRGRKDFALYLQSRSSSVFQTDINPAARIGRGIFLDHATGLVVGETAVIGDNVSILHGVTLGGTGKEGSDRHPKIGNGVLIGAGAKILGNIHIGHCSRVAAGSVVLKAVPPKSTVAGVPAKVVGEAGCSEPSRQMDQILASFDI

SEQ ID NO: 7708 - DNA, 822 bp, Salmonella enterica subsp. enterica serovar Typhi str. CT18
  CDS (1)..(822): transl_table=11
atgccgtgtgaagaactggaaatcgtctggaagaatattaaagctgaagcccgcgctttagctgactgtgagcctatgttggccagtttttatcacgccacgctactcaagcatgaaaatctgggcagtgcgctgagctatatgctggcaaataaactggcttcgcccatcatgcccgctatcgctatccgtgaagtagttgaagaagcctatgccgccgacccggaaatgatcgcgtcggcagcctgcgatattcaggccgtgcgcactcgcgatccggcggtggataaatactccacgccgctgttatatctgaaaggctttcatgcgctacaggcctaccgcattggtcactggttgtggaataaaggtcgccgcgcgctggctatcttcctgcaaaatcaggtttcggtctcgtttcaggtggatattcacccggcagcgaaaattggccgcgggattatgctcgaccatgccaccggtattgtggtgggggagacggcggttattgaggatgatgtgtcgatcctgcaatccgtcaccctgggcggtaccgggaaaacgagcggcgatcgccatcctaaaatccgcgaaggcgtgatgattggcgcgggcgcgaaaattctcggcaatatcgaggtggggcgcggcgcgaaaattggcgcaggctccgtcgttttacagcctgtcccgccgcacactaccgccgcaggcgttccggcgcgtattgtcggcaagccgggcagcgataagccgtcgatggatatggaccagcatttcaacgggctacaccatacgtttgagtatggcgacggcatctga

SEQ ID NO: 7709 - protein, 273 aa, Salmonella enterica subsp. enterica serovar Typhi str. CT18
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGLHHTFEYGDGI

SEQ ID NO: 7710 - DNA, 615 bp, Listeria innocua Clip11262
  CDS (1)..(615): transl_table=11
atgccaactcgcttaaaagaagatattgcaacaattataaagaatgaccctgcgacgaagactttttttgatgcttttttaacgaatccgggattgcacgcactttggtggcatcgtgtggccaactttttttatcgtcacaaaatggttttgtttggaaaagtattatcgcagactgctcgtttctggactaatatagaaattcatcccggcgcaacaattggtagaaggctttttatagatcacggtgcagggattgttattggagaaactgctgaaattggtgatgatgttacgatatttcacggagttacgcttggcgggaccgggaaggactgcgggaaacgtcatccaacggtcggtgatagagcgcttgtttcagcgggagccaaagtacttggaccagttgatattggagcagatgcgcgaattggtgcgggtgcggttgttttaaaagacgtaccaccaggtgcaactgttgtcggtattccagccaaagttgttcggcttaatgggcgtacggtagggcacgcggttcctaaaatggatgaactgacgttacgaattgcagaattagaaaatatagtagaaaaacttttaaaggaaaaggagtag

SEQ ID NO: 7711 - protein, 204 aa, Listeria innocua Clip11262
MPTRLKEDIATIIKNDPATKTFFDAFLTNPGLHALWWHRVANFFYRHKMVLFGKVLSQTARFWTNIEIHPGATIGRRLFIDHGAGIVIGETAEIGDDVTIFHGVTLGGTGKDCGKRHPTVGDRALVSAGAKVLGPVDIGADARIGAGAVVLKDVPPGATVVGIPAKVVRLNGRTVGHAVPKMDELTLRIAELENIVEKLLKEKE

SEQ ID NO: 7712 - DNA, 753 bp, Nostoc sp. PCC 7120
  CDS (1)..(753): transl_table=11
atgcaacagtccttagacggtatcgagaatccacctgattcgacacatacatccttggtgaaaaatctactctctggcatttttctagagccattgttgagtgattttcagattatttttgaacgcgacccggcggcgcgtaattggttggaggtaatattctgttaccccggactgcacgcgatttgtttgcaccgttttgctcattggttacaccgccgtggggtggttttcttcccacgtttaatttctcacttggctaggtttctcacaggaattgagattcacccaggtgcagtgattggtaaaggtgtgtttatcgaccacgggatgggcgttgtcattggtgaaacggcgattgtgggagattatgccctaatttatcaaggggtgactctgggcggtactgggaaggaaagtggtaagcgtcatcccaccgtcgggaatcatgtggttgtgggttcgggggcgaaggttttggggaatattcaaattggcgatcgcgcgcggattggcgcaggttcggttgtgttgcgtgatgttccccatgattgcacagttgtgggcattcctgggcggattatcacccacaagcctaagactgatctctctcctctggaacacggaaagttacctgatgtggaagcagatgtgattcgttctttgctgacacgcatcgaacaactggaacaaaaactgcaaaccctgacaaatcaggcaaaggaaccagaactgttgacgaaagataagtaa

SEQ ID NO: 7713 - protein, 250 aa, Nostoc sp. PCC 7120
MQQSLDGIENPPDSTHTSLVKNLLSGIFLEPLLSDFQIIFERDPAARNWLEVIFCYPGLHAICLHRFAHWLHRRGVVFFPRLISHLARFLTGIEIHPGAVIGKGVFIDHGMGVVIGETAIVGDYALIYQGVTLGGTGKESGKRHPTVGNHVVVGSGAKVLGNIQIGDRARIGAGSVVLRDVPHDCTVVGIPGRIITHKPKTDLSPLEHGKLPDVEADVIRSLLTRIEQLEQKLQTLTNQAKEPELLTKDK

SEQ ID NO: 7714 - DNA, 762 bp, Nostoc sp. PCC 7120
  CDS (1)..(762): transl_table=11
atgctctctatactgcgtgctgacttccgtatcatctttgaacgtgacccggctgctcgtaatttgctggaagtcttgttttgttaccctggtttgcaagccttattattccatcgggtagctaactggctgtatcgccttggattaccgtttattccccgcttaatttctcacatagcccggtttttgacgggcattgaaattcaccctggtgccacaattggacaaggtgtatttatcgaccacggtatgggtgtggttattggtgaaactgcgatcgtgggagactatgctttgatttatcaaggtgtcacccttgggggaacgggtaaagaaagcggtaaacgccaccctactttaggcgaaaatgttgttgttggtgctggtgctaaggtactgggcaatcttcaaatcgggaataacgtccgcattggtgctggttctgttgtccttagggatgtacccgccaattgtactgttgtaggtattcctgggcgcattgtttatcgttctggtggacgagttgaccccctagaacataacaatttaccagactcggaagctcaagcaattcgcgctttggttgaccgcattgaatcgctagaacaacaaatacaagccttacaaaataatcaatctgctgctaaaattcctgctttggttgctgcaagttcacaggaagcagagagatcccacgattcccagtggtgcaacctcagagataaggcaattcaagagttcttagatggtgctggcatttaa

SEQ ID NO: 7715 - protein, 253 aa, Nostoc sp. PCC 7120
MLSILRADFRIIFERDPAARNLLEVLFCYPGLQALLFHRVANWLYRLGLPFIPRLISHIARFLTGIEIHPGATIGQGVFIDHGMGVVIGETAIVGDYALIYQGVTLGGTGKESGKRHPTLGENVVVGAGAKVLGNLQIGNNVRIGAGSVVLRDVPANCTVVGIPGRIVYRSGGRVDPLEHNNLPDSEAQAIRALVDRIESLEQQIQALQNNQSAAKIPALVAASSQEAERSHDSQWCNLRDKAIQEFLDGAGI

SEQ ID NO: 7716 - DNA, 807 bp, Ralstonia solanacearum GMI1000
  CDS (1)..(807): transl_table=11
atgccttacactgcccccaagcgcatcgcgctgatcgatattccgttttttcacagacccatgttcacacgcattcgcgaagacatccgcgccatcatggagcgagacccggccgcgcgcagccgctgggaagtgctgacctgctatccgggcctgcacgccatcatcgtccatcgggccgcgcatgcgtgttggggcgcgggcttcaggtggctgggccgatggctgtcgcacctgggccgtttcctgaccggcatcgaaatccaccccggcgcgcaggtcggccggcgcgtgttcattgatcacggcatgggcgtcgtgatcggcgagaccgccgagatcggcgacgattgcacgatctaccagggcgtgacgctgggcggcacctcgctctacaagggcgccaagcggcatccgacgctgggcaagggcgtcgtggtcagcgcgggcgccaaggtgctcggcgggttcgtgatcggcgacggcgcgcgggtcggctccaacgcggtggtgctcaagccggtgccggccggcgccacggcggtcggcattcccgcccgcatcctcgagcgcgacgtgccgggcgcggtccagcccgcactcaagcaggagttctcggcctacggcatcacgccggacgcggacgatccggtttcgctcgcgctcaagcggctgatcgaccatagcgcgctccagcaggagcgcatcgagtccatcctgagcgcgctggaccgcctgggcgcgcatctcgagaactcgccgaacgatccgttcgatgccagcgagctcaagcggatgctgaagtga

SEQ ID NO: 7717 - protein, 268 aa, Ralstonia solanacearum GMI1000
MPYTAPKRIALIDIPFFHRPMFTRIREDIRAIMERDPAARSRWEVLTCYPGLHAIIVHRAAHACWGAGFRWLGRWLSHLGRFLTGIEIHPGAQVGRRVFIDHGMGVVIGETAEIGDDCTIYQGVTLGGTSLYKGAKRHPTLGKGVVVSAGAKVLGGFVIGDGARVGSNAVVLKPVPAGATAVGIPARILERDVPGAVQPALKQEFSAYGITPDADDPVSLALKRLIDHSALQQERIESILSALDRLGAHLENSPNDPFDASELKRMLK

SEQ ID NO: 7718 - DNA, 846 bp, Agrobacterium tumefaciens str. C58
  CDS (1)..(846): transl_table=11
atgcaaacgaggagaccattcatggtcgcacgtactgaggcccgtcagcctgaacagctggcgatcgttgatccgatctggggcagcctgctgaatgaggcccgaagcgctgcggcgcaggacccgctgctgtcagcctttctctattcgacgatcctcaatcaccgctctctcgaagaatgtgtgatctaccgtatctgcgagctccttgatcatcccgacatgcaggcagttcttctgcgccagaccttccaggacatgctggaggactggccggaatggggaagtgtgctgcgcgtcgatatccaggccgtttacgaccgcgaccccgcctgcacgcgcttcatggagccgctgctttatttcaaggggttccaagctatccagacgcatcgccttgcccactggctgctgcagaagggccgcaaggatttggcgctttatctgcaaagccgctcgtcgagcattttccagacggatatcaatccggccgcgcgcatcggcaagggcatcttcctcgaccatgccaccggactggtggttggtgagaccgccgttatcggcgacaacgtttcgatcctgcatggcgtgacgcttggcggcaccggcaaggagggggcagaccgccatccgaagatcgccaatggggtgatgatcggggcaggcgcaaagattctcggcaatatcgagattggcagctgctcgcgtattgccgccggatcggtggtgctgaaacccgttccgccgaagaccacggttgccggcgtgccggcgcgggtggtgggagaagcagggtgttcggaaccctcgcgtctgatggaccagctcatcggggccgatatctga

SEQ ID NO: 7719 - protein, 281 aa, Agrobacterium tumefaciens str. C58
MQTRRPFMVARTEARQPEQLAIVDPIWGSLLNEARSAAAQDPLLSAFLYSTILNHRSLEECVIYRICELLDHPDMQAVLLRQTFQDMLEDWPEWGSVLRVDIQAVYDRDPACTRFMEPLLYFKGFQAIQTHRLAHWLLQKGRKDLALYLQSRSSSIFQTDINPAARIGKGIFLDHATGLVVGETAVIGDNVSILHGVTLGGTGKEGADRHPKIANGVMIGAGAKILGNIEIGSCSRIAAGSVVLKPVPPKTTVAGVPARVVGEAGCSEPSRLMDQLIGADI

SEQ ID NO: 7720 - DNA, 510 bp, Clostridium perfringens str. 13
  CDS (1)..(510): transl_table=11
ttgttcaaaaatttaaaatatgatatagaaaatgttatgaaaaatgatccagcggctagaacaaaactagaggttttattgctttaccaaagcatacatgttttgatattttatagaatagcacatggactatataagataaaattattttttctagcacgattaatttctcagttaggaagattttttacaggtatagaaattcatccaggggcaaaaataggaaaaggactttttatagatcatggaatgggtgttgtaataggagaaactgcagaaataggagataatgtaactatatatcatggagttactcttggaggaactggaaaggacaagggtaagagacatccaactataggtaataatgttattattggatgcggggctaaaattttaggacctataagtataggcgatggagcaaaaataggagcaaattctgtagtattaaagaatgttccaaagggaaaaaccgctgttggaattccagcagttattaaaaattaa

SEQ ID NO: 7721 - protein, 169 aa, Clostridium perfringens str. 13
MFKNLKYDIENVMKNDPAARTKLEVLLLYQSIHVLIFYRIAHGLYKIKLFFLARLISQLGRFFTGIEIHPGAKIGKGLFIDHGMGVVIGETAEIGDNVTIYHGVTLGGTGKDKGKRHPTIGNNVIIGCGAKILGPISIGDGAKIGANSVVLKNVPKGKTAVGIPAVIKN

SEQ ID NO: 7722 - DNA, 963 bp, Methanosarcina acetivorans C2A
  CDS (1)..(963): transl_table=11
atgggaatcagggaagatataaaaacagttttcgaaaaagacccagctgcaaggtcaacactcgaggtgctctgctgctatccggggctgcatgctatctggatgcaccgagtagcccactcgctctggaacaaagacctcttgtttctcgcccgtttgacatctcatatctcaagggcgctcacgggcattgaaatccatccgggagcaaagctggggaagcgggtatttattgaccacggatcaggagtggtaataggagaaactgccgaagtaggggatgacgtcctcatatacatgggagtcgtgctcggagggactgcccttgagaagaaaaagcgacaccccactgttgaaaataatgcggttctcggctcaggtgcaatcgtactcggaccgattacgataggaagaggggcaaaagtaggtgccggttcggttgtggttcgctcagttccacccgaagccaccgtagtcggcgtccctgccaggattgcaggaacgccacagccgtccgcaccctcagagcagctggaccacaataaactgcctgaccccgtgcttaccgtaataagtcaggtgcttgaccgcatgagcaggttggaggaacggtttcaggctcatgaaaaagcatccaccactcccgtgccggtatcctttgtaagctcagaaaacccctccgtcaaaaaagatgagcagatttattccttgctaaaagacgtgatcgatcctgcagttggaatagatatcgtcaacctgggttttgtcaaggaagtcactgtgaacgggacaaatgtagatgtaaaccttgtattgacaacgagtgcctgtcccatgatcgaatattttagaaatcaggtaaagagaaaggtcatgggcattaaagggatagaaaacgttactgtcaatatccttgacgagccctggaaatgggatggggccggcaggcaggcattccattaa

SEQ ID NO: 7723 - protein, 320 aa, Methanosarcina acetivorans C2A
MGIREDIKTVFEKDPAARSTLEVLCCYPGLHAIWMHRVAHSLWNKDLLFLARLTSHISRALTGIEIHPGAKLGKRVFIDHGSGVVIGETAEVGDDVLIYMGVVLGGTALEKKKRHPTVENNAVLGSGAIVLGPITIGRGAKVGAGSVVVRSVPPEATVVGVPARIAGTPQPSAPSEQLDHNKLPDPVLTVISQVLDRMSRLEERFQAHEKASTTPVPVSFVSSENPSVKKDEQIYSLLKDVIDPAVGIDIVNLGFVKEVTVNGTNVDVNLVLTTSACPMIEYFRNQVKRKVMGIKGIENVTVNILDEPWKWDGAGRQAFH

SEQ ID NO: 7724 - DNA, 699 bp, Methanosarcina acetivorans C2A
  CDS (1)..(699): transl_table=11
ctgagaaaccagcagtatgagacttcaagttgtacaaataattatcttgggtgggggatttctattaccattaaatcaaagagagattatgatttatacattgaggcagatagattagctttaggaaagaattataaaagacctaaactaataggtgacgagatatggaaatttcagcgattattaagaaagaccgagtattacaataactgtcaaaagtccttgattcataaactctattcaaaatacatattttttagattccacaggatgagcatccatctcgggtacagtattccaataaatgtttttggtcctggattatgcatagcccatagaggaaccattgttgtaaacaaagatgccagaattggagaaaactgcagaatacatgcctgtactaatataggatctggtagaacaggatctggcagagatagcattcttctggcaccgaaaatagggaactgcgtatacatcggccctggcgtcaaaatctttggaaatgtcgaaattgctgataatattgcaatcggagcgaattctgtagtaaacaaatccttctatgaaaaggggatctcgattgcaggcgttcctgctaaaaaaataaataataaaggatcagatggaatgataattacagctacaaaaatgatttcagctcctgctctacatgaagctgttgagcgcccactgtaa

SEQ ID NO: 7725 - protein, 232 aa, Methanosarcina acetivorans C2A
MRNQQYETSSCTNNYLGWGISITIKSKRDYDLYIEADRLALGKNYKRPKLIGDEIWKFQRLLRKTEYYNNCQKSLIHKLYSKYIFFRFHRMSIHLGYSIPINVFGPGLCIAHRGTIVVNKDARIGENCRIHACTNIGSGRTGSGRDSILLAPKIGNCVYIGPGVKIFGNVEIADNIAIGANSVVNKSFYEKGISIAGVPAKKINNKGSDGMIITATKMISAPALHEAVERPL

SEQ ID NO: 7726 - DNA, 663 bp, Thermoanaerobacter tengcongensis MB4
  CDS (1)..(663): transl_table=11
atgtttaaaactttaaaagaagacattgaagtagtttttgaaagagaccctgctgcaaagagcgttttggaggttttactgtgttatcccgggctccacgccataatacttcacagaattgcccattacttctataaaaaaggttttatactgctgccgaggttgatttcacatataaaccgttttttgacaggcattgaaatacatccaggtgcaaaaattgggcgcagatttttcatagaccacggcatgggagttgtaataggagagactacggaaattggagacaatgtgacgatatatcaaggagtgactttgggaggtactggtaaagaaaagggaaaaaggcatcctacgataaaggacaatgtagttataggcagtggagctaaagttttgggacctattgtggtaggggaaaattcaaaaataggagcaggagctgtcgttttaaaagatgtgcccccaaatagcactgtagttggcgttcctgcaaggtgcgtcaaaaaagacaacatacgcatagcaagatcttatgaagtggacctggaacatggcaagctccctgaccctgtagaggaagagctaagaaggttaagagagaggatagagaggcttgaaaaaattttaatggaaagggatgaggaagatgaggctgtataa

SEQ ID NO: 7727 - protein, 220 aa, Thermoanaerobacter tengcongensis MB4
MFKTLKEDIEVVFERDPAAKSVLEVLLCYPGLHAIILHRIAHYFYKKGFILLPRLISHINRFLTGIEIHPGAKIGRRFFIDHGMGVVIGETTEIGDNVTIYQGVTLGGTGKEKGKRHPTIKDNVVIGSGAKVLGPIVVGENSKIGAGAVVLKDVPPNSTVVGVPARCVKKDNIRIARSYEVDLEHGKLPDPVEEELRRLRERIERLEKILMERDEEDEAV

SEQ ID NO: 7728 - DNA, 822 bp, Chlorobium tepidum TLS
  CDS (1)..(822): transl_table=11
atgagtgtacaggatatctggtcattgattcgtgaagaagcgtgcctcgagtgcgagcgtgagccggagatccggctgtttctggaacagcacattttgcgatatgaggagttcgctccggcgctggcgatgctgctttcggtgaagcttgggtcgaagcactttccgccgccggtgcttgaaggaatcttcgaggatttttatcggcaaagccccgaatctgtccggtgcgcagcctgcgacatggaggctacccgtgagcgtgacccggcagcggtgaactatttcgagatcatgctttttctcaagggctaccaggcgcttcagtcttaccggctggctcactggctgtggcagaatgaccgcaaatcgctggcctatttcctccagaaccgcatgtcggaggttttcgcggtagatattcatcctgcggctaaaatcggcaagggcattctgcttgatcatgccacgagccttgtcatcggcgagaccgccgtggtagaggataatgtttcgcttctgcacgaggtgacgcttggtggcaccggcaaggattcgggtgaccggcatccgaaagtcggtaagtcggtgatgattggcgccggggccaagattctcggaaacatcaaaatcggagaaggtgcgaaggtcggggcgggcagcgtggtgctcgatgatgttccgccgcactacacggttgctggtgtgccagcacatatcgtggggcgcactgaagttcccgaaccctctctcgatatgaaccagcgcctcatttttccggaaaaacaaaagccgaaaggcgagcagcactcgtgcttataa

SEQ ID NO: 7729 - protein, 273 aa, Chlorobium tepidum TLS
MSVQDIWSLIREEACLECEREPEIRLFLEQHILRYEEFAPALAMLLSVKLGSKHFPPPVLEGIFEDFYRQSPESVRCAACDMEATRERDPAAVNYFEIMLFLKGYQALQSYRLAHWLWQNDRKSLAYFLQNRMSEVFAVDIHPAAKIGKGILLDHATSLVIGETAVVEDNVSLLHEVTLGGTGKDSGDRHPKVGKSVMIGAGAKILGNIKIGEGAKVGAGSVVLDDVPPHYTVAGVPAHIVGRTEVPEPSLDMNQRLIFPEKQKPKGEQHSCL

SEQ ID NO: 7730 - DNA, 741 bp, Thermosynechococcus elongatus BP-1
  CDS (1)..(741): transl_table=11
atgctcagcaccctcaaagcagatttccaaattatctttgagcgggatcctgctgcccgcaattggttagaggttgttttttgctatcccggactgcaggccattgttctccatcggttgagccactggctttggcggcggggcattccctttatcccccggttcatttcccacattgcccgcctcctcacggggattgaaattcaccccggtgccacgattggcaagggggttttcattgatcatggcatgggggtcgtcattggtgagacggccgttgtggggaactactgtttgatttatcaaggggtgaccctcggcggtaccggtaaagaaacaggaaagcgccaccccacccttggtgaaaatgtggttgttggtgcaggggcaaaggtgttgggcaacctcaccattggggacaatgtgcgcattggcgcagggtctgtggtgctgcgggatgtgccttccgattgtacggtggtggggattcccgggcggattgtctatcgtgcaggagccaaaattgcccccttggaacacggtcaactgcctgactctgaggccgaagccattcgctatcttttggatcgcattgaactcctagagcaacaggtgcaaacactgcaacagcagaaaaaggtgcctgcccttgttcaaggacatttgcaaccatcccaaggacaggcctgtcgcctcagcgatcgccccattgaagagtttctcaacggcgctggtatttag

SEQ ID NO: 7731 - protein, 246 aa, Thermosynechococcus elongatus BP-1
MLSTLKADFQIIFERDPAARNWLEVVFCYPGLQAIVLHRLSHWLWRRGIPFIPRFISHIARLLTGIEIHPGATIGKGVFIDHGMGVVIGETAVVGNYCLIYQGVTLGGTGKETGKRHPTLGENVVVGAGAKVLGNLTIGDNVRIGAGSVVLRDVPSDCTVVGIPGRIVYRAGAKIAPLEHGQLPDSEAEAIRYLLDRIELLEQQVQTLQQQKKVPALVQGHLQPSQGQACRLSDRPIEEFLNGAGI

SEQ ID NO: 7732 - DNA, 681 bp, Oceanobacillus iheyensis HTE831
  CDS (1)..(681): transl_table=11
ttgggtatttttaagatgatgaaagaggatatggatgttgtatttgaacaagaccctgctgctagaacgtatgttgaagtaatgcttacttattctggtttacatgctgtatggtcccatcgcgttgcccattggttttataacaagcgattattgtttattgcacgtgttatttcacaaataagtcggtttatcactggaatcgaaattcatcccggagcgaagataggccaaaggttatttattgaccatgggatgggagttgtcatcggggagacatgtgaaataggcaataatgttaccatttttcaaggtgtaacgcttggtggtacaggtaaagaaaaaggcaaacgtcatccaacgctaaaggataatgccttgattgcaactggtgcaaaagtactcggcgcgattacgattggtgaaaactctaaagttggtggtggatcagtcgtgctaaaggatgttccagataactcaacggttgtaggtgttcccgggcaagtggtcgttcaagatggaaaaagagtaggaagagaccttgatcatcataaattaccagatcctgtctttgataaatgcgcccaattacaaacacaaattgatgagctaaaagcggaaatggcttcgatgaaagaggaaaaaaggagggtcttagaaaatgaccatacaaatatataa

SEQ ID NO: 7733 - protein, 226 aa, Oceanobacillus iheyensis HTE831
MGIFKMMKEDMDVVFEQDPAARTYVEVMLTYSGLHAVWSHRVAHWFYNKRLLFIARVISQISRFITGIEIHPGAKIGQRLFIDHGMGVVIGETCEIGNNVTIFQGVTLGGTGKEKGKRHPTLKDNALIATGAKVLGAITIGENSKVGGGSVVLKDVPDNSTVVGVPGQVVVQDGKRVGRDLDHHKLPDPVFDKCAQLQTQIDELKAEMASMKEEKRRVLENDHTNI

SEQ ID NO: 7734 - DNA, 801 bp, Brucella suis 1330
  CDS (1)..(801): transl_table=11
atgaatgccggtctcgatcaggtcgatcccatctggcattccatccgtgccgaagcggaggaggcgaccaggaatgacccggttctgggcgcctttctctacgccacgattctcaaccagccgagccttgaagaagcggtgatgcatcgtatcgccgaacgccttggccatcccgatgtgagcgcggatatcctgcgccagaccttcgatacgatgcttgaggcaaacccggaatggtcgcacgtcctgcgtgtggatattcaggctgtttatgaccgcgatccggcctatagccgctttatggatccggttctttacctgaagggcttccatgcgatccaggcacaccgtctggcgcactggctttacaagcaaggtcgcaaggatttcgcctattatcttcagagccgctcgtcatcgatctttcagaccgatattcacccggcggccaggcttggcagcgggctgtttctcgaccatgctacagggcttgtggtgggtgaaacggccgttgtagaagataatgtctcgatcctgcatggggttacgctgggcggaaccggcaaatcgagcggtgatcgccatccgaaaatccgtcagggcgtgctgattggggcaggcgcaaaaatcctcggcaacatccaggtagggcagtgctccaagatcgcggctggttccgttgtgctgaagtccgtgccgcataatgtaaccgtggcgggcgtgcctgcgcgcatcatcggcgaaacgggctgcacggagccatcccgcgtgatggaccagatgctgggtgacggcatctaa

SEQ ID NO: 7735 - protein, 266 aa, Brucella suis 1330
MNAGLDQVDPIWHSIRAEAEEATRNDPVLGAFLYATILNQPSLEEAVMHRIAERLGHPDVSADILRQTFDTMLEANPEWSHVLRVDIQAVYDRDPAYSRFMDPVLYLKGFHAIQAHRLAHWLYKQGRKDFAYYLQSRSSSIFQTDIHPAARLGSGLFLDHATGLVVGETAVVEDNVSILHGVTLGGTGKSSGDRHPKIRQGVLIGAGAKILGNIQVGQCSKIAAGSVVLKSVPHNVTVAGVPARIIGETGCTEPSRVMDQMLGDGI

SEQ ID NO: 7736 - DNA, 708 bp, Leptospira interrogans serovar Lai str. 56601
  CDS (1)..(708): transl_table=11
ttgtttgaaaatattaaatttataaggaaatatgatcccgctgctaagtcttacttagaaattgtactctgttatcccggtttacatgccctctggtttcataaactggctcattttctttataggatgaaactccctttaatcccaaggatgatcaatactttttccagatttattactggaatcgacattcatcccggagcaaaaattgcaaacgggattatgatcgatcatggacacggagttgtaatcggcgaaaccgccacaatcgcaaaagggtgtttaatttaccaaggtgttactcttgggggtactggaaaagaatctggaaaacgtcatccgtctttactcgaaaacgtagtggtaggcgcaggcgctaaaattcttggaaatattacgatcggaaaaaacgtacgtgtaggtgctggatccgtagttatgagagacgttccacacgatagtacggtagtcggaattcctgccaaagtagttcgctctaaaatgccaatcggcgaagaaggcgaacacatgttggatcataacgaaattccggacccggtcgctaaagtattttctatcctacttgaaagaatagaaactcttcaaaaagaagtgcattctatagataagagcgggattcattccgttaagtcaaacgacaatctggaagaaattttagatgaatttatacacggcggaggaatttaa

SEQ ID NO: 7737 - protein, 235 aa, Leptospira interrogans serovar Lai str. 56601
MFENIKFIRKYDPAAKSYLEIVLCYPGLHALWFHKLAHFLYRMKLPLIPRMINTFSRFITGIDIHPGAKIANGIMIDHGHGVVIGETATIAKGCLIYQGVTLGGTGKESGKRHPSLLENVVVGAGAKILGNITIGKNVRVGAGSVVMRDVPHDSTVVGIPAKVVRSKMPIGEEGEHMLDHNEIPDPVAKVFSILLERIETLQKEVHSIDKSGIHSVKSNDNLEEILDEFIHGGGI

SEQ ID NO: 7738 - DNA, 822 bp, Shewanella oneidensis MR-1
  CDS (1)..(822): transl_table=11
atgggtgtgatagctaggctaaaagaagacattgaatctatatatcaccgtgatcccgcggcgcgcagcgcctttgagatcttggtcaactatcccggaatgcatgccatttggttgcatcggataagccataaattatggaagcgtgattggcgtttaatggctcgctgtttatccacgttttcgcgctggctgacgggcgttgagatccatcctggtgccaccatcggtaatcgtttttttattgaccatggtatgggcgtggtaatcggtgaaacggctgagattggcgatgattgtactttgtatcacggtgtgacactcggtggaaccacatggcaagctggtaagcgacatcctacactgggtaataacgtcgttgttggtgcaggcgctaaaatcttaggccctatcaccatgcatgatggggctcgtgtaggttcaaattctgttgtagtaaaagatgtgcctaaggatacgactgtggtcggtattcctgggcgtgtggtggccacaccatcaccacaatcgaaagaaaaatccgagcgtcgaagtgccatggccaaaaaatatggtttcgatgcttacgcagtatcacctgataatccagatccggttgcgaacgcgatcggtcaaatgctggatcatatgcatctaatggattcaaaggtgcaggagttgtgtcaagccatccagcgtttaggcggcgatgtatgcaccgaaagattgcctgagctgaatgtcggcgattttaacgatgttgaaaaggcggctgctgataagcgccaaagtgcgctagacgagtttgacccaagtatttag

SEQ ID NO: 7739 - protein, 273 aa, Shewanella oneidensis MR-1
MGVIARLKEDIESIYHRDPAARSAFEILVNYPGMHAIWLHRISHKLWKRDWRLMARCLSTFSRWLTGVEIHPGATIGNRFFIDHGMGVVIGETAEIGDDCTLYHGVTLGGTTWQAGKRHPTLGNNVVVGAGAKILGPITMHDGARVGSNSVVVKDVPKDTTVVGIPGRVVATPSPQSKEKSERRSAMAKKYGFDAYAVSPDNPDPVANAIGQMLDHMHLMDSKVQELCQAIQRLGGDVCTERLPELNVGDFNDVEKAAADKRQSALDEFDPSI

SEQ ID NO: 7740 - DNA, 669 bp, Streptococcus mutans UA159
  CDS (1)..(669): transl_table=11
atgacaaacaaattgttgttgaatggtcgggtatggaataaaggagatattatgggttggtggaaagaaaccattgatattgttaaagaaaaagatcccgcagcacggacggcgctagaggttcttttgacttacccaggtgttaaggctttagctgctcattgcttatctcattttttgtggacacaccattgtaaattgttggctcggatgcatagtcagttttggcgtttttggacacaaattgagattcatccaggtgctgaaattgcagaaggcgtctttattgatcacggttcaggtttagttattggtgagactgccatcgtagaaaaaggggtcatgctttatcatggtgtgacacttggtggtacgggtaaagagactggaaaacggcatccaacgattcgtcaaggagctcttatttctgcacattcacaagttattggtccggttgaggttggtccgggcgctaaggtgggtgcaggtgcagtcgttgtttcggatgttccagcagacgtcactgtggttggtgttccagccaaggtggttcgtattcatggtcaaaaagatgaaacagctatccatgaaatcgaagagaaccgtgaatattacctcaaaaaactagaagaagctaaggaagctagttttcactcgtccgggctgtga

SEQ ID NO: 7741 - protein, 222 aa, Streptococcus mutans UA159
MTNKLLLNGRVWNKGDIMGWWKETIDIVKEKDPAARTALEVLLTYPGVKALAAHCLSHFLWTHHCKLLARMHSQFWRFWTQIEIHPGAEIAEGVFIDHGSGLVIGETAIVEKGVMLYHGVTLGGTGKETGKRHPTIRQGALISAHSQVIGPVEVGPGAKVGAGAVVVSDVPADVTVVGVPAKVVRIHGQKDETAIHEIEENREYYLKKLEEAKEASFHSSGL

SEQ ID NO: 7742 - DNA, 567 bp, Corynebacterium efficiens YS-314
  CDS (1)..(567): transl_table=11
atgcttttagttgtgaagatgatccgcgaagacctcgccaacgcccgcgaccatgaccctgcggcgcgaggggaccttgaaaacgccatcgtctactccggtcttcacgcaatctgggcccaccgcatcgcacatgcctggtggaaggcgggtttccgtggccccgcacgtatcctgtcgcagctgaaccgtttcttcaccggcatcgagatccacccgggcgccaccatcggtcgacgtttcttcatcgaccacggcatgggggtggtcatcggcgagaccgccgagatcggtgatggcgtgatgctctaccacggtgtcaccctcggcggccaggtcctcacccagaccaagcgccaccccaccatcgaggacaatgtcaccatcggtgcgggtgcgaaggtgctcggccccatcacggtcggtgcgggttccgccatcggttccaacgccgttgtgaccaaggatgtccccgccaaccacatcgcggtgggtatccctgccaaggcccgcccgcgtggcaaggatgagaccatcaagttggtcgacccggactactacatctag

SEQ ID NO: 7743 - protein, 188 aa, Corynebacterium efficiens YS-314
MLLVVKMIREDLANARDHDPAARGDLENAIVYSGLHAIWAHRIAHAWWKAGFRGPARILSQLNRFFTGIEIHPGATIGRRFFIDHGMGVVIGETAEIGDGVMLYHGVTLGGQVLTQTKRHPTIEDNVTIGAGAKVLGPITVGAGSAIGSNAVVTKDVPANHIAVGIPAKARPRGKDETIKLVDPDYYI

SEQ ID NO: 7744 - DNA, 525 bp, Pseudomonas putida KT2440
  CDS (1)..(525): transl_table=11
atgctggccgcctaccacggcgacccggcggcacgcagcgtcgacgaagtgctgctgtgctatccgggcatcctggcgattatccaccaccggctggctcaccacctgtacaaggccgggctgccgctgctggcgcggatcagttcggagctggcgcattcggccaccggtatcgacattcaccccggggcgcagatcggcccgagcttcttcatcgatcatggtacgggtgtggtgattggtgaaaccgcgatcatcggcgagcgcgtgcgcatctaccaggcggtgaccctgggcgccaagcgtttccccagcgatgagtcgggtacgctgcataaaggcctgccacggcacccgatcgtcgaggacgatgtggtgatctatgccggggccacggtgctggggcgtattaccatcggcaagggttcgaccattggcggtaatgtgtggctgactcgcagtgtgccggctgaaagcaacattactcaggccaacctgcagctggactgccaggacaagaactga

SEQ ID NO: 7745 - protein, 174 aa, Pseudomonas putida KT2440
MLAAYHGDPAARSVDEVLLCYPGILAIIHHRLAHHLYKAGLPLLARISSELAHSATGIDIHPGAQIGPSFFIDHGTGVVIGETAIIGERVRIYQAVTLGAKRFPSDESGTLHKGLPRHPIVEDDVVIYAGATVLGRITIGKGSTIGGNVWLTRSVPAESNITQANLQLDCQDKN

SEQ ID NO: 7746 - DNA, 786 bp, Pseudomonas putida KT2440
  CDS (1)..(786): transl_table=11
atgttcgaacgcctgcgtgaagatattcaaagcgtattccaccgtgacccggctgcacgcaatgccttcgaggtgctcacctgctaccccggcatgcatgccatctggctgcaccgcctgggcaatgcgctgtggaggcgtgatttcaaatggctggcccggctggtgtcgaacttcggtcgctggctgaccggtatcgaaatccaccctggcgccaccattggccggcgctttttcatcgaccacggtatgggtatcgtcattggcgaaaccgccgagatcggcgatgacgtcaccctgtaccagggggtgacgctcggtggcaccagctggaacaagggcaagcgccaccccaccttggaaaacggcgtggtggtaggggcgggtgccaaggtgctggggcctttcaccgtcggcgccggggccaagatcggttccaatgcggtggtcaccaaggcggtgccggccggggctacggcggtaggcattccggggcggatcatcgtcaagagcgaggacaccgaagtcgaagccaagcgtaaggcaatggccgagaagatcggcttcgacgcctatggtgtcagtggcgacatgcccgacccggtggcgcgggccatcggccagatgctcgatcacctgcaggccgtcgacgaacggttggagggtatgtgtggcgcgctgaccaagatgggcagtgactattgtgccaaggaactgccggccttgccggaggacgacttcagcgaggctgcccaagtggcccagcgcgacactcagccgcattga

SEQ ID NO: 7747 - protein, 261 aa, Pseudomonas putida KT2440
MFERLREDIQSVFHRDPAARNAFEVLTCYPGMHAIWLHRLGNALWRRDFKWLARLVSNFGRWLTGIEIHPGATIGRRFFIDHGMGIVIGETAEIGDDVTLYQGVTLGGTSWNKGKRHPTLENGVVVGAGAKVLGPFTVGAGAKIGSNAVVTKAVPAGATAVGIPGRIIVKSEDTEVEAKRKAMAEKIGFDAYGVSGDMPDPVARAIGQMLDHLQAVDERLEGMCGALTKMGSDYCAKELPALPEDDFSEAAQVAQRDTQPH

SEQ ID NO: 7748 - DNA, 525 bp, Pseudomonas putida KT2440
  CDS (1)..(525): transl_table=11
atgttcgataatattcgcgccgacctgcgggcccatggcggggactggggcgcccagggtttctgggtcttgctggtgtaccgctttggccgctggcgttatacgctgcgcccggcactgctgcgcaaactgtgctcgctcatctacaaggtgctgttcaaattcgtccagatcatcaccggtatcgaactgccgtgcgaggtggtgatcgggcgcaacttcgtcatcgatcattttggcggcatcgttgtcagcggctatgcccgcttcggcgatgactgccgtatccgcaacggcgtggtggtgggcctgaagaatgtcgacgagccgattgccccggtgttcggcaacaacgtcgacattggcaccggggccaaggtgctgggcagtattcgcatcggcaacaacgtgatcatcggcgccaatgccgtcgtgctggtagatgtgcctgacaattcactggcagtgggggtgccggccatcatcaaggcccggcatccggccgccgtggcatcggtcgagtga

SEQ ID NO: 7749 - protein, 174 aa, Pseudomonas putida KT2440
MFDNIRADLRAHGGDWGAQGFWVLLVYRFGRWRYTLRPALLRKLCSLIYKVLFKFVQIITGIELPCEVVIGRNFVIDHFGGIVVSGYARFGDDCRIRNGVVVGLKNVDEPIAPVFGNNVDIGTGAKVLGSIRIGNNVIIGANAVVLVDVPDNSLAVGVPAIIKARHPAAVASVE

SEQ ID NO: 7750 - DNA, 822 bp, Vibrio vulnificus CMCP6
  CDS (1)..(822): transl_table=11
atgaaacactgtgaaaaacaaaaagtctggcagagcattgtcaaagaagcccgtgagctatcggagcaagagccgatgcttgccagtttttatcacgccaccatcatcaagcatgaaagcttgtgtgctgcgttgagctacattttagccaataagctgaacacagcctccatgccggcgatggcagtgcgtgaagtggttgaagaagcctttgcggctgaccctaacatcaccgattctgccgcctgcgatatctgtgcgacggtgaatcgtgacccggctgtttctatgtattctatcccactgctttacctaaagggttaccatgccttgcaaggctatcgcgtggcaaattggttgtggaaacaaggccgctacgcgctggcgacctatctgcaaaatcaaatctcggtggcatgccaagtggatattcaccctgcggctcgtatcggcaaaggcatcatgctggatcacgcaacaggtatcgtgatcggggaaaccgctgtcgtcgaaaatgatgtatccatcctgcaagacgtgacgttaggtggtactggtaaagagtgcggcgaccgacatcctaagatccgcgaaggggtgatgatcggagctggggcaaaaatccttggcaatatcgaagttggagaaggtgcaaaaattggctcctgctccgttgtacttcaacccgttccaccgcatactaccgtcgctggtgtacccgcacgaattgtagggagaccgcaatccgacaagccttctctcgatatggatcaaggctttaacgggaaataccctaacttcattgacggtgacggcatctaa

SEQ ID NO: 7751 - protein, 273 aa, Vibrio vulnificus CMCP6
MKHCEKQKVWQSIVKEARELSEQEPMLASFYHATIIKHESLCAALSYILANKLNTASMPAMAVREVVEEAFAADPNITDSAACDICATVNRDPAVSMYSIPLLYLKGYHALQGYRVANWLWKQGRYALATYLQNQISVACQVDIHPAARIGKGIMLDHATGIVIGETAVVENDVSILQDVTLGGTGKECGDRHPKIREGVMIGAGAKILGNIEVGEGAKIGSCSVVLQPVPPHTTVAGVPARIVGRPQSDKPSLDMDQGFNGKYPNFIDGDGI

SEQ ID NO: 7752 - DNA, 954 bp, Bradyrhizobium japonicum USDA 110
  CDS (1)..(954): transl_table=11
atgtttcaacgcgttggcggctttcgcggggcaaggtgctgttcactctcaggcaagcccgtcaggactttgtcgcctagactgtgctatagaaccaacaaaacgagcccattcgaaagagcagatcccatggcagtgcatcaggtcaatccgggaggaaagctcgcatccctcgatccgatctgggaccggatccggagcgaagcggaggacatcgtccatcgcgagccggagcttgcgaccttcatctattcgacggtgctgcatcacagccgtctcgaggattcggtgatccatcgtctcgccgaccggctcgatcattccgcgctgtcgggcgatctcgtgcgccagacctatgacgaggcgctgcgcgacgatcccgatctcggcaacgccttccgcgccgacctcgtcgccgtctacgatcgcgatcccgcgacctcccgcttcatcgatccgttgctctacttcaagggcttccacgcgatccagacccatcgccttgcgcactggctctggctgaagggccgcaaggatttcgcgtattatctccagagccgcgcctctgcggtgttccagaccgacatcaatcccgccgcgcgcatcggccgcggcatcttcctcgaccatgccaccggcttcgtctgcggcgagacggcggtgatcgaggacgacgtctcgatcctgcacggcgtcacgctcggcggcaccggcaaggagaacgaggaccgtcatccgaagattcgccatggcgtgctgatcggcgcgggcgcgaaaatcctcggcaacatcgagatcggccattgcgcgcgcatcgcggcgggctcggtcgtggtcaagcccgtgccgcacaacgtcacggtcgcgggcgtgcccgccaagatcgtcggcgaggccggctgcgccgagccgtcgcgcaccatggatcagatgatcaacgcgatggggctttga

SEQ ID NO: 7753 - protein, 317 aa, Bradyrhizobium japonicum USDA 110
MFQRVGGFRGARCCSLSGKPVRTLSPRLCYRTNKTSPFERADPMAVHQVNPGGKLASLDPIWDRIRSEAEDIVHREPELATFIYSTVLHHSRLEDSVIHRLADRLDHSALSGDLVRQTYDEALRDDPDLGNAFRADLVAVYDRDPATSRFIDPLLYFKGFHAIQTHRLAHWLWLKGRKDFAYYLQSRASAVFQTDINPAARIGRGIFLDHATGFVCGETAVIEDDVSILHGVTLGGTGKENEDRHPKIRHGVLIGAGAKILGNIEIGHCARIAAGSVVVKPVPHNVTVAGVPAKIVGEAGCAEPSRTMDQMINAMGL

SEQ ID NO: 7754 - DNA, 768 bp, Bradyrhizobium japonicum USDA 110
  CDS (1)..(768): transl_table=11
atggcggaggctgcgatcatggcgagcgacggcctctggcaacgggtccgcggcgaggcgcagcgcgcggcggatgccgatcccgtcttcggcaaggcgcttgccggcaccattctcgctcatgatgatttcgccgcggccttgtccgatctgatcggacgccggctcggcggcagcgcagccgagcgcgcgcgcttctcggccttttccttcgatgcctttcgcggctcgccagatctgatcgaggtggccggccgtgacttgcaggcgatcgcgatccacgatcccgccatcgccgacctgttgccgccgctgctgcatttcaagggctatgtcgcgctgcaagcctggcgcgtctcgaactggctctggcaccatgaccatcgcgatgcggcgctgctgttccagaacgaagcgtcgaatgcgctgcaggtcagcattcatccggccgccagcatcggatcgtcagtctatctcgaccacgccaccggcatcgtgatcggcgccaacgtcgtgatcggcgacgaggtcaccatcctccagaacgtcagcatcggccgcggcagtgaactgccgacgcgctcgccgcggatcggccgcggcatctatatcggcggcggtgcgaccatcctcggcgacatcagggtcggcgatttcgccaagatcggcgccgacgcgctcgtgacgtcagacgttcctgctggctgcacggccgtcggcaatcccgcgcggctgaccaactgccccgaacctgcctcggcggcctga

SEQ ID NO: 7755 - protein, 255 aa, Bradyrhizobium japonicum USDA 110
MAEAAIMASDGLWQRVRGEAQRAADADPVFGKALAGTILAHDDFAAALSDLIGRRLGGSAAERARFSAFSFDAFRGSPDLIEVAGRDLQAIAIHDPAIADLLPPLLHFKGYVALQAWRVSNWLWHHDHRDAALLFQNEASNALQVSIHPAASIGSSVYLDHATGIVIGANVVIGDEVTILQNVSIGRGSELPTRSPRIGRGIYIGGGATILGDIRVGDFAKIGADALVTSDVPAGCTAVGNPARLTNCPEPASAA

SEQ ID NO: 7756 - DNA, 561 bp, Clostridium tetani E88
  CDS (1)..(561): transl_table=11
atgtttaaaaatttaaagtacgatatagataatataataaaaaatgatccagcagcaagaaattctttagaagtactgttattatatccatctatacatgccattatcaatcatagaatagctcactttttttataagaaaagaatgttttttatagctagattaatatctcaaatatctagattttttacagggatagaaattcatccaggagctcagataggaaatgggctctttatagaccatggtatgggggtagttataggtgaaactgctgaagtaggaaatgatgttactatttatcatggggttactttaggaggaacagggaaagataaaggtaaaagacatcctacagttggaaacaatgttataataggaagtggagctaaagtattgggacctatagtaataggtaataatgcaaaggtaggggctaattccgtagttttaaaggatgtaccagaaaataaaactgcagtaggggcaccggctaaaatagttggagaaaagaaatctgaagttgtagatatgaatctatacagaactatagtaagataa

SEQ ID NO: 7757 - protein, 186 aa, Clostridium tetani E88
MFKNLKYDIDNIIKNDPAARNSLEVLLLYPSIHAIINHRIAHFFYKKRMFFIARLISQISRFFTGIEIHPGAQIGNGLFIDHGMGVVIGETAEVGNDVTIYHGVTLGGTGKDKGKRHPTVGNNVIIGSGAKVLGPIVIGNNAKVGANSVVLKDVPENKTAVGAPAKIVGEKKSEVVDMNLYRTIVR

SEQ ID NO: 7758 - DNA, 777 bp, Pseudomonas syringae pv. tomato str. DC3000
  CDS (1)..(777): transl_table=11
atgttcgagcgtctgcgagaagacattcaaagcgtatttcatcgcgaccctgcggcgcgcaatgcttttgaagtgctgacctgctacccgggcatgcacgccatctggctgcaccgtttcgctcatgttctgtggcgcaatggctggaaatggcttgcgcgagtggtgtccagcttcggccgctggatgaccggtgtcgagattcatccgggcgcacgcataggccgtcgcttcttcattgatcacggcatgggcatcgtgatcggcgaaaccgccgaaatcggcaatgacgtgacgctttatcagggggtgaccctgggcggtaccagttggaacgccggtaagcgccaccccacgctggaagacggcgtggtcgtgggtgccggtgccaaggtgctcgggccgtttaccgtgggtgcaggcgccaagatcggttccaatgccgtggtgaccaaggccgtgcctgcgggcgcgactgccgtgggtattccggggcgcatcatcgtcaagtccgacgacgaaaccgaagccaggcgcaaggtcatggcggaaaagcttggcttcgatgcctatggtgtcagtggcgacatgccagaccccatcgcccgtgccatcggtcagatgctggatcacctgcaggcggtcgatggccgtcttgaaggcatgtgcgacgccctcggcaggctgggcagcgattattgcgccaaagaccttccccagttacgcaacgaggtcttcgactgtgtcaaggatgctcgcgaagacaccgtcgactag

SEQ ID NO: 7759 - protein, 258 aa, Pseudomonas syringae pv. tomato str. DC3000
MFERLREDIQSVFHRDPAARNAFEVLTCYPGMHAIWLHRFAHVLWRNGWKWLARVVSSFGRWMTGVEIHPGARIGRRFFIDHGMGIVIGETAEIGNDVTLYQGVTLGGTSWNAGKRHPTLEDGVVVGAGAKVLGPFTVGAGAKIGSNAVVTKAVPAGATAVGIPGRIIVKSDDETEARRKVMAEKLGFDAYGVSGDMPDPIARAIGQMLDHLQAVDGRLEGMCDALGRLGSDYCAKDLPQLRNEVFDCVKDAREDTVD

SEQ ID NO: 7760 - DNA, 903 bp, Bacteroides thetaiotaomicron VPI-5482
  CDS (1)..(903): transl_table=11
atgagtccattgaactttacccacattctgacacaggcagtcgatgagctatcggaaagcgaatcttacaaagggctgtttcatcaacataaagatggcgaaccattgccctctgctaaagttttgtatgaaattatcgagctttcacgtgccattctcttccccggatactacggaaattccaccatcaacagccggacaatcaattatcacatcggtgtaaatatcgaaaagttatttgacttgctcacagagcaaatcctggccggactatgtttcagtacggcagaaggagactgcaacgtctgctcggagtcgagaagagaagaagccgcccgactggctgcgaactttatcagcaaactacccgccatgagaagaatactggctacggacgtagaagccgcctacaacggtgaccccgctgccaaaagctacggtgaagtaattttctgctatcccgccattaaggcaatcagcaattatcgtattgcgcacgaactgctggaactgggtgttcccctgattcctcgcatgatcacggaaatggctcatagcgagacgggtatcgatatccatccgggagcgaagataggcagtcactttaccatagaccacggaacgggtgtcgtgatcggtgctacaagcatcatcgggaacaatgtcaaattatatcagggtgtcaccctaggagcaaaaagcttcccgctggatgccgacggaaaaccgatcaagggtatcccccgccacccgatactggaagacaatgtcatagtctactccaacgccaccattcttggaagaatcactatcggaagcgacgcaaccgtaggaggaaatatctgggtaacggaaaacattcctgccggagcaaagattgtacaaacaaaagcaaagaaataa

SEQ ID NO: 7761 - protein, 300 aa, Bacteroides thetaiotaomicron VPI-5482
MSPLNFTHILTQAVDELSESESYKGLFHQHKDGEPLPSAKVLYEIIELSRAILFPGYYGNSTINSRTINYHIGVNIEKLFDLLTEQILAGLCFSTAEGDCNVCSESRREEAARLAANFISKLPAMRRILATDVEAAYNGDPAAKSYGEVIFCYPAIKAISNYRIAHELLELGVPLIPRMITEMAHSETGIDIHPGAKIGSHFTIDHGTGVVIGATSIIGNNVKLYQGVTLGAKSFPLDADGKPIKGIPRHPILEDNVIVYSNATILGRITIGSDATVGGNIWVTENIPAGAKIVQTKAKK

SEQ ID NO: 7762 - DNA, 540 bp, Enterococcus faecalis V583
  CDS (1)..(540): transl_table=11
atgagttggttgaaacgtagcgtcgcagctgttaaaagaaacgatcctgcagcgcggaccacactagaagttcttttaacgtatcctggcttgcacgccctgttttggcatcgcttgtctcatttcttatataggcatcagttgtttttgttggcgaagattcatgcacaattttggcgtttcataacgggcgtagaaattcatcccggagccacaattggagcgggagtttttatcgatcacggcatgggcattgtgattggggaaaccgcggaaatagaagaagatgttgttttgtttcacggagtgacgttaggtgggaccggtcgtgatacgggtaaacgccatccaacagtgaaaaaaggagcgatgatttcggcacgagctcaaattttagggccagtggtgattggtgaacgttcaaaaattggtgcgggtgctgttgttatttcagacatcccagcagatgccacagctgtgggtgttcctgcgaaagtcgttcgtctaaatggaagaaaggtggaaaaagggcatgattaa

SEQ ID NO: 7763 - protein, 179 aa, Enterococcus faecalis V583
MSWLKRSVAAVKRNDPAARTTLEVLLTYPGLHALFWHRLSHFLYRHQLFLLAKIHAQFWRFITGVEIHPGATIGAGVFIDHGMGIVIGETAEIEEDVVLFHGVTLGGTGRDTGKRHPTVKKGAMISARAQILGPVVIGERSKIGAGAVVISDIPADATAVGVPAKVVRLNGRKVEKGHD

SEQ ID NO: 7764 - DNA, 666 bp, Bacillus cereus ATCC 14579
  CDS (1)..(666): transl_table=11
atgtttaagaggcttcgggaagatattgaagtcgtttttgaacaggatccagcggcaagaggttatttcgaagtcattttaacttactctggattacatgcagtttgggcccatcgaattgcacatgctttttataaaaaaaattttttctttcttgcacgttttgtttcacaagtgagccgcttttttactggcattgagatccatccaggagcaacaattggtcgacgttttttcatagatcatggaatgggagttgtaatcggagaaacttgtgaaattggtgataatgtaacgatttatcaaggggttacattaggtggtacaggaaaagaaaaaggaaagaggcatccaacaattcaggataatgtattaattgcgacgggtgctaaagttcttggttctattactgtgggagagaattctaaaatcggagcagggtccgtcgtattaaaagaagttcctgcacattctacagttgtaggtatacctggccgtgtcgttattcaaaatggagtaaagattggtcaagaattaaatcactctgaccttccggatccgatttttgataaattaaaggctatggaagtagaacttgataaattgaagaaacaattggaattaaaggtagaaaggaaggataaaaatgactattcacatttataa

SEQ ID NO: 7765 - protein, 221 aa, Bacillus cereus ATCC 14579
MFKRLREDIEVVFEQDPAARGYFEVILTYSGLHAVWAHRIAHAFYKKNFFFLARFVSQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKAMEVELDKLKKQLELKVERKDKNDYSHL

SEQ ID NO: 7766 - DNA, 705 bp, Helicobacter hepaticus ATCC 51449
  CDS (1)..(705): transl_table=11
atgactttgtggggcattatcaaagaagattttagtattattaaacaaaaagatccagcacttaatagcagcgtggagttattttttaattatccgggtttaattgcattggtgcattatcgtatagctcatcgcttttataaggctggatttaaaatattagcgcgtattttgatggggcttacaggttttataacaaatgttgatattcaccctgcagctataataggtaggcgcgtatttattgaccacgctacgggtgtagtcattggcgagactgcggaagtgggtaatgatgtgatgatataccaaggtgttacactcggaggcacgagccttgataaagtcaagcgccaccctacgatagaagatggcgtagtcataggggcaggtgcaaagattttaggaaatattagaattggtgcaaatgcgaaaatcggtgcaaattctgttgtgattaaagatgtgccacaagattgcactgcagttggaatcccagcaagagttattgtcaaaggacgagcacaaggtataaatgcgattaataagctacctgatattgatagggcattgtttgaatatctctttaaacgcatacaaattctagaatccactcaagatgagcaaaactgcactaagctcaaagcagagcttcaaagccttgatgaaatctatgcgcatttcttgcaaagcttaaaaggataa

SEQ ID NO: 7767 - protein, 234 aa, Helicobacter hepaticus ATCC 51449
MTLWGIIKEDFSIIKQKDPALNSSVELFFNYPGLIALVHYRIAHRFYKAGFKILARILMGLTGFITNVDIHPAAIIGRRVFIDHATGVVIGETAEVGNDVMIYQGVTLGGTSLDKVKRHPTIEDGVVIGAGAKILGNIRIGANAKIGANSVVIKDVPQDCTAVGIPARVIVKGRAQGINAINKLPDIDRALFEYLFKRIQILESTQDEQNCTKLKAELQSLDEIYAHFLQSLKG

SEQ ID NO: 7768 - DNA, 975 bp, Rhodopirellula baltica SH 1
  CDS (1)..(975): transl_table=11
atggcaaccgattttcggctgaaagagcagttaccagagctgaccgagcaaatcgtcagcacatacacctccgatgattcaatcaatcatttggggcactgcccattgcctagctacaccgccgtcgttgacatccttttggatctcaaggacatcctttacccgggttacaagcggcataccaatttgcatgccggcaacatccgctaccacgtcggcgggttgattgattccttgcacgatcagctgacgactcagatcgctcgtgctttacggcacgagcaccgcgtgctgcagaatcacaaggattgtgaaacggacatcgacttcgaagccaaaggccaagccatggcgatcgagttgctcaaacgcgtcgtgaaattgcggcacatgttggcgaccgatgttcaagccgctcacgatggcgacccggcttgccagacgaccgatgaagtcgtcttttgctaccccggtttcgaagcgatcacggtctaccgaatcgctcatgaactggtgcagctcaacgtgcctttcattcctcgaatgatgacggaatgggcgcacaaagaaactggcatcgacattcaccctggtgcgacgatcggtgagtacttcttcatcgatcacggaaccggtgtggtgatcggtgagacgtgccacattggaaagcacgtcaaactgtatcaaggtgtgacgcttggcgcattgagcttcccaaccgacgccgatggccagttgattcgcggccagaaacgtcatccgacgatcgaagacgaagtggtggtttacgccaacgcgacgatcttgggtggtcgcacagtgatcggtcgcgaatcggtgattggttcgagcgtttggatcactcgcagtgtctcgcccggcaccacggtggtactggagaaaccgcaactgaaggtacgtggctcggatgagcccgccgatgagttgcgtcccgaggtgaattaccaaatctga

SEQ ID NO: 7769 - protein, 324 aa, Rhodopirellula baltica SH 1
MATDFRLKEQLPELTEQIVSTYTSDDSINHLGHCPLPSYTAVVDILLDLKDILYPGYKRHTNLHAGNIRYHVGGLIDSLHDQLTTQIARALRHEHRVLQNHKDCETDIDFEAKGQAMAIELLKRVVKLRHMLATDVQAAHDGDPACQTTDEVVFCYPGFEAITVYRIAHELVQLNVPFIPRMMTEWAHKETGIDIHPGATIGEYFFIDHGTGVVIGETCHIGKHVKLYQGVTLGALSFPTDADGQLIRGQKRHPTIEDEVVVYANATILGGRTVIGRESVIGSSVWITRSVSPGTTVVLEKPQLKVRGSDEPADELRPEVNYQI

SEQ ID NO: 7770 - DNA, 816 bp, Haemophilus ducreyi 35000HP
  CDS (1)..(816): transl_table=11
atgaagcacatcgaacttaatcaaatgtggcaaaaaatccggcaagaagcccaacaattagccgatcaagaaccgatattggccagtttttttcatgctacaatccttactcaccataatttgggtagcgcgcttagctacattttagccaataaactagctaatgcaattatgcccgctattgcattaaaagaaattattgagcaggcttatgaagcagatccccaaattattgaaagtgccgcttatgatattaatgcagtcacaacacgagatcccgccgtagatagatggacaacaccactcctttatttaaaaggtttccacgccttacagagctatcgtgttacccattatctttggcaacaaggacgtcgcgatcttgcagtttatctacaaaatcaaatttccgtcgcgtttgatgtcgatattcaccctgccgcacgcttagggcatagcattatgtttgaccacgcaactgccatcgttattggcgaaaccgctgtcattgaaaatgatgtttctattttacaaggcgtaacattaggtgggacaggcaaagaacacggcgatcgccaccccaaaatccgtgaaggcgtaatgatcggtgcaggcgccaaaatcctaggcaatattgaaattggccgttattctaaaattggggctaactcagtagtcttacaagccgtaccggatcacactaccgcagcaggaatccccgctcgcattataggacgagcgccacaacaaaaacccgcattcgatatgaaccaatattttgaagaaattgaaggtacagatggtgatggcatttaa

SEQ ID NO: 7771 - protein, 271 aa, Haemophilus ducreyi 35000HP
MKHIELNQMWQKIRQEAQQLADQEPILASFFHATILTHHNLGSALSYILANKLANAIMPAIALKEIIEQAYEADPQIIESAAYDINAVTTRDPAVDRWTTPLLYLKGFHALQSYRVTHYLWQQGRRDLAVYLQNQISVAFDVDIHPAARLGHSIMFDHATAIVIGETAVIENDVSILQGVTLGGTGKEHGDRHPKIREGVMIGAGAKILGNIEIGRYSKIGANSVVLQAVPDHTTAAGIPARIIGRAPQQKPAFDMNQYFEEIEGTDGDGI

SEQ ID NO: 7772 - DNA, 747 bp, Prochlorococcus marinus subsp. marinus str. CCMP1375
  CDS (1)..(747): transl_table=11
atgcttaagtctttccactcagatctagaaatcattcgcgaaagagatccggccgcacggggttttatcgaaattctgctttgttaccctggttttcaagctctaattcttcataggattagtcacaaactatggaacattggactacctctatttcctagggtacttagccaaataactagatcattaactggaatagagatacatccaggtgccaaaataggaaaaggcgtttttattgatcatgggatgggagtcgttattggtgaaacagcagaaataggtaatagatgtttgctatatcaaggagttactcttggaggaacaggtaaaagccatgggaaaagacacccaaccttgtcagaaaatgtagtagttggagcgggagcaaaagttttaggagctattgcagtaggagcaaacacaagaattggtgctggctcagttgttgttagagatgtagaagctgatagcacagttgtaggcataccagggcgaattattcatcaaagtggggttcggattaaccctttggctcactcagctctaccagatgctgaagcaactgtaattcgcaatttgatgaaaagaattgattatttagaaagtcaagtgcaacttctaaccaataatctccaaacaattagtaagggaaatatgccaaataaaatcatttcaggagaagctcaaaatttaaaggatagagaaattattgaattccttggtgatacattaaaagaagattaa

SEQ ID NO: 7773 - protein, 248 aa, Prochlorococcus marinus subsp. marinus str. CCMP1375
MLKSFHSDLEIIRERDPAARGFIEILLCYPGFQALILHRISHKLWNIGLPLFPRVLSQITRSLTGIEIHPGAKIGKGVFIDHGMGVVIGETAEIGNRCLLYQGVTLGGTGKSHGKRHPTLSENVVVGAGAKVLGAIAVGANTRIGAGSVVVRDVEADSTVVGIPGRIIHQSGVRINPLAHSALPDAEATVIRNLMKRIDYLESQVQLLTNNLQTISKGNMPNKIISGEAQNLKDREIIEFLGDTLKED

SEQ ID NO: 7774 - DNA, 735 bp, Candidatus Blochmannia floridanus
  CDS (1)..(735): transl_table=11
atgtcttcgaataaagttgatatagtttggaataatatgataattgaggcaagattgttgattgattcagagcctatattaaaaaaatttttaaatgtaactttattgaatcatgataattttcaagatgctttagtttatttgttatttaaaaagttaaataatttagatatgatgacgattgatttaattgatatattgaaagatatatatagaactaatgatattattgatgcggcagctcaagatatttgtacgatacgtttacgtgatccgtctgtacaaaaatatctcactccttttttgtatttaaaaggatttcatgccttacaagcatatcgtattacgaactggttgtggaatcataattatccaggattggctatgtatttatataatcgtatttctattatttttaatgtagatattcatcctgctgctaaaattggttgtggaattatgttagatcatgcgactggagtggtaattggagaaactgctgtcatagatgataatgtatctattatgcagtctgttacgttaggaagtactggaaaaatagatggtaatcggcatccaaaaataaaaaaaggggttttaattggggcaggatctattattttaggtaatatcgaaataggttgtggatcaaaaattggtgctggatctattgtggtacactcagtaccgccttattcaacggtggttggaaggcctgctagattagtacaataa

SEQ ID NO: 7775 - protein, 244 aa, Candidatus Blochmannia floridanus
MSSNKVDIVWNNMIIEARLLIDSEPILKKFLNVTLLNHDNFQDALVYLLFKKLNNLDMMTIDLIDILKDIYRTNDIIDAAAQDICTIRLRDPSVQKYLTPFLYLKGFHALQAYRITNWLWNHNYPGLAMYLYNRISIIFNVDIHPAAKIGCGIMLDHATGVVIGETAVIDDNVSIMQSVTLGSTGKIDGNRHPKIKKGVLIGAGSIILGNIEIGCGSKIGAGSIVVHSVPPYSTVVGRPARLVQ

SEQ ID NO: 7776 - DNA, 954 bp, Bordetella pertussis Tohama I
  CDS (1)..(954): transl_table=11
atgagcggttcttcccattatcccgtcgccaactggaacctcgacggcatcgtctccggcctgcgcggcgcgcgccaggagtggcgcggcccgcgcggccgcctgcgcgaggagtccgagtcgggcgtgcgcgagtttccttcccaggaaagcctgcgcgacatcatgcggcaactgttcggcgcgctgtttcccatgcgcctgggccccatcgacctgcgcgaagaggtcgaggatttctacgtcggccacaccatcggcgccgcgctggacgcgctgctgcaccaggtctgcctggagctgcagcacctcggacgcgacgatccgcaaccctacggacaggtgctcgagcgcgcggtcgacatcgtgcgccgcttcggcgccgagttgccggcggtgcgcaaggcgctggacctggacgtcacggccgcctaccagggcgacccggccgcgcgcagcgtcgacgaagtgctgctgtgctatccgggcgtgaccgccatgatccaccaccgcctggccaatgtgctgtaccggctgggcgcgccgatgctggcgcgcatcgtcgccgagatcgcccattccgacaccggcatcgacatccatccgggcgcgaccatcgggcgcagtttcttcatcgatcacggcacgggcgtggtgatcggcgaaacggccatcatcggcgagcgcgtgcggctctaccagatggtcacgctgggcgccaagcgctttccgccgggcgagaacggcgaactcaagaaaggcctgccgcgccatcccatcatcgaggacgacgtggtcatctacgccggcgcgaccatcctgggccgcatcaccatcggccagggctcgaccatcggcggcaatgtctggctcacgcacagcgtgccgccgaacagcaccgtgacgcaggccggcgtgatcaacgacatgcccgactgcggcctgggcggctga

SEQ ID NO: 7777 - protein, 317 aa, Bordetella pertussis Tohama I
MSGSSHYPVANWNLDGIVSGLRGARQEWRGPRGRLREESESGVREFPSQESLRDIMRQLFGALFPMRLGPIDLREEVEDFYVGHTIGAALDALLHQVCLELQHLGRDDPQPYGQVLERAVDIVRRFGAELPAVRKALDLDVTAAYQGDPAARSVDEVLLCYPGVTAMIHHRLANVLYRLGAPMLARIVAEIAHSDTGIDIHPGATIGRSFFIDHGTGVVIGETAIIGERVRLYQMVTLGAKRFPPGENGELKKGLPRHPIIEDDVVIYAGATILGRITIGQGSTIGGNVWLTHSVPPNSTVTQAGVINDMPDCGLGG

SEQ ID NO: 7778 - DNA, 735 bp, Prochlorococcus marinus subsp. pastoris str. CCMP1986
  CDS (1)..(735): transl_table=11
atgctaagaactttcaagtcagatattgaaataataagagagagagatcctgcagcaagaggaattttagaaatttttctttgctatcctggtttccaatcaattatcgttcataggtttacccataaattatggttattaaagttacccttaattccgagattattaagtcatttaaatagattattaacaggaatagaaatacatccaggtgccaaaatcggggaaaaagtttttatagatcatggcatgggtgttgtcatcggcgaaacagctgaaattggtaataactgcttactttatcaaggagttacattaggaggaactggtaaaagtcatggcaaaaggcatccaacattaatggagaatgttgtagttggggcaggagcaaaagttctaggctcaataataattgggcaaaatactagaattggtgcaggttcagtcgttgttcgtaatgtcgaagaaaatagtactgttgttggaataccaggaagagtagttcatcaaagtggtgtaaaagttaatcccttagcacactctgctttaccagacgctgaagctaatgtaatcaaaaatttaatggacagaatagatcagcttgaaaaccaaatccttcaactacaaaatacccttcaatgtttggtaaattcagaatctaatgatatttctaaaattggcaatgcacaaaatctaaaagacaaagaaataatagaattcttaggagataactaa

SEQ ID NO: 7779 - protein, 244 aa, Prochlorococcus marinus subsp. pastoris str. CCMP1986
MLRTFKSDIEIIRERDPAARGILEIFLCYPGFQSIIVHRFTHKLWLLKLPLIPRLLSHLNRLLTGIEIHPGAKIGEKVFIDHGMGVVIGETAEIGNNCLLYQGVTLGGTGKSHGKRHPTLMENVVVGAGAKVLGSIIIGQNTRIGAGSVVVRNVEENSTVVGIPGRVVHQSGVKVNPLAHSALPDAEANVIKNLMDRIDQLENQILQLQNTLQCLVNSESNDISKIGNAQNLKDKEIIEFLGDN

SEQ ID NO: 7780 - DNA, 756 bp, Prochlorococcus marinus str. MIT 9313
  CDS (1)..(756): transl_table=11
atgctgaataatctccgcgcagactttgcgatcatccgtgagcgtgatccagcggccagaggcctcgttgagatcctgctttgctatccaggggttcacgcgctgatgatgcatcggctcagccatcgaatctggtcgaccagattgccgctgatcccaatgaaattgctagctcgcctcatcagccacttcagcagaagtcttactggagtggagatccacccaggagcgaaaattggcaatggtgttttcattgaccacggaatgggcgtggtgatcggcgaaacagcggaggtaggtgatcgttgcctgctttatcagggggtaactctgggtggcacaggcaaagatcacggcaagcgccaccccacgctggcaagcaacgtagtagtaggggccggagccaaagtacttggagcacttcacataggcagcaacactcggattggtgcgggatcagttgtggtaagtgacgtggaagccaactccacggttgtgggcattccaggtcgagtaatacatcagagtggcgcgcgaatagagcctcttgcacattcagctctaccagatgcagaagccaatgtgataagaaatctcatgggaaggattgatctgctagaagccaatatggaaacaatgcgcagaaaaatgcaagcaataaaagacggaaactcttacaatgaagagctatttggcgaatcgcagaatctcaaggataaggagattatagaatatataggggacaaaaaaatataa

SEQ ID NO: 7781 - protein, 251 aa, Prochlorococcus marinus str. MIT 9313
MLNNLRADFAIIRERDPAARGLVEILLCYPGVHALMMHRLSHRIWSTRLPLIPMKLLARLISHFSRSLTGVEIHPGAKIGNGVFIDHGMGVVIGETAEVGDRCLLYQGVTLGGTGKDHGKRHPTLASNVVVGAGAKVLGALHIGSNTRIGAGSVVVSDVEANSTVVGIPGRVIHQSGARIEPLAHSALPDAEANVIRNLMGRIDLLEANMETMRRKMQAIKDGNSYNEELFGESQNLKDKEIIEYIGDKKI

SEQ ID NO: 7782 - DNA, 747 bp, Synechococcus sp. WH 8102
  CDS (1)..(747): transl_table=11
atgttcgatcacatccgcgccgacttcgcgatcatccgtgagcgcgacccggcagctcgtggctggctagagatcatctgctgttatccaggctttcaggccctgagcctgcatcgcctcagccacagcctgtggcgtagcccactccccctgaagctggcagcccgctgcctcagccagatcagccgcaccctcaccggcatcgagattcatcccggagcccgcataggccgcagcgtattcatcgaccacggcatgggggtggtgatcggcgaaaccgccgaggtgggccaccgctgtctgctgtatcagggtgtgaccctgggtggcaccggcaaagaccacggcaaacgccatcccacgctggctgagaacgtggtggtgggagctggcgccaaggtgctgggggccatcaacatcggagccaacacccggatcggcgctggctctgtggtggtgcgtgatgtggacgccgattgcacggtggttggaatcccgggtcgggtgattcaccagagcggcgtgcggatcaatcccctggcccactccgccctaccggatgcggaagccaacgtgattcgcaacctgatggagcggatcgacgaactggagagcacggtgagcaatctgcagcgctgtctcaaggaagttgcagaagggcgtcagctgcgggacgtctgccgtggcgagtcccaaagccttaaagatcgagagatcttggagtttctgggggaaaacacaggctga

SEQ ID NO: 7783 - protein, 248 aa, Synechococcus sp. WH 8102
MFDHIRADFAIIRERDPAARGWLEIICCYPGFQALSLHRLSHSLWRSPLPLKLAARCLSQISRTLTGIEIHPGARIGRSVFIDHGMGVVIGETAEVGHRCLLYQGVTLGGTGKDHGKRHPTLAENVVVGAGAKVLGAINIGANTRIGAGSVVVRDVDADCTVVGIPGRVIHQSGVRINPLAHSALPDAEANVIRNLMERIDELESTVSNLQRCLKEVAEGRQLRDVCRGESQSLKDREILEFLGENTG

SEQ ID NO: 7784 - DNA, 783 bp, Chromobacterium violaceum ATCC 12472
  CDS (1)..(783): transl_table=11
atgagttccaccctggttgatccgctgtggtcggccatccgcgacgaaacgctggcggcggtcaacgacgagccgctgctggccagtttcctgcacatgaccgtattgcgccacgccacgctggaagacgtgctggccttccacctgtccaccaagctcgccagtccggtgatggatccccgcgcgctgcaggagctgttccgcgaggccttccaggccgatccggcgatcagcgccgcgctgcgcgccgacatccgcgcctgtttcgagcgcgatcccgcctgcgaccgctactccacgccgctgctgtacttcaagggcttccacgcgatccagagtcagcgcgtcacccactggctgtggcagcaggggcggaccacgctggcgctgttcctgcagaaccgcatttccgaggtgaccggcgccgacatccaccccgccgcgcgcgtcggccagggcgtgatgctggaccacggcaccggcctggtggtcggcgaaaccgccgtcatcggcaataacgtctccatcctgcacggcgtcaccctgggcggctccggcaaggatcgcggcgaccgccatcccaagataggcgacggcgtgatgctgggcgcgggcgccgcggtgctgggcaacatccgcgtcggcgaatgcgcgaaagtgggcgccggcagcgtggtgctggaagacgtgccgccgcacgcgaccgtggccggcgtgccggcgcgggtggtggcccaggcctgtccgggcaccccggcgctggacatggaccagcgagtgtga

SEQ ID NO: 7785 - protein, 260 aa, Chromobacterium violaceum ATCC 12472
MSSTLVDPLWSAIRDETLAAVNDEPLLASFLHMTVLRHATLEDVLAFHLSTKLASPVMDPRALQELFREAFQADPAISAALRADIRACFERDPACDRYSTPLLYFKGFHAIQSQRVTHWLWQQGRTTLALFLQNRISEVTGADIHPAARVGQGVMLDHGTGLVVGETAVIGNNVSILHGVTLGGSGKDRGDRHPKIGDGVMLGAGAAVLGNIRVGECAKVGAGSVVLEDVPPHATVAGVPARVVAQACPGTPALDMDQRV

SEQ ID NO: 7786 - DNA, 714 bp, Wolinella succinogenes DSM 1740
  CDS (1)..(714): transl_table=11
atgagtcgccttagagagttcttttcgatcatcaaagaggacttcgccgttgtttttgaaaaagatcccgcgattcgctctagagtcgagctctttttcaactatccaggcctcatcgccattgtccaccatcgattcgcccacgctcttcaccgccgaggctttagagtagtggcgcggattcttatggctttcaaccagtttgtgaccaatattgatattcatcccggagccactattgggcgccgtgtctttatcgatcatggaattggcgtggtcatcggcgagacagctatcgtaggagatgatgttaccatttatcaaggggtgagcctaggaggagtgagcctagagcgcaccaagcgccatcccaccatcgaagagggagtggtgattggtgcgggagcgaaaatcctcggcaatattaccattggagcccattccaaaattggtgccaactccgttgtgattcggagtgttcccgccgattcaaccgctgtgggcattcccgctagagtgattgataaaggccggagcaaagacccaagcgacatgggcaaactacctgatattgacaaacaactctttgaatacctgctcaagcgagtcgctcttttggagcatgcactcaaaagcgatcacaaagagttggacagtcgaggcgaagagttagagaaaatttacgaatcgtttgtgaagagtttaagaagctag

SEQ ID NO: 7787 - protein, 237 aa, Wolinella succinogenes DSM 1740
MSRLREFFSIIKEDFAVVFEKDPAIRSRVELFFNYPGLIAIVHHRFAHALHRRGFRVVARILMAFNQFVTNIDIHPGATIGRRVFIDHGIGVVIGETAIVGDDVTIYQGVSLGGVSLERTKRHPTIEEGVVIGAGAKILGNITIGAHSKIGANSVVIRSVPADSTAVGIPARVIDKGRSKDPSDMGKLPDIDKQLFEYLLKRVALLEHALKSDHKELDSRGEELEKIYESFVKSLRS

SEQ ID NO: 7788 - DNA, 735 bp, Gloeobacter violaceus PCC 7421
  CDS (1)..(735): transl_table=11
atgtacaaaaccctggcaagcgtcgtcgctaccatccgggaagacttccaggccgccttcgagaaagacccggccgcgcgttcgtggtttgaagtgctgacttgttatccgggtctgcacgccgtcgccgtccaccgcttcgcccatcttctgtacgcccgccgctggttctggccggcgcgctttttatcgcacatcgcccgctggctgaccggcgtcgagattcatccgggggccaccatcggcgcgggcatcttcatcgaccacggcatgggcgtggtgattggtgaaaccgccatcatcggccgcgacgcgctgatctaccagggcgtcaccatcggcggcaccggcaaacaaaagggcaagcgccaccccaccctaggcgacaacgtcgtggtcggcgccggggcaaaagttttgggaaatatcgaaatcggcaacaacacccgcatcggggccgggtcggtggtactgcgcacggtgcccagcgactgcacggtggtgggtgtacccggccgggtggtctatcaggacggcgagcgcatcgatccgctcgcccacggccaggtgcccgacccactcgccgatgtgatccgctcgctggtccgccgcatcgacgaactcgaaagcgaagtgcaacagttgcgcaccgacaaaaccgggaaaccggcagctccgagttgcgccatcgaggcgcgcttgctcgaagactttttgcacggcccggggatctag

SEQ ID NO: 7789 - protein, 244 aa, Gloeobacter violaceus PCC 7421
MYKTLASVVATIREDFQAAFEKDPAARSWFEVLTCYPGLHAVAVHRFAHLLYARRWFWPARFLSHIARWLTGVEIHPGATIGAGIFIDHGMGVVIGETAIIGRDALIYQGVTIGGTGKQKGKRHPTLGDNVVVGAGAKVLGNIEIGNNTRIGAGSVVLRTVPSDCTVVGVPGRVVYQDGERIDPLAHGQVPDPLADVIRSLVRRIDELESEVQQLRTDKTGKPAAPSCAIEARLLEDFLHGPGI

SEQ ID NO: 7790 - DNA, 822 bp, Photorhabdus luminescens subsp. laumondii TTO1
  CDS (1)..(822): transl_table=11
atgtcgctagaagaattggacgaagtttggaagaacataaaaacagaagcgagagcactggctgaatgtgaaccgatgttggccagtttttttcatgcaacattactcaagcatgaaaatcttggtagtgctttaagttatatgctggcgaataagctggctacgccgattatgccggctattgctgttagagagatcgtagaagaggcttatggctcggatcaaaaaatgattgtctctgctgcccgcgacatcatagcggtacgtctacgcgatcccgccgtagataaatactcaacacctctgctgtacctcaaagggtttcatgctctccaagcctatcgtattgcccattggatctggggagaagaccgtaaagcattggctatttatctgcaaaaccaaatctcgatgtcttttggcgttgatattcacccggcagcaaagattggttgtggcattatgcttgaccacgccactggcattgtgattggcgaaacggcggtagtggaaaatgacgtttctatcctgcaatccgtcacccttggtggtacgggtaaaaccgggggtgatcgtcatccgaaagtcagggaaggggtgatgattggtgcaggttcgaaaatattgggtaatattgaaattggtcgtggggctaaaattggcgcaggttcagttgtccttcgctctgttccaccgcacacaacagccgctggagtgcctgcccgtattgtcggtaaacctgaaagcgaaaagccatcattggatatgaaccagcattttaatggtatcaaccatggctttgagtatggggatgggatttaa

SEQ ID NO: 7791 - protein, 273 aa, Photorhabdus luminescens subsp. laumondii TTO1
MSLEELDEVWKNIKTEARALAECEPMLASFFHATLLKHENLGSALSYMLANKLATPIMPAIAVREIVEEAYGSDQKMIVSAARDIIAVRLRDPAVDKYSTPLLYLKGFHALQAYRIAHWIWGEDRKALAIYLQNQISMSFGVDIHPAAKIGCGIMLDHATGIVIGETAVVENDVSILQSVTLGGTGKTGGDRHPKVREGVMIGAGSKILGNIEIGRGAKIGAGSVVLRSVPPHTTAAGVPARIVGKPESEKPSLDMNQHFNGINHGFEYGDGI

SEQ ID NO: 7792 - DNA, 567 bp, Corynebacterium diphtheriae NCTC 13129
  CDS (1)..(567): transl_table=11
atgtacaggcttgtcaagacgatccgcgaagacctagcgaacgcccgcgaacacgaccccgcggctcgcagcgacgcagaaaacgccatcgtttactcaggactccacgccatctggagccaccgtatcgcccacgcactatggcagaaaaaccttaaaggccccgcccgcatcctcgcccaattcacgcgatttctcactggtgtagaaatccaccccggagccaccatcggacgtcgattcttcatcgaccacggaatgggtatcgtcatcggcgaaaccgccgaaattggcgacggagtcatgctctaccacggcgtaaccctaggcggacaggtgctaacccaaaccaaacgccaccccaccgttgaagacgatgtggttatcggtgcaggcgccaaagtcctaggccccatcaccatcggcaaaggaagcgccatcggtgccaacgccgttgtgaccaaagacgtccccgccaaccacatcgctgtgggaatccccgcagccaaccgcccccgcggcgccgacgaaaaaatcaaactcgtcgaccccgactactacatctaa

SEQ ID NO: 7793 - protein, 188 aa, Corynebacterium diphtheriae NCTC 13129
MYRLVKTIREDLANAREHDPAARSDAENAIVYSGLHAIWSHRIAHALWQKNLKGPARILAQFTRFLTGVEIHPGATIGRRFFIDHGMGIVIGETAEIGDGVMLYHGVTLGGQVLTQTKRHPTVEDDVVIGAGAKVLGPITIGKGSAIGANAVVTKDVPANHIAVGIPAANRPRGADEKIKLVDPDYYI

SEQ ID NO: 7794 - DNA, 948 bp, Rhodopseudomonas palustris CGA009
  CDS (1)..(948): transl_table=11
atgtcgcaatccgccgagccccgtgtcgtcactgagccagcatgggacctcggcgagatcgtcgccgaactcgcggggctccgcgcgatctctcagcgccggcgctatcgcagccggtcactgccggagctgccgtcgcgcgaagcggttgccggaatcgtcgatgccctggttgcggcgttgtatccgcgccacttcggaccggcgggactgtcggaagacagtctcgacatctacgtcgccgacaccatcgagcaggcgctgcgccggctgcgccgcgaggtcggccgcgagttgcgccttgctgatctcgacggcgccgcgaaacccggcgagatcgaacagcaggcgctgaccatcgcggcggatttcgcccacgacctgccgcggattcgcgcgctcctcgacagcgacatccgcgccgccttcgacggtgatccggcagcgaagagcctggacgaagtcgtgttctgctatccgggcgtcgccgcgatgatccggcatcgcatcgctcaccggctgtacgtgctcggggtgccgatgctggcgcggatcgtcgccgagatcgcccatgcgcagaccggcatcgacattcatcccggcgcgaccatcggcgagagcttcttcatcgatcacggcaccggcgtggtgatcggcgagaccgcgcggatcggcaagcgggtgcggctgtatcaggcggtgacgctcggcgccaagcggttcgagaccgacgagcacggccgcatcgtcaagggcggcgaccgtcacccgatcatcgaggacgaggtcgtaatctatgccggcgccacggtgcttgggcgggtgacgatcgggcagggctcgtcgattggcggcggcgtctggctgacgcgcgacgtgccgccgaacagcgtcatcacccaagccaaggcgcgccacgacgctttcgaggacggtggcggtatctga

SEQ ID NO: 7795 - protein, 315 aa, Rhodopseudomonas palustris CGA009
MSQSAEPRVVTEPAWDLGEIVAELAGLRAISQRRRYRSRSLPELPSREAVAGIVDALVAALYPRHFGPAGLSEDSLDIYVADTIEQALRRLRREVGRELRLADLDGAAKPGEIEQQALTIAADFAHDLPRIRALLDSDIRAAFDGDPAAKSLDEVVFCYPGVAAMIRHRIAHRLYVLGVPMLARIVAEIAHAQTGIDIHPGATIGESFFIDHGTGVVIGETARIGKRVRLYQAVTLGAKRFETDEHGRIVKGGDRHPIIEDEVVIYAGATVLGRVTIGQGSSIGGGVWLTRDVPPNSVITQAKARHDAFEDGGGI

SEQ ID NO: 7796 - DNA, 828 bp, Rhodopseudomonas palustris CGA009
  CDS (1)..(828): transl_table=11
atggtgatgcatcagatcaatccgcagagtgcgaacgtgacggcgctcgatccgatctgggagcgggtgcggaacgaagccgaagacatcgttcggcgcgagcccgagctggcatccttcatctttgcgagcgtgctgcatcacgatcgtctggaagacgcggtggtgcatcgcgtggcggagcggctcgatcatgcggcgctgtccggcgatctgatccgccagacttacgaagacgccctgcgcgatcaacctgacatcggcaacgcgtttcgcgccgatatggtggcggtgttcgatcgcgatccggcgacctcgcgcttcatcgacccgctgctgtactacaagggcttccacgccattcagacgcatcgtctggcgcattggctgttcggcaagggtcgcaaggatttcgcgctctatttgcagagccgcgcatcggcggtgtttcagaccgacatcaatccagcggcaaagatcggccgcggcatcttcctcgatcatgccaccggcctagtggtcggcgagaccgctgtcatcgacgacgacgtttcgatcctgcacggcgtcacgctcggtggtaccggcaaggagcacgaggatcgccatccgaagatcaggcgcggcgtcatgatcggcgccggcgcaaagattctcggcaacatcgaagtcgggcactgcgcgcgcattgctgcggggtcggtggtgctgaagtcggtgccgcacaatatgactgtcgccggtgtgccggccaaggtggtcggcgaggccggctgcgccgagccgtcacgcaccatggatcagatgatcaacgcgatcgggctctaa

SEQ ID NO: 7797 - protein, 275 aa, Rhodopseudomonas palustris CGA009
MVMHQINPQSANVTALDPIWERVRNEAEDIVRREPELASFIFASVLHHDRLEDAVVHRVAERLDHAALSGDLIRQTYEDALRDQPDIGNAFRADMVAVFDRDPATSRFIDPLLYYKGFHAIQTHRLAHWLFGKGRKDFALYLQSRASAVFQTDINPAAKIGRGIFLDHATGLVVGETAVIDDDVSILHGVTLGGTGKEHEDRHPKIRRGVMIGAGAKILGNIEVGHCARIAAGSVVLKSVPHNMTVAGVPAKVVGEAGCAEPSRTMDQMINAIGL

SEQ ID NO: 7798 - DNA, 678 bp, Geobacter sulfurreducens PCA
  CDS (1)..(678): transl_table=11
atgtttgcacgactgcgcgaggatattcaatcggtgctcgaccgcgatcccgctgcccgcagcacgctggaagtgctctgttgctacccggggctgcacgccatctggtttcaccggctggcgaacctgctctggcggagcgatttccatttcctgggccgccttgtttcccacgtgggccgttttctcaccggcatcgagatccatccgggagcgaccatcggccggcgccttttcatcgatcacggcatgggggtagtgatcggcgagacggccgaaatcggcgacgacgtgaccatctaccacggggtgaccctcggcggggtcagcctggagaagaagaagcggcaccccaccgtggagagcaacgcggtcatcggttccggcgccaaggtcctgggtccgttcaccgtgggcgagggggccaagattggctccaattcggtggtggtgaaggaggtcccggccaatgccaccgtggtgggcatccccggccgggtggtcatggccgcggagaagccgaaggacaagtccgatttcgagcacggcaagctgcccgacccggaagccaaggccatttcctgtctcttcgaacagatccgggagctggagcgcaagtacggcgaactggccgccgagcacgaggcgctgaagcgccgcctggatggggggaattag

SEQ ID NO: 7799 - protein, 225 aa, Geobacter sulfurreducens PCA
MFARLREDIQSVLDRDPAARSTLEVLCCYPGLHAIWFHRLANLLWRSDFHFLGRLVSHVGRFLTGIEIHPGATIGRRLFIDHGMGVVIGETAEIGDDVTIYHGVTLGGVSLEKKKRHPTVESNAVIGSGAKVLGPFTVGEGAKIGSNSVVVKEVPANATVVGIPGRVVMAAEKPKDKSDFEHGKLPDPEAKAISCLFEQIRELERKYGELAAEHEALKRRLDGGN

SEQ ID NO: 7800 - DNA, 825 bp, Yersinia pestis biovar Microtus str. 91001
  CDS (1)..(825)
atgatgtcgtcagaagagttagaacaggtctggagcaacataaaatcagaagcaagggcactggctgaatgtgaaccgatgctggctagcttttttcatgcaacactcttgaagcatgagaatttgggcagtgcgctgagttatattctcgcgaataagttggctaatcctatcatgccagcgattgctatccgtgaagtggttgaagaagcttatcgttcagatgcgcatatgatcgtttccgctgcccgcgatattctggccgtccggttacgcgatccagccgttgataaatactccacaccgttactgtatctcaaaggttttcatgctttgcaggcttatcgtattggccattggttgtgggcgcaggatcgtaaagcgctggcgatttatctgcaaaatcaagtctctgtcgcatttggtgtggatatccaccctgcggcaaccattggttgtggcatcatgctggaccacgctaccggtatcgttattggtgaaacggctgtggttgagaatgacgtgtctattctgcaatctgtcacgcttggggggacgggcaaaaccagtggcgaccgccatccaaaaatccgtgaaggtgtcatgattggcgcaggcgcgaaaattctcggcaatatcgaggtgggccgtggtgcgaagattggtgccggttcagttgtactacaatcggtacccgctcacacgacggctgccggtgtacctgcccgtatcgttggtaaaccagagagtgataaaccctcgttggatatggatcagcatttcaatggcagcattcagggctttgaatatggcgatggtatttaa

SEQ ID NO: 7801 - protein, 274 aa, Yersinia pestis biovar Microtus str. 91001
MMSSEELEQVWSNIKSEARALAECEPMLASFFHATLLKHENLGSALSYILANKLANPIMPAIAIREVVEEAYRSDAHMIVSAARDILAVRLRDPAVDKYSTPLLYLKGFHALQAYRIGHWLWAQDRKALAIYLQNQVSVAFGVDIHPAATIGCGIMLDHATGIVIGETAVVENDVSILQSVTLGGTGKTSGDRHPKIREGVMIGAGAKILGNIEVGRGAKIGAGSVVLQSVPAHTTAAGVPARIVGKPESDKPSLDMDQHFNGSIQGFEYGDGI

SEQ ID NO: 7802 - DNA, 840 bp, Apis mellifera
  CDS (1)..(840)
atgatgaaaaaaaaatttggtcaatctcttcatccaattgcacctactcaaaacgcaatgaatgatccgaataacctattagcgagcggccccgacagccacgaaataaaccttcaagccttgtgggaaaaaatggttcaagaaagcaatggatgttgtgatcctttgttatccagtttttttgatacatgcattcacagccatcatgatttcaaaaccgccctgacttgtatgataggacgcaaattagaggatgcctccatcccctatcaggcattaactgatttaatcaaacaagtgtacagaaccaatccgcctctcatttccatagctgcagccgatttgatcgcggttatgatgagagacgcagcatgctccgatttaattacaccatttctatttttcaagggattccactccattcaggcccatcgcatttcccattggctatggcataatcaaagacgctatctggcacttcatttacaaagccgtatttcggaagtgtttggggttgatatacatcctgccgcccgtctgggacagcgaatcatgatagatcacgccacttctgttattattggggaaaccgctgttgtagaagatgacgtttcaatattacaagaagttacccttgggggaacgggcaaagatgaaaaagaccgtcatcccaaaatccgtcggggagtcttaatcggtgcaggtgcaaaagtattaggaaatgtggaaattggagaaggagccaagattggtgcagggtcaattgttttagaagcagtcaaaccttacacaaccgtagttggcaatcctgcccgacaaatcgggtcttccccctattga

SEQ ID NO: 7803 - protein, 279 aa, Apis mellifera
MMKKKFGQSLHPIAPTQNAMNDPNNLLASGPDSHEINLQALWEKMVQESNGCCDPLLSSFFDTCIHSHHDFKTALTCMIGRKLEDASIPYQALTDLIKQVYRTNPPLISIAAADLIAVMMRDAACSDLITPFLFFKGFHSIQAHRISHWLWHNQRRYLALHLQSRISEVFGVDIHPAARLGQRIMIDHATSVIIGETAVVEDDVSILQEVTLGGTGKDEKDRHPKIRRGVLIGAGAKVLGNVEIGEGAKIGAGSIVLEAVKPYTTVVGNPARQIGSSPY

SEQ ID NO: 7804 - DNA, 1179 bp, Chlamydomonas reinhardtii
  CDS (1)..(1179)
atgcggagcgtcttcagtgatacttgctcggcggcgccaagcacttctcggccgcacgcagtatcagtaattccatcacggccgcggcgctatgctggtggccgcacgcttggtggacacacgctcctaagcagtcggaatgtcggcagcgttgctgtcaacactatggcccgggaccggttgtcagcccaggagcgggaggagctcgaggccgtgcgggcacgcctgaaccagcagctacagcttgtaacgggggtatctccctcggcatcatctgatctctcagtggatgagcggccaacactgctggcgaaagcgaacaactgcccatgcgaggacgaggtgcacccctccaacgggtggcggcccatgccccaccacctatcaaagccggagctgtgggagcggatacggcaggaggcgcagatggatgcgtcctcggagcctgcccttgccagcaacctgttcagcaccatcctggcccaccccagcctggagaagtccatggcgttcctgctggccaacaagctagccaaccccaccatgctgggcatgcagctcatgcgcctcatcagcgaggcgtacgaggacgatgctggactcatcgaggcgtgcatggcggacttgcaggccgtgtacgaccgcgaccccgcctgcgacagcttctcgcaggccatgctgtacttcaagggcttccaggccatccagtgccaacgagtggcgcactggctatggcagaaaggccgcaaggccctggcgctggccatccagagccgcatgtctgaggccttccacgtggacatccaccccgcggcgcagctggggcgcgggctgttgatagaccacgccacgggtgtggtgatcggcgagacggcggtggtgggcgacaacgtgtccatgctgcaccacgtcacgctgggcggcagcggcacggggcgcggcgtgcgccaccccacggtgggcaacggcgtgctgctgggcgcgggtgtgacggtgctggggcccatcaccgtgggcgccggcagcaaggtgggcgcgggcagtgtggtggtcagcgacatcccctgccacagcgtggcggtgggtgtgccggcccgcatcatcaagcgcgacatcgtgaaggagccggtcaaggagatggaccagtgcactgactacatccttgactacaccatctag

SEQ ID NO: 7805 - protein, 392 aa, Chlamydomonas reinhardtii
MRSVFSDTCSAAPSTSRPHAVSVIPSRPRRYAGGRTLGGHTLLSSRNVGSVAVNTMARDRLSAQEREELEAVRARLNQQLQLVTGVSPSASSDLSVDERPTLLAKANNCPCEDEVHPSNGWRPMPHHLSKPELWERIRQEAQMDASSEPALASNLFSTILAHPSLEKSMAFLLANKLANPTMLGMQLMRLISEAYEDDAGLIEACMADLQAVYDRDPACDSFSQAMLYFKGFQAIQCQRVAHWLWQKGRKALALAIQSRMSEAFHVDIHPAAQLGRGLLIDHATGVVIGETAVVGDNVSMLHHVTLGGSGTGRGVRHPTVGNGVLLGAGVTVLGPITVGAGSKVGAGSVVVSDIPCHSVAVGVPARIIKRDIVKEPVKEMDQCTDYILDYTI

SEQ ID NO: 7806 - DNA, 1443 bp, Chlamydomonas reinhardtii
  CDS (1)..(1443)
atgagctttccatgcttaggctcaaaacacgcgctgtctggcgcctcaagccgagcgcagcaaagcgtcgtcgctcgggtgtggttcgctcgcggaggcagcggtcgccggtgttcaccagtgctcgcgagcaacacggagccagccagttcgaaaccatcaaaagcatcaaataacaaaatgtctccggaggattccatagattggacgcgagcgggtgtgcccgcctacctgcagagcaacgtcgacttcaatatttgcggcgaggaatcgcaggcgctgacgcttggccgcgcgggcgagatgatgtggaagcagattcgcactgaggcccaggcggacgccaacagcgaaccgctgctgtcttccttcctgtacgcatccatcctggcgcacgacacgtttgagcaggcgctggcgttcgtactggccaaccgcctcgccaacagcaccatgctgtccacgcagctgtttgagatcttccacaacttcctcagcaaagagcctgacgtgcgctgcgccgcgctgtcggaccttgcggcgtgtcgcgagcgcgaccctgcctgtagctcctacagccacgcgctgctgtacttcaagggctaccacgccattcagacgcagcgcatcgcgcacgcgctgtggaaccgcaagcagaaggtcatggcactggcgctgcagagccgcatctcggaggtgttcgcggttgacgtccacccagcggcccgcatcggcaagggtgtgctgctggaccacggcacgggtgtggtgatcggcgagacggccgtcatcggcaacaacgtatcaatcctgcagaacgtgacgctaggcggtaccggcaaggagatcggcgaccgccaccccaaggtgggggacaacgtgctcatcggggcctgcgccacagtgctgggcaacatccccatcggcgagggcgcgcagatcgcggctggctcgctggtgctcaagcccgtgccgccgcacaccatggtggcgggctcgccggccaaggaggtggggccggtggtcggcaaccccgcgctgtcgatgatgcactggagccagcggcttctgagtgcggaaagcatggacggcgccggcggcgtgggcatgaacggcgtgccattggccgcggccatggccccagtgaacggcctcgcaaacgggattgcaaagccggccgccaaggtggcgctagggaaagcggcggcagcggccgccgcggcgtctgccagcgcagcgcccgcgtctgccgctgcctcggtgcaggcggcaaagaaagcggccgcgaagctcggcggcgcggcgaaggcggcggccgctgggtcgcctgcagcgccggcgggcaaggcgggcactcccagcggggacgtgtctcagaagcaggggcgcgtggcacggagtgaggttatccggaagaagccggcgcctgagtatgagatttag

SEQ ID NO: 7807 - protein, 480 aa, Chlamydomonas reinhardtii
MSFPCLGSKHALSGASSRAQQSVVARVWFARGGSGRRCSPVLASNTEPASSKPSKASNNKMSPEDSIDWTRAGVPAYLQSNVDFNICGEESQALTLGRAGEMMWKQIRTEAQADANSEPLLSSFLYASILAHDTFEQALAFVLANRLANSTMLSTQLFEIFHNFLSKEPDVRCAALSDLAACRERDPACSSYSHALLYFKGYHAIQTQRIAHALWNRKQKVMALALQSRISEVFAVDVHPAARIGKGVLLDHGTGVVIGETAVIGNNVSILQNVTLGGTGKEIGDRHPKVGDNVLIGACATVLGNIPIGEGAQIAAGSLVLKPVPPHTMVAGSPAKEVGPVVGNPALSMMHWSQRLLSAESMDGAGGVGMNGVPLAAAMAPVNGLANGIAKPAAKVALGKAAAAAAAASASAAPASAAASVQAAKKAAAKLGGAAKAAAAGSPAAPAGKAGTPSGDVSQKQGRVARSEVIRKKPAPEYEI

SEQ ID NO: 7808 - DNA, 735 bp, Prochlorococcus marinus str. AS9601
  CDS (1)..(735): transl_table=11
atgctaagaacttttaaatcagatatagaaattatcagagagagagatcctgcagctagaggaataatagaaatatttctttgctaccctggtttccaatccatagttatacataggtttacgcataagttatggcaattaaagattcctttaattccccgcatactcagtcatcttaataggctagcgacaggcattgaaatccatccaggggcaaaaattggtaaaagagttttcatagaccatggaatgggcgttgtaattggcgaaacagctgagataggaaataattgtttgctatatcagggagtgacattaggaggtactggtaaaagccatggcaaaagacacccaacattgatggaaaatgtcgtagttggagcaggcgcaaaagtacttggatctattacggtaggacctaatacccgtattggcgctggctcagtagttgttagaaatgtagatgggaacagtactgtggttggagtgcctggcagggtagtgcatcaaagtggtgtcaaagtcaatccattagctcactctgccttaccagatgcagaagctaatgttataaaaaatttaatggatagaatagactctctcgaaaatgaaatacttaaattacaaagaactctacaatgtatagctagctcggaatctattgatatttctaaactcggtgattctcaaaatcttaaagacaaagaaatttttgaatatcttggagatgattaa

SEQ ID NO: 7809 - protein, 244 aa, Prochlorococcus marinus str. AS9601
MLRTFKSDIEIIRERDPAARGIIEIFLCYPGFQSIVIHRFTHKLWQLKIPLIPRILSHLNRLATGIEIHPGAKIGKRVFIDHGMGVVIGETAEIGNNCLLYQGVTLGGTGKSHGKRHPTLMENVVVGAGAKVLGSITVGPNTRIGAGSVVVRNVDGNSTVVGVPGRVVHQSGVKVNPLAHSALPDAEANVIKNLMDRIDSLENEILKLQRTLQCIASSESIDISKLGDSQNLKDKEIFEYLGDD

SEQ ID NO: 7810 - DNA, 735 bp, Prochlorococcus marinus str. MIT 9515
  CDS (1)..(735): transl_table=11
atgttgagaaattttagatcggacattgaaataataagagaaagagatccagcagcaagaggtattttagagattttcctttgctatcctggtttccaatcaattgtaatgcatagattaactcataaattatggctattaaaagtacctttaattcctagaatattaagtcacttgaatagattatttactggaatagaaatacatccaggtgcaaaaatagggaaaaaagtttttatagatcatgggatgggagttgtgattggtgaaacagctgaaattggcaacaattgcttactttatcaaggagttactttagggggcactggcaaaagtcatgggaaaagacacccaactttaatggaaaatgtagtagtaggagcaggagcaaaagtcctcggttcaataatagttgggcctaatactcgcattggggcaggttctgttgttgttcgtaatgtagaagaaaatagtactgttgttggcatccctggaagagtagttcatcaaagtggtgtcaaagttaatccactagcacactctgcgttaccagatgctgaagccagtgtcattaaaaacttaatggatagaattgatcaactcgagaatcaagttcttagattaaataaaaccttaagaactttagtgaaaacagaatctatggatattacaaaaatcggtgatgcacaaaatataaaagacaaagaaataatagaattcttaggagataattaa

SEQ ID NO: 7811 - protein, 244 aa, Prochlorococcus marinus str. MIT 9515
MLRNFRSDIEIIRERDPAARGILEIFLCYPGFQSIVMHRLTHKLWLLKVPLIPRILSHLNRLFTGIEIHPGAKIGKKVFIDHGMGVVIGETAEIGNNCLLYQGVTLGGTGKSHGKRHPTLMENVVVGAGAKVLGSIIVGPNTRIGAGSVVVRNVEENSTVVGIPGRVVHQSGVKVNPLAHSALPDAEASVIKNLMDRIDQLENQVLRLNKTLRTLVKTESMDITKIGDAQNIKDKEIIEFLGDN

SEQ ID NO: 7812 - DNA, 753 bp, Prochlorococcus marinus str. NATL1A
  CDS (1)..(753): transl_table=11
atgtttcgatcactaaagtcagatttcgcaattatcaaagaaagggatccagctgcgagaagcctttgggaaataatattttgttatccaggctttcaggccctagtcatgcatagaatcagtcataaactttggacatataaacttcctctctttccaaggttaattagccacttcactagatttttgactggtgttgagatacatccaggtgcaaggattggtagaggagtgtttatagatcatggtatgggcgttgtgattggagaaacaagcgaaataggtgatcgttgcttgctatatcaaggtgtaactttgggtggtactggtaaagaaagtgggaaaagacacccaactcttgaaactaatgtagttgtgggtgcgggcgctaaagtccttggaggaatttgcgtagggactaatacaaggatcggggctggatcagttgtagtaaagaatgttgaggcaaatagtactgttgtaggaattcctggacgagtagttcatcagagtggagtaaaaatcaatcctctagctcattctgcattgccagatacagaagccaacgtattgagaaatcttatggaaagaattgatcaattagaaagtgatattctgggcctgcaagatctagtagttaaaattcaaactaatagaaataaagatgatataattattggtgaatcacagaacttaagagataaagaaataatagagtttattggagataatatagaagaagaaagtgggtag

SEQ ID NO: 7813 - protein, 250 aa, Prochlorococcus marinus str. NATL1A
MFRSLKSDFAIIKERDPAARSLWEIIFCYPGFQALVMHRISHKLWTYKLPLFPRLISHFTRFLTGVEIHPGARIGRGVFIDHGMGVVIGETSEIGDRCLLYQGVTLGGTGKESGKRHPTLETNVVVGAGAKVLGGICVGTNTRIGAGSVVVKNVEANSTVVGIPGRVVHQSGVKINPLAHSALPDTEANVLRNLMERIDQLESDILGLQDLVVKIQTNRNKDDIIIGESQNLRDKEIIEFIGDNIEEESG

SEQ ID NO: 7814 - DNA, 744 bp, Prochlorococcus marinus str. MIT 9303
  CDS (1)..(744): transl_table=11
atgctcacagccataaagaccgacctagcaatcatcaaagaacgagatccagcagcccgagacctgcttgagatcctgctttgctatccgggctttcaggccttgacactgcatcgaatcagtcaccgactttggcgctccggattacctttgctgccacgactactcagccagatcacacgtgccctgactggcatagagatccatccaggcgcccagatcggtcacggagtattcatcgatcacggcatgggtgttgtgatcggagaaacaacggagatcggcaaccgctgcttgctctatcaaggcgtaacgctcggtggcacaggcaaagagcacggcaaacgccatccaaccctggcagaaaacgttgtcgttggagcgggcgccaaagttcttggcgcaattcacgtgggggccaatacgagaatcggtgccggatcagtcgttgtacgggacgttgaagccgacagcacggttgtgggtatcccagggcgagtggtgcatcaaagcggtgtccgtatcaatccattagcccactcagcactaccagactcagaggccgatgtcatacgcaacctgatggagcgtatcgaccaactagaaaatcaggtgacagcgttgcattctttcctacaagagctaagtactgatcgtgttcctcaagatcttcaaactggacaagctcaaaacctcaaagacagggaaatcattgagttcctaggggatactcccagaagctga

SEQ ID NO: 7815 - protein, 247 aa, Prochlorococcus marinus str. MIT 9303
MLTAIKTDLAIIKERDPAARDLLEILLCYPGFQALTLHRISHRLWRSGLPLLPRLLSQITRALTGIEIHPGAQIGHGVFIDHGMGVVIGETTEIGNRCLLYQGVTLGGTGKEHGKRHPTLAENVVVGAGAKVLGAIHVGANTRIGAGSVVVRDVEADSTVVGIPGRVVHQSGVRINPLAHSALPDSEADVIRNLMERIDQLENQVTALHSFLQELSTDRVPQDLQTGQAQNLKDREIIEFLGDTPRS

SEQ ID NO: 7816 - DNA, 747 bp, Clostridium thermocellum ATCC 27405
  CDS (1)..(747): transl_table=11
atgtttaaacagtttatagaggatgcaaaatcaattgccgaaagggatccggcggcgacaagcgtgctggaggtaatctttttatactccgggttccatgcggtttgtctccacaggattgcccactggttttacaaaaggaacatgcgttttattgcgaggttcatttcccagcttaacagatttttgaccggtgttgagatacatcccggggcgaaaataggcaagggactgtttatagaccacggcatgggtgtggtaataggggagaccgccgaagtgggggacaactgtacaatttaccacaatgtcacccttggaggtaccggcaaggacaaaggaaagaggcatcccaccataggaaacaacgtgcttataagtaccggggcaaaagtactgggcccgttcaaagtaggggacaattcacgaattggagccaatgcggtggttttaaacgaggttgagccgaacaccacggtggtcggagtaccgggaagagcggtcaaaaggggaaatcagaagattgtaccctctattgagctggaccagatacatattcccgacccggttgcgcaggaactgtgcaggataaaacagagactggagagcctggaaaaggagcttatggagatgcggcgcgcctcacaaggttcaaatgtccaggagcctgtgcctcaggaaaagtcgtgtgaagaggaatgcaaattggagatgggaaaggagatagccgataatgagactttataa

SEQ ID NO: 7817 - protein, 248 aa, Clostridium thermocellum ATCC 27405
MFKQFIEDAKSIAERDPAATSVLEVIFLYSGFHAVCLHRIAHWFYKRNMRFIARFISQLNRFLTGVEIHPGAKIGKGLFIDHGMGVVIGETAEVGDNCTIYHNVTLGGTGKDKGKRHPTIGNNVLISTGAKVLGPFKVGDNSRIGANAVVLNEVEPNTTVVGVPGRAVKRGNQKIVPSIELDQIHIPDPVAQELCRIKQRLESLEKELMEMRRASQGSNVQEPVPQEKSCEEECKLEMGKEIADNETL

SEQ ID NO: 7818 - DNA, 600 bp, Clostridium difficile 630
  CDS (1)..(600): transl_table=11
atgaatactttgtttaagaaaataaataaagatattgaatatataatgaagaatgatccagcagctaggtctaagatagaagtttttttactttatccatcagttcatgcaatgataatgcataggatggctcatgctctttataagaagaagaagctttttacagcaagattaatatcccagatatccagatttatgactggcatagaaatacatcctggtgctaaaatgggggaaggtatattgatagaccatggaatgggtgttgtaattggagagacagctgaagtagggaatagggtgacaatatatcaaggagctactttaggagctacaggaaaagatactggaaagagacatccaactgttggtgatgatgtattaattggtgctggaacaaaaatactaggacctttaaatataggttcaaattcaaaaattggtgcaaattctgttgtcgttaaggatgtacctaatggtgcaacagttgttggtataccagcaaaaatagtaaaaataagaaacctagaacctgtaaaaaagaataaaaaagaagtgtcctatgagtatgatgaattagataatgtatattatatatag

SEQ ID NO: 7819 - protein, 199 aa, Clostridium difficile 630
MNTLFKKINKDIEYIMKNDPAARSKIEVFLLYPSVHAMIMHRMAHALYKKKKLFTARLISQISRFMTGIEIHPGAKMGEGILIDHGMGVVIGETAEVGNRVTIYQGATLGATGKDTGKRHPTVGDDVLIGAGTKILGPLNIGSNSKIGANSVVVKDVPNGATVVGIPAKIVKIRNLEPVKKNKKEVSYEYDELDNVYYI

SEQ ID NO: 7820 - DNA, 735 bp, Prochlorococcus marinus str. MIT 9301
  CDS (1)..(735): transl_table=11
atgctaaaaacttttaaatcagatatagaaatcattagagagagagatcctgccgctagaggaataatagaaatatttctttgctacccaggctttcaatcaatagttattcataggtttacgcataaattatggcaattaaatattcctttagtaccccgcttaatgagtcatcttaataggttagtaacaggtattgaaatccatcctggggcaaaaattggtaaacgggttttcatagatcatggaatgggcgttgtaattggagaaacagctgaagtaggaaataattgtcttctatatcagggagttacattaggaggcactggtaaaagccatgggaaaagacacccaaccttaaaggaaaatgttgtagttggggcaggagcaaaaattcttggatccatcacagtaggatctaatacacgtatcggcgcaggctcagtagttgttcgaaatgtagaggggaacagtactgttgttggggtccctggcagggtagtgcatcaaagtggtgtcaaagtaaatcccttagctcactctgccttaccagatgcagaagctaatgtgataaaaaatttaatggataggatagactctcttgaaaatgaaattcttaaattacaaaaaaccctacaatgtttagcgaactcagagtctattgatatttctaaactcggtgattctcaaaatcttaaagacaaagaaatttttgaatttcttggagatgattaa

SEQ ID NO: 7821 - protein, 244 aa, Prochlorococcus marinus str. MIT 9301
MLKTFKSDIEIIRERDPAARGIIEIFLCYPGFQSIVIHRFTHKLWQLNIPLVPRLMSHLNRLVTGIEIHPGAKIGKRVFIDHGMGVVIGETAEVGNNCLLYQGVTLGGTGKSHGKRHPTLKENVVVGAGAKILGSITVGSNTRIGAGSVVVRNVEGNSTVVGVPGRVVHQSGVKVNPLAHSALPDAEANVIKNLMDRIDSLENEILKLQKTLQCLANSESIDISKLGDSQNLKDKEIFEFLGDD

SEQ ID NO: 7822 - DNA, 744 bp, Herminiimonas arsenicoxydans
  CDS (1)..(744)
atgttcagtcgcattaaagaagatatcgccaacatcattgcccgcgatccagccgcgcgcagcgtgtgggaagtcattacctgctacccgggcctgcacgccatcgtcatgcaacgctgggcgcattggttctgggtaaatgatttgaagtggctgggacgctttacctcgcatattgcacgctggctgaccggtatcgaaattcatcctggtgcaaaaatcggtcggcgtgtgtttatcgaccacggttttggcgtagtaataggtgaaaccgcagagatcggtgacgattgcacgatctaccagggagtcacattaggcggcacctcgctgagcaaaggtgcgaagcgccatcctacactgggcaatggcgtcatcataggtgccggtgcgcaagtgctgggtgcgtttaccgtgggcgagggggcgaaggtcggatcgaatgcggtggtcgtaaaggaagtaccggcaggcgcgacagcggtcggcaatccggcacgcattatcctcaaggacgatacccgcgatcaggctgcggcgcgcatgtttgcatcctatggtgtgacgccgaatggtgacgatccgctctccaaggccttgcacggcttgatcgataatgcagcgacacaggaacatcaaatcgaaaaaattctggcagccctgaaatgtgcgggaattgattgcgaaactctgccggcagcggaaaaattcgatcaggaacagatgaacaagctggttgagtag

SEQ ID NO: 7823 - protein, 247 aa, Herminiimonas arsenicoxydans
MFSRIKEDIANIIARDPAARSVWEVITCYPGLHAIVMQRWAHWFWVNDLKWLGRFTSHIARWLTGIEIHPGAKIGRRVFIDHGFGVVIGETAEIGDDCTIYQGVTLGGTSLSKGAKRHPTLGNGVIIGAGAQVLGAFTVGEGAKVGSNAVVVKEVPAGATAVGNPARIILKDDTRDQAAARMFASYGVTPNGDDPLSKALHGLIDNAATQEHQIEKILAALKCAGIDCETLPAAEKFDQEQMNKLVE

SEQ ID NO: 7824 - DNA, 801 bp, Burkholderia vietnamiensis G4
  CDS (1)..(801): transl_table=11
atggtcatgagcgccgtgccgcgcaccgcatccgcggcggcggcggccgagcgcgccgccggccgctcatggtgggccttgctgcgcggcgacgcacgctgcgtgctcgagcgcgatccggccgcgcgcagcaggctcgaggtctggaccatctatccggggctgcacgcgctcgccgcgcaccgcgtcgcgcatgcgctgtggcggcgcggctggcgctacctgccgcgcgtgctgtcgttcgtcgcgcgcatggtcacgcaggtcgacatccatcccggcgcgacgatcggcccgcgcctgttcatcgatcacggctcgggcgtcgtgatcggcgagacggccgagatcggcgccgactgcacgctctatcacggcgtcacgctcggcggcaccagcctgcacgcaggcaagcgccatccgacgctcggcgagcgcgtgatcgtcggcgcgggcgcgacgatcctcggcccgatcgcggtcggcgatggcgcgcggatcgcggcgaactcggtcgtgatcgacgcggtgccggaccacgcgaccgtcgtcgggattccggcgcgcgtggtcgcgccgcgcgaccggcgcaccgcgcacggctacgacctgaaccatcacctgattcccgacccggtcggcaaggcgctcgcgtgcctgctcgatcgcgtcgcccggctcgagcagtccagccaaggcggcccgctgccgccgcgtcccggcgcacccggcgaaccatgctgcggcgacggctgcatggacgccgtgcacgcgccatccccgtcccgccgtccggagtga

SEQ ID NO: 7825 - protein, 266 aa, Burkholderia vietnamiensis G4
MVMSAVPRTASAAAAAERAAGRSWWALLRGDARCVLERDPAARSRLEVWTIYPGLHALAAHRVAHALWRRGWRYLPRVLSFVARMVTQVDIHPGATIGPRLFIDHGSGVVIGETAEIGADCTLYHGVTLGGTSLHAGKRHPTLGERVIVGAGATILGPIAVGDGARIAANSVVIDAVPDHATVVGIPARVVAPRDRRTAHGYDLNHHLIPDPVGKALACLLDRVARLEQSSQGGPLPPRPGAPGEPCCGDGCMDAVHAPSPSRRPE

SEQ ID NO: 7826 - DNA, 945 bp, Burkholderia vietnamiensis G4
  CDS (1)..(945): transl_table=11
atgcgcggccgcctgcattggcatatgtcgacatcacccgcccgtcagtggggcctcgaagaaatcgttgccggcttgcgcgaatcgcgcgaggaactgcatcgcacccgccatccgcgcggcatccgtgaactgccgtcgcgcgacgcgatctgcaagatcgtgaccggcctgcgcgcgtcgatgtttccgacgcattacggcgcgccggatctcaccgacgaaagcgtcgactattacgtgggtcatacgctcgagagcacgctgcggatcctctccgaacaaattcgccgtgcgttgccgttcctgcccgagcacgcggacacgccgttcgtggcactcgacgaacgcgcgttcgagatcgcacgcgagttcgggcggcagctgccgtcgattcgcgcgctgctggtgagcgacatccaggcggcgtacgcgggcgatccggccgcgcagcacatcaccgagatcctgctctgctatcccggcgtgctcgcgatgatgcaccaccggctcgcccatgcgctgcaccagctcggtgtgccgctgctcgcgcgcttcatcaacgagatcgcgcattcggccaccggcatcgacatccaccccggtgcgcagatcggcccgagcttcttcatcgaccacggcaccggcgtcgtgatcggcgaaaccgcgatcatcggcgagcgcgtgcgcgtgtaccaggccgtcacgctcggcgcgaagagcttcccggccgacggcgacggcgcgctggtgaagggcaacgcacgccatccgatcgtcgaggacgacgtggtgatctacgcgggtgcgacgattctcggccgcgtgacgatcgggcgcggctcggtgatcggcggcaacgtgtggctcacgcacagcgtgccgcccggcacgagcgtcgcgcagggcaaggtccgcgagggcggcagcgccgagaagccgtaa

SEQ ID NO: 7827 - protein, 314 aa, Burkholderia vietnamiensis G4
MRGRLHWHMSTSPARQWGLEEIVAGLRESREELHRTRHPRGIRELPSRDAICKIVTGLRASMFPTHYGAPDLTDESVDYYVGHTLESTLRILSEQIRRALPFLPEHADTPFVALDERAFEIAREFGRQLPSIRALLVSDIQAAYAGDPAAQHITEILLCYPGVLAMMHHRLAHALHQLGVPLLARFINEIAHSATGIDIHPGAQIGPSFFIDHGTGVVIGETAIIGERVRVYQAVTLGAKSFPADGDGALVKGNARHPIVEDDVVIYAGATILGRVTIGRGSVIGGNVWLTHSVPPGTSVAQGKVREGGSAEKP

SEQ ID NO: 7828 - DNA, 774 bp, Burkholderia vietnamiensis G4
  CDS (1)..(774): transl_table=11
atgttcactagactgcgcgaagacgttgcgacgattcgcgagcgggaccccgccgctcgcagtgcctgggaagtgctcacctgttatccggggctgcacgcgctcgtgctgcatcggttcgcgcatgcctgctggcgcgcgaaacgctactggctcgcgcggttcgcgtcgcagctcggtcgcttcttgacggggatcgaaatccatccgggcgcgacgctcggccggcgcgtgttcatcgatcacgggatgggcgtcgtgatcggcgagaccgcgatcgtcggcgacgactgcacgatctaccagggcgtgacgctcggcggcacgtcgctcacgcgcggcgcgaagcgccatccgacgctcgaggccggcgttatcgtcggcgcgggggcgaaggtgctcggcgggttcacggtcggtgcgggcgcgaagatcggttcgaacgcggtcgtcgtgaagccggtgccggcgggcggcaccgcggtcggcaacccggcgcgcatcgtgatgccggcgcaaccgaagccgcagcccgaacgcgcggcgttctgcgcgtacgggatcacgccgaacgcggacgacccgatgtcgctcgcgatacacgggctgatcgatcatgcggcgaaggaaagccgacgcgtcgacgagatcgtcgccgcgctcgagcagctcggcacccatctggaaacgctacagggcgcggacgcagcgcgtctcgatctgcgccgcctgtcggccgtgctggaggggaagtcggtcgagcgtcaaacgtga

SEQ ID NO: 7829 - protein, 257 aa, Burkholderia vietnamiensis G4
MFTRLREDVATIRERDPAARSAWEVLTCYPGLHALVLHRFAHACWRAKRYWLARFASQLGRFLTGIEIHPGATLGRRVFIDHGMGVVIGETAIVGDDCTIYQGVTLGGTSLTRGAKRHPTLEAGVIVGAGAKVLGGFTVGAGAKIGSNAVVVKPVPAGGTAVGNPARIVMPAQPKPQPERAAFCAYGITPNADDPMSLAIHGLIDHAAKESRRVDEIVAALEQLGTHLETLQGADAARLDLRRLSAVLEGKSVERQT

SEQ ID NO: 7830 - DNA, 582 bp, Streptococcus pyogenes str. Manfredo
  CDS (1)..(582)
atgggttggtggaaagaaagtatagctattgttaaagctctagacccagctgctcgtaatagtcttgaggttatcctaacttatccaggcatcaaagccctagctgctcatcgtttgtctcattttctttggcgacatcattttaaattactagccagaatgcatagccaattttggcgattttggacacaaattgaaatccatcctggagcacaaatcgctcctggagtcttcattgaccatggtgctggtcttgttattggagagacagcaattgttgaaaaaggtgtgatgctttatcatggggtgaccctaggtggaaccggaaaagattgtggcaagcgtcatccaacgattcgacaaggtgccttaatttcggcacatgcccaagtgattggacctattgacatcggagcaaatgctaaagtaggggcagcagctgttgtgttatcagatgttcctgaagacgtgacagttgtaggtgtgccagctaagatagtacgagtgcatggacaaaaagataatcgtcaaattcaaagtttacaaaaacaacgagaggtctcttatcagttgtcaaaatga

SEQ ID NO: 7831 - protein, 193 aa, Streptococcus pyogenes str. Manfredo
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTIRQGALISAHAQVIGPIDIGANAKVGAAAVVLSDVPEDVTVVGVPAKIVRVHGQKDNRQIQSLQKQREVSYQLSK

SEQ ID NO: 7832 - DNA, 828 bp, Bradyrhizobium sp. ORS278
  CDS (1)..(828): transl_table=11
atggctatgcatcagacccatcctcagagcggaaagctggcgacgctcgatccgatctgggatcggatccggaccgaggccgaagagatcgtccgccgggagccggagctcgcgaccttcatctattcgacggtgctgcatcacagcaggctggaggattcggtcgttcatcgggtcgccgaccgtctcgatcattcggcgctgtcgggcgatctgatccgccagaccttcgacgatgccctgcgcgacgagccggatctcggccacgccttccgcgccgatctcgtcgccgtctatgaccgcgatcccgcgacgtcgcgcttcatcgatcccttgctctacttcaagggctttcacgcgctgcagacgcatcgtctcgcgcattggctttatcgcaagaaccgcaaggatttctcgttctatctgcagagccgctcctcggcggtgttccagaccgacatcaatccggccgcacgcatcggccgcggcatcttcctcgatcacgccaccggcttcgtctgcggcgagaccgcggtcatcgaggacaacgtctcgatcctgcacggcgtgacgctcggcggcaccggcaaggagaatgaggaccgtcatccgaagattcgccacggcgtgctgatcggtgccggcgccaaggtgctcggcaacatcgaggtcggtcattgcgcgcgcatcgcggccggatcggtggtcgtgaagccggtgccgaacaacgtcacggtggcgggcgtgccggccaagatcgtcggcgaggccggctgcgccgagccgtcgcgcaccatggaccagatgatcaacgcgatcggtatctga

SEQ ID NO: 7833 - protein, 275 aa, Bradyrhizobium sp. ORS278
MAMHQTHPQSGKLATLDPIWDRIRTEAEEIVRREPELATFIYSTVLHHSRLEDSVVHRVADRLDHSALSGDLIRQTFDDALRDEPDLGHAFRADLVAVYDRDPATSRFIDPLLYFKGFHALQTHRLAHWLYRKNRKDFSFYLQSRSSAVFQTDINPAARIGRGIFLDHATGFVCGETAVIEDNVSILHGVTLGGTGKENEDRHPKIRHGVLIGAGAKVLGNIEVGHCARIAAGSVVVKPVPNNVTVAGVPAKIVGEAGCAEPSRTMDQMINAIGI

SEQ ID NO: 7834 - DNA, 960 bp, Bradyrhizobium sp. ORS278
  CDS (1)..(960): transl_table=11
atgagacatcgtcctgtgacgggctccggcgcggagacgcctgcaccggcgggcgaacgctggggcctcgatcggctggtggcggagctgcgcgtctcgcgcgaggaaacccatagcatccgcaaggacggcacgatccaccggccgccatcgcgcgagaagctggcgcaggtcgtcgccgcgctgaccgaggcgctgtttccgcgccactatggccagtacgacctcgatagcgagaatatcgactatttcgtcggccaccggctcagcatcggcctcgacctgctctccgaccagatccaccgcgccgccttgttcgtcggcgacgagctgatccccggctttcgccagccggacgccgtcgagctcacgcacagtttcgcaaaggggttgcctgggctgcgcggaatcctgatcagcgacctgcgcgccgccttcgtcggtgatcccgccgccaagagctttccggagatcctgatcggctatcccggcatgaccgcgatcattcaccaccggctcgcgcatctgctctacggtcacggcgcgcgcctggtgtcgcggctgattgccgagatcgcgcacgcccgaaccgggatcgacattcatccgggcgcgcagatcggttcgggcttcttcatcgatcacggcaccggcgtcgtcatcggcgagacggccgtgatcggcgacaatgttcggatctaccaggcggtcacgctcggcgcgcggcacttcccgaccgaggaggacggcacgctgatcaagggcgacgcgcgccatccgatcgtcgaggacgacgtcgtgatctatgccggcgccaccatcctcggccgcatcacgatcggacagggatcgacgatcggcggcaatgtctggctgacacacgatgtcccgcccaacagcatcgtgacccaggccacgctccgcaacaaggtcggcggaccgaacctgcagaagtcctga

SEQ ID NO: 7835 - protein, 319 aa, Bradyrhizobium sp. ORS278
MRHRPVTGSGAETPAPAGERWGLDRLVAELRVSREETHSIRKDGTIHRPPSREKLAQVVAALTEALFPRHYGQYDLDSENIDYFVGHRLSIGLDLLSDQIHRAALFVGDELIPGFRQPDAVELTHSFAKGLPGLRGILISDLRAAFVGDPAAKSFPEILIGYPGMTAIIHHRLAHLLYGHGARLVSRLIAEIAHARTGIDIHPGAQIGSGFFIDHGTGVVIGETAVIGDNVRIYQAVTLGARHFPTEEDGTLIKGDARHPIVEDDVVIYAGATILGRITIGQGSTIGGNVWLTHDVPPNSIVTQATLRNKVGGPNLQKS

SEQ ID NO: 7836 - DNA, 792 bp, Bradyrhizobium sp. ORS278
  CDS (1)..(792): transl_table=11
atgaccgacatcatggataacccgattgccaagagcgctgccgccgacgcgagcccgccgtcgctgttccgcctcatccgcgaggacatcggctgcgtccgatcgcgcgacccggccgcgcgcagcgagatcgagaccttgctgacctatcccggaattcacgcgctgatctggcaccgtctcgcgcatcgcttctggatcagcggctggcggtttccggcgcggctcttgtcatggcttggacgcttcctgtcgaacgtcgacattcaccccggcgcccagatcggccggcgcttcttcatcgaccacggcgcctgcgtcgtgatcggcgagacagccgaggtcggcgacgatgtcacgctgtatcacggcgtcacgctgggcggcacgtcgtggtcgccgggcaagcggcatccaacactcgagaacggcgtcgtcgtcggggccggtgccaagatcctcgggccgatcacgatcgggccgcgcacccgcgtcggcgccaactccgtcgtcatccagagcacgccgcctgatgtcaccgtggtcggcatccccgccaaggtggtgcggccggagttcacgcaccgccgcaccgtcggccgcatcgatctcgatcatcacctgatgcctgatccggtcggcgaggcgttgtcggtgatgctcgaccgtatcgagttcctcgaagcgcagctcgcgcatgtccgccagaaggtgcgccagggaccgccgccgccggcgccgatcaatggatgcgaggttgacccgactttgactcaaggagcgaagcaatga

SEQ ID NO: 7837 - protein, 263 aa, Bradyrhizobium sp. ORS278
MTDIMDNPIAKSAAADASPPSLFRLIREDIGCVRSRDPAARSEIETLLTYPGIHALIWHRLAHRFWISGWRFPARLLSWLGRFLSNVDIHPGAQIGRRFFIDHGACVVIGETAEVGDDVTLYHGVTLGGTSWSPGKRHPTLENGVVVGAGAKILGPITIGPRTRVGANSVVIQSTPPDVTVVGIPAKVVRPEFTHRRTVGRIDLDHHLMPDPVGEALSVMLDRIEFLEAQLAHVRQKVRQGPPPPAPINGCEVDPTLTQGAKQ

SEQ ID NO: 7838 - DNA, 693 bp, Dehalococcoides sp. BAV1
  CDS (1)..(693): transl_table=11
atgataaaagatattagaaatgtttttagcaaagacccggctgccagaagtgtggcagaggttctattttgttatcccggtttgcatgctctctggtttcaccgggtggcaaactggctgtggcggcacaaactccatttctgggcgcgctggctttcccatggcgggcggttctgcaccggcattgagattcatccgggggcaaaaataggtcagcgtttcttcattgaccatgggatgggggtagtcattggcgaaacctctgaaattggcaatgacgtgcttatgtatcagggtgtggtgcttggcggaaccagtctgtccaaaggcaaacgccaccctaccatctgcgataatgcggttatcggtacaggcgcaatagtgctaggcggcattacggtgggtgaaggggctaaagtaggggcaggttcggtggttaccaaagatgttccggccggggcgactgtagttggcatacccgggcgggtggttgaagaatcacgccgtatggttattgatctggaacacggcaaactgcctgacccggtagcagacgctctgaaagtggttctggccgaacagcaaaaactgatggacaggcttgcccagcttgaaaaaaacagcggactgaaagtgcctcaggatgagcttcgcgggcagatacgcgagattatgaaagagtttaacctgtag

SEQ ID NO: 7839 - protein, 230 aa, Dehalococcoides sp. BAV1
MIKDIRNVFSKDPAARSVAEVLFCYPGLHALWFHRVANWLWRHKLHFWARWLSHGGRFCTGIEIHPGAKIGQRFFIDHGMGVVIGETSEIGNDVLMYQGVVLGGTSLSKGKRHPTICDNAVIGTGAIVLGGITVGEGAKVGAGSVVTKDVPAGATVVGIPGRVVEESRRMVIDLEHGKLPDPVADALKVVLAEQQKLMDRLAQLEKNSGLKVPQDELRGQIREIMKEFNL

SEQ ID NO: 7840 - DNA, 744 bp, Synechococcus sp. WH 7803
  CDS (1)..(744): transl_table=11
atgttcaaccacatccgtgccgacctggcgatcatccgcgaacgggatccggcggcacgaggcccgctggaaattctgctgtgttatccaggcttccaggccctgagcctgcaccggctcagccatcggctctggcactcccggttgcccttgaagctggccgcccggctgctcagccaactcggccgcaatctcactggcgtggagatccatcccggcgccaggatcggccatggcgtgttcatcgaccacggcatgggcgtggtgatcggcgagaccgccgaagtgggtgaccgctgcctcctctaccagggagtaaccctggggggcacgggcaaagaccacggcaaacgccatcccaccctggccaacaacgtggtgatcggcgccggcgccaaggtgctgggcgccatcgaggtgggcaccaacacccgcatcggcgctggatcggtggtggtgcgcgatgtggaagccgattgcaccgtggtgggaatccccgggagggtgatccaccagagcggcgtgcgcatcaatcccctggcccactccgccttaccggatgcggaagcgaatgtgatccgcaacctgatggagcggatcgatcagctcgaagggcaggtgcgcagcctgcaggacaacctgcgcaccatggcggccgccagcggtcggcccctgcgcgaagtgcgcaatggccaggcccagaacctcaaggaccgggagatcctcgagttcctgggggattga

SEQ ID NO: 7841 - protein, 247 aa, Synechococcus sp. WH 7803
MFNHIRADLAIIRERDPAARGPLEILLCYPGFQALSLHRLSHRLWHSRLPLKLAARLLSQLGRNLTGVEIHPGARIGHGVFIDHGMGVVIGETAEVGDRCLLYQGVTLGGTGKDHGKRHPTLANNVVIGAGAKVLGAIEVGTNTRIGAGSVVVRDVEADCTVVGIPGRVIHQSGVRINPLAHSALPDAEANVIRNLMERIDQLEGQVRSLQDNLRTMAAASGRPLREVRNGQAQNLKDREILEFLGD

SEQ ID NO: 7842 - DNA, 822 bp, Klebsiella pneumoniae subsp. pneumoniae MGH 78578
  CDS (1)..(822): transl_table=11
atgccgtgtgaagaactggatatcgtctggaataatattaaagccgaagcccgggctttggctgactgtgagccgatgctcgccagtttttaccacgcaacgctactcaagcatgaaaatctcggcagcgcgctgagctatatgctggccaacaagctggcttccccgattatgccggcgatcgccattcgcgaagtggtggaagaggcctacgccgccgatccggaaatgatcgcctccgccgcctgcgatattcaggcggtgcgcacgcgcgacccggcggtggataaatactccacgccgttgctctatctgaagggtttccatgccctgcaggcctatcgtatcggccactggctgtggactcaggggcgacgcgcgctggcgattttcctgcaaaatcaggtctccgtctctttccaggtggatatccacccggcggcgaaaatcggccgcgggatcatgctcgaccatgccaccggcattgtggtcggcgaaacggcggtgattgaagatgacgtctctattctgcagtcggtcaccctcggcgggaccggtaaaaccagcggcgaccgtcatccgaaaattcgcgaaggcgtaatgattggcgccggggcgaagatcctcggcaatattgaagtcgggcgtggcgcgaagattggcgccggttcggtggtattgcagccggttccgccgcacaccaccgcggcgggcgtaccggcgcgtatcgtcggcaagccggagagcgacaagccggcgatggatatggatcagcatttcaacggcatccaccacaccttcgagtacggcgacgggatttga

SEQ ID NO: 7843 - protein, 273 aa, Klebsiella pneumoniae subsp. pneumoniae MGH 78578
MPCEELDIVWNNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWTQGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPESDKPAMDMDQHFNGIHHTFEYGDGI

SEQ ID NO: 7844 - DNA, 777 bp, Xanthobacter autotrophicus Py2
  CDS (1)..(777): transl_table=11
atgatcatgggaagcccgaaatggcaggggaccgacgttccgctcgccggcgcggcggaggctgagaaggcgtccgccctctcggtgtggcgcctcatccgcgaggacgtggactgcgtgaagtcgcgcgatccggcggcccgcaacacggtcgagatcgtgctcacctatcccggcgtgcatgccgtgatctggcatcggctggcgagccggctgtggcggcgcggcatcaagttcccggcccgcttcctgtcctggctcggtcgcttcctgaccaatgtggacatccatcccggcgccaccatcggccggcgcttcttcatcgatcacggcgcgtgcgtggtgatcggcgagaccgccgaggtgggcgatgacgtgacgctctatcacggggtcaccctgggcggcacctcctggacctccggcaagcgccatcccaccctgcgcgacggcgtgctggtgggagcgggcgccaagatcctcggtcccatcacggtgggggcgggttgccgcatcggtgccaattcggtggtaatcgaggacgtgcccccggccatgacggtggtgggtattcccggccgggtggtgaagcccatggccgaccgccgccgcgtcggcgacggccgcatcgacctggagcatcacctgatgccggacccggtgggcgaggccatcgtctcgctgctcgaccgcatcgaattcctggaggcgcgcctcgcgcacctgcaaagcgaacgtccgcgcggccgcagcgccactgcggacgaggcggcgtaa

SEQ ID NO: 7845 - protein, 258 aa, Xanthobacter autotrophicus Py2
MIMGSPKWQGTDVPLAGAAEAEKASALSVWRLIREDVDCVKSRDPAARNTVEIVLTYPGVHAVIWHRLASRLWRRGIKFPARFLSWLGRFLTNVDIHPGATIGRRFFIDHGACVVIGETAEVGDDVTLYHGVTLGGTSWTSGKRHPTLRDGVLVGAGAKILGPITVGAGCRIGANSVVIEDVPPAMTVVGIPGRVVKPMADRRRVGDGRIDLEHHLMPDPVGEAIVSLLDRIEFLEARLAHLQSERPRGRSATADEAA

SEQ ID NO: 7846 - DNA, 897 bp, Xanthobacter autotrophicus Py2
  CDS (1)..(897): transl_table=11
atgccccaatctcccacgcctgcccccatgcccgcgcccgttgccgacgcgttcgctccgaagctcaccaaggcaggcacggaacgctggcacgacgtggtcgatccggtctgggcgcgcctgcgcaacgaggcggaggaagccgccgagcgagagccgctgctcgccgccttcctcatcggcgccgtgctgggccagccgagcttggaggcggtgattggcgaacgcatcgccgcccgcctcgaccatgcggacgttccggccagcgccatccgcgccgcctggcttgaggccgccgcccgcgacaagaccattccccaggccctgcgcgccgacatcatggcggtggtggaccgcgaccctgcagccacccgcacgcttgagccggtgctgtatttcaagggcttccacgccatccagacccaccgcctgtcccacttcctgtgggccagcggccagcgcgacttcgccctctatctccagagccgggcctcctccgtgttcgccgtggacatccacccgcaggtgcccatgggccggggcatcttcctcgaccacgccaccggcgtcgtcatcggcgccacggcggtgatcgaggacgacgtgtccatcctgcagggggtgacgctgggcggcaccggcaaggagaccggcgaccgccatcccaagatccgccggggcgtgctcatcggcgctggcgccaaggtgctcggcaacatcgaggtcggccgctgcgcccgcatcgccgccggctcggtggtgctgaagccggtgccgcgcaataccacggtggcgggcatcccggccaaggtagtgggcgaagccggctgcgccgaaccctcgcgctccatggaccagatgttcgaggacaacatctggtctggcgccgatatctga

SEQ ID NO: 7847 - protein, 298 aa, Xanthobacter autotrophicus Py2
MPQSPTPAPMPAPVADAFAPKLTKAGTERWHDVVDPVWARLRNEAEEAAEREPLLAAFLIGAVLGQPSLEAVIGERIAARLDHADVPASAIRAAWLEAAARDKTIPQALRADIMAVVDRDPAATRTLEPVLYFKGFHAIQTHRLSHFLWASGQRDFALYLQSRASSVFAVDIHPQVPMGRGIFLDHATGVVIGATAVIEDDVSILQGVTLGGTGKETGDRHPKIRRGVLIGAGAKVLGNIEVGRCARIAAGSVVLKPVPRNTTVAGIPAKVVGEAGCAEPSRSMDQMFEDNIWSGADI

SEQ ID NO: 7848 - DNA, 750 bp, Prochlorococcus marinus str. MIT 9211
  CDS (1)..(750): transl_table=11
atgcttaaagccattcaatcagacatagccattataaaagagagagatcctgcagcaagaggattgcttgaaatcattctctgttatccgggtttccaagctctcgtattgcacagaatcagtcataggctttggaagtttggcatgccattattccctcgcctacttagccaaattactaggtccttaactggaattgaaattcatccaggagcaaaaatagggaaaggcgtttttattgaccatggaatgggagtagttattggtgaaaccacagaaataggaaatagatgtcttctctaccaaggtgtgacacttggaggcactggcaaagatgaaggcaagagacatccaaccttggcagaaaatgtagtaattggagctggagcgaaagtactaggggctataacagttggtacaaacacaaggattggggcaggatcagttgtagtaagagatgttgaagctaatagcacagttgtgggaatccctggaagggttgtgcatcaaagtggtgtacgaattaatcctctggctcactcagcgctaccagatactgaagcaacagtaattagaaatcttatggaacgtattgattacctggaaggtcaagtaagtagcatgagtaattctttgaaagatttcaatcaagggagttcacctaatgcagttttacctggagaagcccaaaatctaaaagaccgagaaattattgaattcctaggagatgaagttaacgatgatcaataa

SEQ ID NO: 7849 - protein, 249 aa, Prochlorococcus marinus str. MIT 9211
MLKAIQSDIAIIKERDPAARGLLEIILCYPGFQALVLHRISHRLWKFGMPLFPRLLSQITRSLTGIEIHPGAKIGKGVFIDHGMGVVIGETTEIGNRCLLYQGVTLGGTGKDEGKRHPTLAENVVIGAGAKVLGAITVGTNTRIGAGSVVVRDVEANSTVVGIPGRVVHQSGVRINPLAHSALPDTEATVIRNLMERIDYLEGQVSSMSNSLKDFNQGSSPNAVLPGEAQNLKDREIIEFLGDEVNDDQ

SEQ ID NO: 7850 - DNA, 972 bp, Desulfovibrio vulgaris subsp. vulgaris str. Hildenborough
  CDS (1)..(972): transl_table=11
atgaagaagcttgatgccagcaccgccgtatcgctcaccggaatgcccgaactcgaacgcatcgtcgagtccctgtgtacccccgaatcgtacgaggcggtctaccatcagtcactgcacggttcgcccatgccttcgctggaggcgctgaccgaacttatggcgcgtctgcgtgcggcactcttccccggctactttggagcgtccaacatcgttctggagtccatgcgctaccacctggcagccaacctcgactccatctaccgcatcctcgccgaacaggttcgccgcggcgggtgcttcgcctgcgccgactacgccacggactgtcagaactgcgaaagccattcgcaggagaccgccatggagttcatgcgggcgctgccgcgcatacggcaactgctcgccacagacgtgaaggccgcctatgagggcgaccctgccgccaaaagccccggcgagaccatcttctgctatccctccatctacgccatgatccatcaccgcatcgcccatgagctgtacaggctcgacgtgccggtgattccgcgcatcatcagcgagatggcgcactcgcgcacgggcatcgacatccaccccggcgcgacagtcggcgaggagtttttcatcgaccacggcacgggcgtggtcatcggagagacctgcatcatcggccgcggctgccgcctgtatcagggcgtcaccctcggggcgctctcgttccccaaggacggaggcggtgcgctcatcaagggcatcccgcgccaccccatccttcaggacggcgtgactgtctacgcgggggcgaccatcctcgggcgggtcaccatcggcgcaggtgccatcgtgggtggcaacgtgtgggtgacccacgatgtggcccccggtgccaaggtggtgcagcagaagtcctcaccgcctgccgccgaagacaggatggtgggaacgaagaacggcacccccaaggcatga

SEQ ID NO: 7851 - protein, 323 aa, Desulfovibrio vulgaris subsp. vulgaris str. Hildenborough
MKKLDASTAVSLTGMPELERIVESLCTPESYEAVYHQSLHGSPMPSLEALTELMARLRAALFPGYFGASNIVLESMRYHLAANLDSIYRILAEQVRRGGCFACADYATDCQNCESHSQETAMEFMRALPRIRQLLATDVKAAYEGDPAAKSPGETIFCYPSIYAMIHHRIAHELYRLDVPVIPRIISEMAHSRTGIDIHPGATVGEEFFIDHGTGVVIGETCIIGRGCRLYQGVTLGALSFPKDGGGALIKGIPRHPILQDGVTVYAGATILGRVTIGAGAIVGGNVWVTHDVAPGAKVVQQKSSPPAAEDRMVGTKNGTPKA

SEQ ID NO: 7852 - DNA, 927 bp, Acinetobacter sp. ADP1
  CDS (1)..(927): transl_table=11
atggctaaatgggatatttctcctgttgtacaaggtttacaacaggcacgtcacgaatggcgtgaacgtcaaaatcgtatcaaagaaattgggggacgagaattaccatctaaagaggttttaaagtcaattcttgatgacttgtgcggcattctttttccaatgcgtctgggaccagcagacctacgtcaggaaactgaagactattatatttcctatacactagaccgtgttttaaatgcattatacggtcaggtcaaacttgctttagattatgaattaaaaagcaagtctagacaaaattatgagcaggatagcgcagcaattagtcaacaagcagaaattgttgttcaaaattttgcaaagaccttaccacacatacgccgcttactggatgcagatgtttgtgccgcttatgaaggtgatcccgctgcacacagtgtagatgaagttctactatgctatccaggtatattggcaatcattcatcatcgtctggcccatcagttatacccacacgttccactattatcgcgaattatttccgagcttgcacattctgcgacgggtattgatatacatcctggtgcaagcattggttcaggtttcttcattgaccatggtacgggaattgtgattggagaaacatgtattattggagaaaaagtcagaatttatcaagcggtgactttaggtgccaaacgctttgaaaccgatgcagatggctcgctcaaaaaagactaccaacgtcatccaattgtagaagatcaagtgattatttatgcaggtgcaacaatactaggcagaattaccattggtaaaggctctgtcattggtggcaatgtctggttaacacatagcgtacctgcaggtagccagatattacaatcaccatcagaatcacatcatcagaaaaaaacggcttaa

SEQ ID NO: 7853 - protein, 308 aa, Acinetobacter sp. ADP1
MAKWDISPVVQGLQQARHEWRERQNRIKEIGGRELPSKEVLKSILDDLCGILFPMRLGPADLRQETEDYYISYTLDRVLNALYGQVKLALDYELKSKSRQNYEQDSAAISQQAEIVVQNFAKTLPHIRRLLDADVCAAYEGDPAAHSVDEVLLCYPGILAIIHHRLAHQLYPHVPLLSRIISELAHSATGIDIHPGASIGSGFFIDHGTGIVIGETCIIGEKVRIYQAVTLGAKRFETDADGSLKKDYQRHPIVEDQVIIYAGATILGRITIGKGSVIGGNVWLTHSVPAGSQILQSPSESHHQKKTA

SEQ ID NO: 7854 - DNA, 909 bp, Acinetobacter sp. ADP1
  CDS (1)..(909): transl_table=11
atgacacaatggaacatccagtcagttgttgatggcttgcaaaaagcacgtcatgattggcgagaaagtcagcatcgaaccaaagaaatgggtgatcgcgaattaccgtcgaaagaaatcttaaaatccattattgatgacctgtgtggtattttgtttccaatgcggcttggcccatcagaattacgacaacaaaccgaaaactattatattgcttatacgctcgaccgggttttaaatgaacttctcattcaaactcgaatggcattaaattatgaagccaaacttcatccagaaagttcacatcctgaccttgatgcatatgccaagcaaatcgtacacgaatttgcagatgctttacctcaaattcgtcgtctacttgatgaagatgttattgcagcctatgaaggtgatcctgctgcacatagtgtcgatgaagtcctgatttgctatcctggcttactcgcaattatatatcatcgtttgtcacatcaactttatccacatgttccactggtctctagaatcatttctgagcttgcacactcagaaacaggaatcgatattcatcctggagccaaaattggtaaaggcttctttattgaccatggaactggtgtggtgattggtgaaacctgcattattggtgaacgagtcagaatttatcaagcagtgactcttggggcaaaacgttttgaaacagatgatcaaggtggtttgaaaaaagattatgctcgtcatcctattgttgaagatgacgtggtgatttacgcaggtgcgactattttaggccgtatcatcattggtaaaggatcaaccattgggggaaatgtctggctgacccataccgtgcctgctggtagtcagattttacaatctccctctgaaacctgtaaaaatattggctag

SEQ ID NO: 7855 - protein, 302 aa, Acinetobacter sp. ADP1
MTQWNIQSVVDGLQKARHDWRESQHRTKEMGDRELPSKEILKSIIDDLCGILFPMRLGPSELRQQTENYYIAYTLDRVLNELLIQTRMALNYEAKLHPESSHPDLDAYAKQIVHEFADALPQIRRLLDEDVIAAYEGDPAAHSVDEVLICYPGLLAIIYHRLSHQLYPHVPLVSRIISELAHSETGIDIHPGAKIGKGFFIDHGTGVVIGETCIIGERVRIYQAVTLGAKRFETDDQGGLKKDYARHPIVEDDVVIYAGATILGRIIIGKGSTIGGNVWLTHTVPAGSQILQSPSETCKNIG

SEQ ID NO: 7856 - DNA, 810 bp, Acinetobacter sp. ADP1
  CDS (1)..(810): transl_table=11
atgtttaaacagttaaaagaagatattcaggccgtttttgctcgtgatcctgctgctcgcaatacgctggaggtgttgacaacatatccaggtattcatgcgctgattatgcaccgaatggcccatgaactatggaataaggactttaaagggactgctcgagcattatcatcattcagtcgttttgcaacgggtattgaaattcatcctggcgcaaagattggtcgtcgcttttttattgatcatggcatgggtgtcgttattggtgaaactgctgaaattggggacgacgtcacgctgtatcatggtgtcacgcttggtgggaccacctggaatacaggtaaacgccatcctacgcttgaagatggtgtcgtcatcggtgctggtgcaaagattttaggtccttttaccattggtaaaggtgcaaaaattggttcaaatgcagtggtgacgaaagctgtacctgcaggtgtaacggctgtaggtagtgcagcacgattcatttataaaaatatcgaaaaaaatgaagatgagatccgtagagaaaattatgctcagagcattggttttcagccttatgccaccacacgagaccaagcagatcctattctggaaggcatgaaagttttacttgatcgattacaacaaaatgaagttcgtatgaacactttatgccagagactatcttctttggatcctagctttaacaagcaaaattacgatcaacaaccttttagtcaagaagaactcaaaattattgaagaagtccgccgagaatgcgaagcacaaacgcatacggacaaagcctga

SEQ ID NO: 7857 - protein, 269 aa, Acinetobacter sp. ADP1
MFKQLKEDIQAVFARDPAARNTLEVLTTYPGIHALIMHRMAHELWNKDFKGTARALSSFSRFATGIEIHPGAKIGRRFFIDHGMGVVIGETAEIGDDVTLYHGVTLGGTTWNTGKRHPTLEDGVVIGAGAKILGPFTIGKGAKIGSNAVVTKAVPAGVTAVGSAARFIYKNIEKNEDEIRRENYAQSIGFQPYATTRDQADPILEGMKVLLDRLQQNEVRMNTLCQRLSSLDPSFNKQNYDQQPFSQEELKIIEEVRRECEAQTHTDKA

SEQ ID NO: 7858 - DNA, 822 bp, Erwinia carotovora subsp. atroseptica SCRI1043
  CDS (1)..(822): transl_table=11
atgtcgacagaagaactggcactggtctggaccaatatcaaagcagaagcgcgcagtctcgcagactgtgaaccgatgctggccagcttttttcacgccacattgctgaagcatgagaatctgggtagcgccctgagctacatgttggcgaataagttagccaattcgattatgcctgcgattgctattcgtgaggtggtggaagaagcttacagcgccgatccgcatatgatcgtttctgctgcgcgcgatattcaggccgtctgcctgcgcgatcctgcggtggataaatactctacgccgctgctctacctgaaagggtttcatgcgttgcaggcttatcgcattggtcactggctttggtcgcaggatcgtaaagcactggcggtctatttccagaatcagatctcagtttcttttggtgtcgatattcacccagcggcgagaatcggttgtgggatcatgctcgatcacgcaacaggtattgtgatcggtgaaacggccgtggttgaaaacgatgtctccattctacaatccgttacgcttggcggtacgggcaaaaccagcggcgatcgtcaccctaaaattcgtgaaggtgtgatgattggcgcaggcgctaaaattttggggaacattgaagttggctgtggcgcgaaaattggtgctggttctgtcgtgctgcaatccgttcctccacatacgacggcggcaggggttccggcccgtatcgtcggtcgaccagaaagcgataagcccgccatggatatggatcagtatttcaacggtatcaaccgcggctttgaatacggcgacggcatctaa

SEQ ID NO: 7859 - protein, 273 aa, Erwinia carotovora subsp. atroseptica SCRI1043
MSTEELALVWTNIKAEARSLADCEPMLASFFHATLLKHENLGSALSYMLANKLANSIMPAIAIREVVEEAYSADPHMIVSAARDIQAVCLRDPAVDKYSTPLLYLKGFHALQAYRIGHWLWSQDRKALAVYFQNQISVSFGVDIHPAARIGCGIMLDHATGIVIGETAVVENDVSILQSVTLGGTGKTSGDRHPKIREGVMIGAGAKILGNIEVGCGAKIGAGSVVLQSVPPHTTAAGVPARIVGRPESDKPAMDMDQYFNGINRGFEYGDGI

SEQ ID NO: 7860 - DNA, 573 bp, Propionibacterium acnes KPA171202
  CDS (1)..(573): transl_table=11
atgagcactgagacgacggccctgctccggaccctcaagcgatgcaaggaacgcgcgatggaggacctcgacgccgccatgcgcgaggatcccgccgctacctcgaagctcatggtcgccatcgcctaccaaggtgttcacgccatctgggcgcatcgcctagcccacgccatgtgggtcaagaagcctgcgctgcgaccactagcacggttgttgtcacaattgtctcgccacatcaccggcattgagatccatccgggggcgacgattggacgccggttcttcatcgaccacggcatgggcgtcgttattggtgagacggcggtcgtcggtgacgacgtcctcatgtatcaccaggtgaccctcggcggccgcgcccgcggacagttcaagcgtcaccccacgattggcaaccgtgtcctcatcggcgcgggagccaagatcattggcaacatcacggttggcgacgactgcaagatcggcgccaacgcgttggtcgtcaaggatgtcgcccccggcacagtcgtcgtcggaatcccgtcgaaggtgcaccagggcgacgtcatcgcctga

SEQ ID NO: 7861 - protein, 190 aa, Propionibacterium acnes KPA171202
MSTETTALLRTLKRCKERAMEDLDAAMREDPAATSKLMVAIAYQGVHAIWAHRLAHAMWVKKPALRPLARLLSQLSRHITGIEIHPGATIGRRFFIDHGMGVVIGETAVVGDDVLMYHQVTLGGRARGQFKRHPTIGNRVLIGAGAKIIGNITVGDDCKIGANALVVKDVAPGTVVVGIPSKVHQGDVIA

SEQ ID NO: 7862 - DNA, 564 bp, Leifsonia xyli subsp. xyli str. CTCB07
  CDS (1)..(564): transl_table=11
atgttccgggtgtgcgaagacctcggcaacgcgcgcaagcacgatcccgccgcacgcggccccgtcgaggtcgcgattgtgtactccggcctccacgccgtctgggcgtaccgcgtagcgcaccggctgtggcgcgccgggctccgcacacccgcgcggatgctctcccagttcgcgcgcttcctgaccggcatcgagatccaccccggcgcccgcatcggccggcgcttcttcatcgaccacgggatgggcgtcgtgatcggcgagaccgcctggatcggcgacgatgtgctgctctaccacggggtcacccttggcgggcgcggcagcgagcacggcaaacgccacccgaccgtccacgacggagtggtcgtgggagcgggtgcgaaagtgctgggcgcgatcacgatcggggcgcgcacggtcatcggcgcgaacgccgtcgtcgttcacgacgcgccgccggactcggtgctgaccggcgtgcccgcccgcccgcgcccgcacctgggccgcgagcagatcgcgggcgacgactggctcgacccggcgctctacatctga

SEQ ID NO: 7863 - protein, 187 aa, Leifsonia xyli subsp. xyli str. CTCB07
MFRVCEDLGNARKHDPAARGPVEVAIVYSGLHAVWAYRVAHRLWRAGLRTPARMLSQFARFLTGIEIHPGARIGRRFFIDHGMGVVIGETAWIGDDVLLYHGVTLGGRGSEHGKRHPTVHDGVVVGAGAKVLGAITIGARTVIGANAVVVHDAPPDSVLTGVPARPRPHLGREQIAGDDWLDPALYI

SEQ ID NO: 7864 - DNA, 978 bp, Desulfotalea psychrophila LSv54
  CDS (1)..(978): transl_table=11
atggaaaaaacgattcctaccatcccagaactttgcgatcacgttaagatcacagaaaacagtaagcataaccaacttccagatatcgtaaaaaaaatgctctcaggctggagcaccaaggaatgctttgaccatatcagtcctgtttgcatcccctctcaggaaaaaattatcgatattgccctccaggcacgtcgcatcatattccccggctacttcaccacaaccaagctccatgcctccaatattgagtactatattggcaaggagaccatggatctttatgagctggtctgcgagcagatcaccatggccatccgccatgactgccggagaaaccgcagactatgcaccaactgcgaacaggagagcgccaaactcgcccttcagttcatggaaaaattaccggaaataaccgcaacactggctcaggacattcgggcaacacttgctggtgaccccgcaaccaagagtccagatgaggtcatcttttgttacccgggtctactggccaccttggtctaccgacttgcccatgaactcttcctccttgaggtaccctttgtcccaagaataatgactgaatacgcccatagccaaacaggcatcgatattcatcccggtgcccaaattgccccgggatttttcattgaccacggcacaggcatcgttattggcgagacaaccattattggtgagaacgtacgtatctatcagggtgttaccctaggagcactctctctcccccgcgatgcgggcgagaaactacgctcaacaaaacgccatccaaccattgaaaacgatgttatcatctatgccaataccaccattcttggcggcaccaccaccataggtgagggctcggtcattggcggtaatagctggatcatcgaaagtgttgaacagggctctaaggtatttttaaaaaaacctgagcttatcgtgcaccatgcaaatgggcaaaaaacacatctatag

SEQ ID NO: 7865 - protein, 325 aa, Desulfotalea psychrophila LSv54
MEKTIPTIPELCDHVKITENSKHNQLPDIVKKMLSGWSTKECFDHISPVCIPSQEKIIDIALQARRIIFPGYFTTTKLHASNIEYYIGKETMDLYELVCEQITMAIRHDCRRNRRLCTNCEQESAKLALQFMEKLPEITATLAQDIRATLAGDPATKSPDEVIFCYPGLLATLVYRLAHELFLLEVPFVPRIMTEYAHSQTGIDIHPGAQIAPGFFIDHGTGIVIGETTIIGENVRIYQGVTLGALSLPRDAGEKLRSTKRHPTIENDVIIYANTTILGGTTTIGEGSVIGGNSWIIESVEQGSKVFLKKPELIVHHANGQKTHL

SEQ ID NO: 7866 - DNA, 702 bp, Symbiobacterium thermophilum IAM 14863
  CDS (1)..(702): transl_table=11
atgttcagcctgttcaagcggcttcggcgggacatcgaggcggtcttcgagcgggatccggcggcgcgttccgtgctggaggtgctgctctgctatccgggactgaaggcgatctgggcccaccgggtggcacactggctgtggcagcggaacttcaaactcctggcccgtgtgatctctcagatctcccgttttttcacccagatcgagattcaccccggcgccaagatcggggaaggcgtcttcatcgaccacggctgcggcgtcgtcatcggcgagaccgcagaggtgggcaacaatgtgaccatctaccagggcgtgaccctgggcggcaccggcaaggagaagggcaagcggcacccgacgatcggggacaacgtggtgatcggcaccggcgcccgcatcctgggctcgttcacggtgggggccaacagccgcatcggcgccggcgccgtagtactgcgggaggtgccgcccaactccaccgtcgtcggcaacccgggccgggtcgtggtgcagaacggcgtgcgcacggaccagctggacatgatccacatgcccgatccgatcgcaaacatgtttgaccagatgcagcgccagatcgacaagctgacccagcgcatcgagcggctggaggaggagaaccgggcgctgcgcagattacaggagggtttggcgcatgggcatccgcatctacaatga

SEQ ID NO: 7867 - protein, 233 aa, Symbiobacterium thermophilum IAM 14863
MFSLFKRLRRDIEAVFERDPAARSVLEVLLCYPGLKAIWAHRVAHWLWQRNFKLLARVISQISRFFTQIEIHPGAKIGEGVFIDHGCGVVIGETAEVGNNVTIYQGVTLGGTGKEKGKRHPTIGDNVVIGTGARILGSFTVGANSRIGAGAVVLREVPPNSTVVGNPGRVVVQNGVRTDQLDMIHMPDPIANMFDQMQRQIDKLTQRIERLEEENRALRRLQEGLAHGHPHLQ

SEQ ID NO: 7868 - DNA, 798 bp, Mannheimia succiniciproducens MBEL55E
  CDS (1)..(798): transl_table=11
atgttacgtgaagtctggaataatatccgcaatgaagcaaaagaacttgttgaacatgagcccgttctagccagcttcttccattccactattctaaaacataaaaatttaggcggtgcattgagttatattttagccaacaaattggcaacctctaccatgccggcaattaccttgcgtgaaattattgaagaaacttatcaagacgacccgcgtattatcgacagcgccgcttgcgacattcatgccgtgcgtcaacgtgaccctgcagtcggcttatgggcgacgccgttactttatttaaaaggttttcatgctattcagagttatcgtattactcatcatctttggcaacaaaaccgcaaatcgcttgccatttatctgcaaaaccagatttccgtggcgtttgacgtggatattcatccggcggcgcgtgtgggttgcggcattatgtttgaccatgccaccggcattgtggtgggggaaaccgcagtaattgaaaatgacgtatctattttgcagggcgtaacccttggcggtacggggaaagaatccggcgatcgccacccgaaaatccgcgagggcgtgatgattggtgcgggtgcgaaaattttaggtaatattgaagtgggtaaatacgctaaaatcggcgctaattccgtggttttgcaacccgtaccggaatatgccactgcagcgggtgtgccggcgaagattatcagcaaagaccgcagtgcaaaaccggcttttgatatgaaccaatattttattgatgatgcggaagctttgaatatttag

SEQ ID NO: 7869 - protein, 265 aa, Mannheimia succiniciproducens MBEL55E
MLREVWNNIRNEAKELVEHEPVLASFFHSTILKHKNLGGALSYILANKLATSTMPAITLREIIEETYQDDPRIIDSAACDIHAVRQRDPAVGLWATPLLYLKGFHAIQSYRITHHLWQQNRKSLAIYLQNQISVAFDVDIHPAARVGCGIMFDHATGIVVGETAVIENDVSILQGVTLGGTGKESGDRHPKIREGVMIGAGAKILGNIEVGKYAKIGANSVVLQPVPEYATAAGVPAKIISKDRSAKPAFDMNQYFIDDAEALNI

SEQ ID NO: 7870 - DNA, 651 bp, Bacillus licheniformis ATCC 14580
  CDS (1)..(651): transl_table=11
atgttctttaaaatgctgaaagaagatgtagatgtcgtatttgaccaagatccggctgcgagaagctacattgaagtcatcttaacttattcaggtttgcatgctatatgggcacatcgaattgcacatgctttatataaaagaaaaaggtttttcatcgccagagcgatctctcaaatcgcccgcttctttacgggaatcgaaattcacccgggtgccaagatcggcaggagatttttcattgatcacggcatgggggttgtgatcggcgaaacctgtgagatcggaaacaatgtcacggtttttcagggcgtgacgcttgggggaacaggaaaagaaaaaggcaaaaggcatccgacaatcgaggacgatgccctgatctcaacaggggctaaagtgcttggatccattacagtcggaagaggggcgaaaatcggtgcaggctccgtcgtcctgcacgatgtgcctgaatgctccaccgttgtcggcatcccgggccgggtcgtcgtacaaaacggaaagaaaatcagacgcgacttgaatcaccaggatttgccggatccggtggctgaccgcttcagagaattggaaaacgaaatcaggcagctgaaacaagagctccggagaaaagaaagggaagatgagctgtga

SEQ ID NO: 7871 - protein, 216 aa, Bacillus licheniformis ATCC 14580
MFFKMLKEDVDVVFDQDPAARSYIEVILTYSGLHAIWAHRIAHALYKRKRFFIARAISQIARFFTGIEIHPGAKIGRRFFIDHGMGVVIGETCEIGNNVTVFQGVTLGGTGKEKGKRHPTIEDDALISTGAKVLGSITVGRGAKIGAGSVVLHDVPECSTVVGIPGRVVVQNGKKIRRDLNHQDLPDPVADRFRELENEIRQLKQELRRKEREDEL

SEQ ID NO: 7872 - DNA, 828 bp, Burkholderia mallei ATCC 23344
  CDS (1)..(828): transl_table=11
atgcgcctcgggccgcccgatcttcggcaggagagtgaaaatttctatgtgagccacgcgctcgacgacgcattgcatgcgcttctcgcgcaggctcggctcgaattgcgctacaagggccgacacgatgccgacgcgcccgccgaagccgcgatcgacgcgaaagccgatgcggcggtgcgcgcgttcgccgcgcgcctgcccgatatccgcgcgctgctcgacagcgacgtgctggccgcgtttcacggcgatccggccgcgggcagcgtcgacgaggtgctgctttgctaccccggcgtgctggcgatgatccatcaccggctcgcgcacgcgctgtatcgcctcgaattgccgctgctcgcgcgcatcgtcgccgagcatgcgcacgcgcagacggggatcgacattcatcccggcgcgcagatcggcggcggattcttcatcgatcacggcacgggcgtcgtgatcggcgagaccgcggtgatcggcgagcgcgtgcgcgtctatcaggcggtcacgctcggcgcgaagcgctttccgagggacgcgtccgggcatctcgaaaagggactcgcgcgccacccgatcgtcgaggacgatgtcgtcgtctatgcgggcgcgacgattctcggccgcgtgacgatcggcaagggcgcggtgattggcggcaacgtgtggatcacgcaggacatcccgcccggcagccatgtcacgcaagccgtcacgcgcagcgatccggcgcggccggccgacgcggccgcctcgtcgccgtggccggccggcgcgcacgacgcgacgctttcggccgcgcaggcgctgcgatga

SEQ ID NO: 7873 - protein, 275 aa, Burkholderia mallei ATCC 23344
MRLGPPDLRQESENFYVSHALDDALHALLAQARLELRYKGRHDADAPAEAAIDAKADAAVRAFAARLPDIRALLDSDVLAAFHGDPAAGSVDEVLLCYPGVLAMIHHRLAHALYRLELPLLARIVAEHAHAQTGIDIHPGAQIGGGFFIDHGTGVVIGETAVIGERVRVYQAVTLGAKRFPRDASGHLEKGLARHPIVEDDVVVYAGATILGRVTIGKGAVIGGNVWITQDIPPGSHVTQAVTRSDPARPADAAASSPWPAGAHDATLSAAQALR

SEQ ID NO: 7874 - DNA, 750 bp, Methylococcus capsulatus str. Bath
  CDS (1)..(750): transl_table=11
atggtaggaggcgaagccgccagcccgtccctcgcggagcttctgcgtgaggacgttggctgcgtattcgagcgcgatccggcggcccgcagccggctggaagtcatgttgacctatcccggtgtccacgcggtgctgctgcaccggttcgcccaccgcctgtggcgcgccggacatcggctgagcgcacggctgctggcggcgttcgcccgctggctgaccaacgtcgacattcatcccggcgcgaccatcggccggcgcttcttcatcgatcacggcgccggcgtcgtgatcggcgagaccgcggagatcggcgacgacgtgactctctatcatggcgtcaccctcggcggaacctcgtggaacaaggtcaaacgccatcccaccctgggcaacggcgtgctgatcggcgcgggcgccaaggttctgggtcccatcgtcctgggcgaccaggttcgagtcggtgcgaattcggtcgtgatcaaggacgtgccggcttattgcacggtggtcgggattcccggcaaggtcgtgcagcccaagagttcgcgtaagtccgacccgcacggcatcgacctggaccatcatctgatccccgatccggtcggcagggcagtgcaatgcctgctggatcggatcgagatcctggaagacgaactggtgaagcggcgcgtcgaagcggcccacgaatgcaggcagtgcgatggcgaggcggtgtgcagggaacccgcggcagccgatcttgaatga

SEQ ID NO: 7875 - protein, 249 aa, Methylococcus capsulatus str. Bath
MVGGEAASPSLAELLREDVGCVFERDPAARSRLEVMLTYPGVHAVLLHRFAHRLWRAGHRLSARLLAAFARWLTNVDIHPGATIGRRFFIDHGAGVVIGETAEIGDDVTLYHGVTLGGTSWNKVKRHPTLGNGVLIGAGAKVLGPIVLGDQVRVGANSVVIKDVPAYCTVVGIPGKVVQPKSSRKSDPHGIDLDHHLIPDPVGRAVQCLLDRIEILEDELVKRRVEAAHECRQCDGEAVCREPAAADLE

SEQ ID NO: 7876 - DNA, 786 bp, Methylococcus capsulatus str. Bath
  CDS (1)..(786): transl_table=11
atgctgaagaaaattagagaagagttcggttgcatattcgcccgggaccccgcggcccagtcgtttttcgagatactgaccgtctatcccggcgtccacgccgtgctgatccaccgcttcagccactggctctggaaccacggcctgcactggcccgcgagggtcctgtcctatctcgcgcgctgggcgaccggcatcgagatccaccccggagcgacgctgggccggaggctgttcatcgaccatggcatgggcgtcgtcatcggagagaccgcggtaatcggggacgattgcacgctataccacggcgtgaccctgggcggcaccagctggcagaagggcaaacgccatccgacgctgggcaacggcgtggtggtcggcgccggcgccaaggtactcggccccatcacggtgggcgacggcgcccgcatcggctccaattcggtcgtgctgcgcaccgtccccgcaggcgccacggtggtcggcattccgggccacatcatcaatccggatcgcagggcgcaggaagcgcagcgcctggccatcgccagcagactcggcttcgacgcctacggcatgacgccggacatgccggaccccgtcgcccacgccatcaatcacatgctcgaccatatccaggcattggaccagcaagtcgcgaagctcaaggaagtgctgcgggaacgaggaatcgacctggaagaagcccctctgcccgatctggacgactgccaactcgaccccggcgagccgcaggtgaccgtcaacagttcccgcacgggctga

SEQ ID NO: 7877 - protein, 261 aa, Methylococcus capsulatus str. Bath
MLKKIREEFGCIFARDPAAQSFFEILTVYPGVHAVLIHRFSHWLWNHGLHWPARVLSYLARWATGIEIHPGATLGRRLFIDHGMGVVIGETAVIGDDCTLYHGVTLGGTSWQKGKRHPTLGNGVVVGAGAKVLGPITVGDGARIGSNSVVLRTVPAGATVVGIPGHIINPDRRAQEAQRLAIASRLGFDAYGMTPDMPDPVAHAINHMLDHIQALDQQVAKLKEVLRERGIDLEEAPLPDLDDCQLDPGEPQVTVNSSRTG

SEQ ID NO: 7878 - DNA, 768 bp, Azoarcus sp. EbN1
  CDS (1)..(768): transl_table=11
atgttcagccgcctgcgcgaagacttggccagcgttcgcgaacgcgaccccgccgcccgctccacttgggaagtgctgacctgttatcccggcgtgcatgcgctcatgttccaccgcctcgcgcacgcggcgtggacccgcgagctgttctggatcggccgtttcgtcagtcacatctcgcgcttcctgaccggcatcgagatccatcccggggcgacgataggccgacgcgtgttcatcgaccacggcatgggcgtggttatcggcgagaccgccgaagtcggtgacgattgcacgatctatcaggcggtcacgctcggcgggacctcgctgtatcgcggcaccaagcgccacccgacgctcggcaacggcgtcgtcgtcggcgccggcgcgaaagtgctcggcggcttcaccgtcggtgatggcgcacgcatcggctccaatgccgtcgtcgtcaagccggtgccggccggaaggacggcggtcggcaatcctgcccgcgtcatcgatccggaacgcaccgatgcgcgtgacaaggcgcgcgagcagaaggccgagcagatgggcttctcggcatatggcgtcaccaagcagatggacgacccgatcgcgaaggcgatgcacggcctgctggatcacgcggtcgaaaccgatcgtcgtattcagctactcgtcgaacagctcgaaaaggccggtgtgaggctggattcgacgatcgagcagagcgacgaattcgatgcccagcgcctctcgaaaatggttgattga

SEQ ID NO: 7879 - protein, 255 aa, Azoarcus sp. EbN1
MFSRLREDLASVRERDPAARSTWEVLTCYPGVHALMFHRLAHAAWTRELFWIGRFVSHISRFLTGIEIHPGATIGRRVFIDHGMGVVIGETAEVGDDCTIYQAVTLGGTSLYRGTKRHPTLGNGVVVGAGAKVLGGFTVGDGARIGSNAVVVKPVPAGRTAVGNPARVIDPERTDARDKAREQKAEQMGFSAYGVTKQMDDPIAKAMHGLLDHAVETDRRIQLLVEQLEKAGVRLDSTIEQSDEFDAQRLSKMVD

SEQ ID NO: 7880 - DNA, 813 bp, Silicibacter pomeroyi DSS-3
  CDS (1)..(813): transl_table=11
atgatggaaacgcgcaagaaacttgcccccgtggacccggtctgggaccggattaccgccgaagcacaggacgctgtggacagagagcccctgatgggtgggctggtgcatgcctgtatcctgcaccacaagaatctcgaccgggcgctgtcctatcgcatttccgccaagctgtgctcgaacgaaatgtcgatgatggtgctgcgcgagatcgtcgatgacgcctatgacagtgcgcccgagctgatcgaggctgcgcgtgccgatctgatggccgtttacgagcgtgatccggcctgccaccggctgttgcagccgatcctctatttcaaggggtaccaggcgatgcaggcctatcgcgtggcgcattggctgtggacgcgcaagcgctatgatctggcctatttcttccagatgcgggtttccgagattttcggcgtcgatatccacccggcggcccggatcggcaaggggatcatgatcgaccatgcccattccatcgtgatcggcgaaacggcagtggtcggcgacaatgtctcgatgctgcattcggtgacgctgggcggcaccggcaaggaggaagaggatcgccaccccaagatcggcgatggtgtgctgatcggagcaggcgccaaggtgctgggcaatatcaaggtcggtcattgcagccgtatcgccgccggttcggtggtgctgagcgaagtgcccccctgcaagaccgtggcaggtatcccggccaagatcgtgggcgaggcgggctgcgatcagccctcggtcagtatggaccagaggttcccgaacggctcggactag

SEQ ID NO: 7881 - protein, 270 aa, Silicibacter pomeroyi DSS-3
MMETRKKLAPVDPVWDRITAEAQDAVDREPLMGGLVHACILHHKNLDRALSYRISAKLCSNEMSMMVLREIVDDAYDSAPELIEAARADLMAVYERDPACHRLLQPILYFKGYQAMQAYRVAHWLWTRKRYDLAYFFQMRVSEIFGVDIHPAARIGKGIMIDHAHSIVIGETAVVGDNVSMLHSVTLGGTGKEEEDRHPKIGDGVLIGAGAKVLGNIKVGHCSRIAAGSVVLSEVPPCKTVAGIPAKIVGEAGCDQPSVSMDQRFPNGSD

SEQ ID NO: 7882 - DNA, 666 bp, Bacillus clausii KSM-K16
  CDS (1)..(666): transl_table=11
atggggcttgctcgtacattgttgaatgatattgatgtcgtctttgaacaagatcctgctgcacgtagtcggctagaagtcatttttacgtactcgggtgtgcatgctgtttgggggcatcggattgctcacggtctatggaaacggaaatggtatttcttagcgcgcctgctttcgcaaattgtccgctttatgacagggattgaaatccatccaggggcaaagatcgggcaaaggctatttattgaccacggcatgggcgtcgtcattggcgagacttgcgaaattggcgacaatgtaacgattttccaaggcgtaactttagggggcactggcaaagaaaaggggaagcgccatccaactgtaaaagacggcgtgctcattgccagtggagctaaagtgcttggctcatttacaatcggcgaaggcgcccggataggggcaggctctgtcgtgttaaacgaagtgccaccccattcgacggttgtaggtatccctgggaaaattgttgtgcaaaatggaataaaagtgagctcggcccgttcccttgaccaccatgccttgcctgaccctgttgctgacaagattgctgaattagaacgggaaattgcccgtttaaaagcagagtacagcaagcttgccgataaacaaagcacattggactag

SEQ ID NO: 7883 - protein, 221 aa, Bacillus clausii KSM-K16
MGLARTLLNDIDVVFEQDPAARSRLEVIFTYSGVHAVWGHRIAHGLWKRKWYFLARLLSQIVRFMTGIEIHPGAKIGQRLFIDHGMGVVIGETCEIGDNVTIFQGVTLGGTGKEKGKRHPTVKDGVLIASGAKVLGSFTIGEGARIGAGSVVLNEVPPHSTVVGIPGKIVVQNGIKVSSARSLDHHALPDPVADKIAELEREIARLKAEYSKLADKQSTLD

SEQ ID NO: 7884 - DNA, 639 bp, Campylobacter jejuni RM1221
  CDS (1)..(639): transl_table=11
atgaatttttggggtattataaaagaagatttttctcagccaaaggcacaagatccagcttttaattcttgtatagaacttttttttaattaccctggagtatgggctgtagtaaattaccgctttgcacattttttttacataagaaattttaaacgcattgctagaatgattagcggaatttcacaattcttaactggggtagatttgcaccctggagcagaacttggaaggcgtatttttatagatcatgccaatggagtggttataggtcaaacagcaattatagaagatgatgttttaatttatcaaggcgttactttaggtggaacaagccttgaaaaaggtactaaacgccatccaaccataaaaaaaggagtgatcataggctcaggcgcaaaagtacttggcaatatcaccataggagaaaatgccaaaataggctcaaatgctgtagtggttaaagatgtaggtgcaaatttaactgccgttggaattcctgcttatattatcgaagagcgtaaaaataaaaacattagagctatagatgcaaattgcgatgacaaactagaaaagttagaaaagaaaattttagaacttgaaaatcttatattaaaacaacctgaatcacaaaaataa

SEQ ID NO: 7885 - protein, 212 aa, Campylobacter jejuni RM1221
MNFWGIIKEDFSQPKAQDPAFNSCIELFFNYPGVWAVVNYRFAHFFYIRNFKRIARMISGISQFLTGVDLHPGAELGRRIFIDHANGVVIGQTAIIEDDVLIYQGVTLGGTSLEKGTKRHPTIKKGVIIGSGAKVLGNITIGENAKIGSNAVVVKDVGANLTAVGIPAYIIEERKNKNIRAIDANCDDKLEKLEKKILELENLILKQPESQK

SEQ ID NO: 7886 - DNA, 693 bp, Dehalococcoides ethenogenes 195
  CDS (1)..(693): transl_table=11
atgataaaagatattagaaacgttttcagtaaagacccggctgcccgaagtgtggcagaggttcttttttgttatccgggtttgcatgccctctggtttcaccgggtggcaaactggctttggcgtcacaagctccatttctgggcacgctggctttcccacggcgggcggttctgcaccggcattgagattcatccgggggcaaaaataggccagcgtttcttcattgaccatggaatgggtgtagtcattggtgaaacctctgaaattggtgatgacgtgctcatgtatcagggggtggtcttaggcggcaccagtttgtccaagggtaagcgtcaccctactatcggcagcaatgtggttatcggcacaggtgcggtagtgctgggcggcattacagtgggcgaaggggcaaaaataggggcgggttcggtagtgactaaagacgttccggccggggcaactgtagtgggtataccggggcgggtagtagaagaatcccgccagatggttattgatttggaacacggcaaactgcctgacccggtagcggatgccttaaaggtagtgctggccgaacagcaaaagctgatggacaggcttgcccagcttgaaaaaaacagcgagctgaaagtgcctcaggatgagcttcgcgggcagatacgtgaaattatgaaagagtttaacctctga

SEQ ID NO: 7887 - protein, 230 aa, Dehalococcoides ethenogenes 195
MIKDIRNVFSKDPAARSVAEVLFCYPGLHALWFHRVANWLWRHKLHFWARWLSHGGRFCTGIEIHPGAKIGQRFFIDHGMGVVIGETSEIGDDVLMYQGVVLGGTSLSKGKRHPTIGSNVVIGTGAVVLGGITVGEGAKIGAGSVVTKDVPAGATVVGIPGRVVEESRQMVIDLEHGKLPDPVADALKVVLAEQQKLMDRLAQLEKNSELKVPQDELRGQIREIMKEFNL

SEQ ID NO: 7888 - DNA, 567 bp, Corynebacterium glutamicum ATCC 13032
  CDS (1)..(567): transl_table=11
atgctctcgacaataaaaatgatccgtgaagatctcgcaaacgctcgtgaacacgatccagcagcccgaggcgatttagaaaacgcagtggtttactccggactccacgccatctgggcacatcgagttgccaacagctggtggaaatccggtttccgcggccccgcccgcgtattagcccaattcacccgattcctcaccggcattgaaattcaccccggtgccaccattggtcgtcgcttttttattgaccacggaatgggaatcgtcatcggcgaaaccgctgaaatcggcgaaggcgtcatgctctaccacggcgtcaccctcggcggacaggttctcacccaaaccaagcgccaccccacgctctgcgacaacgtgacagtcggcgcgggcgcaaaaatcttaggtcccatcaccatcggcgaaggctccgcaattggcgccaatgcagttgtcaccaaagacgtgccggcagaacacatcgcagtcggaattcctgcggtagcacgcccacgtggcaagacagagaagatcaagctcgtcgatccggactattacatttaa

SEQ ID NO: 7889 - protein, 188 aa, Corynebacterium glutamicum ATCC 13032
MLSTIKMIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 7890 - DNA, 954 bp, Pseudomonas syringae pv. syringae B728a
  CDS (1)..(954): transl_table=11
atgagcgatattccagaagcgtccgccgacggccgctccagccactggcagttgcagcgcatcgtcagccagttgcgtggcgcgcgtgaagactggcgggctcgcaacaggcgggtgagcggtgaacacggtggacgtgagctgccttcgcgtgcggccatgggcgagattcttgaagccttgagcggtgctctgttcccgatgcgcctgggccctgtggacctgcgtgaggaaagcgaggacttctatgtcggccatacgctggatgtggcgctcaacgcgctgctggctcaggcccggcttgaattgcgctacgtggcccatcagcagggcggtgacctgaagagcatcgatgcgcgggcgctcgagctgattcagggtttcgccatggccctgccgggtattcgtctgttgctggacaccgacgtgctggctgcctatcacggtgacccagcggcgcgcagtgtcgatgaagtgctgctgtgctatcccggcattctggcggtgatccaccatcgtctggcgcattatctgtatcgcgccggtttgccgttgctggcgcgtatcagctcggaaatcgcccattctgcgaccggtatcgatattcatccgggcgcgcagatcggcccgagcttctttatcgatcacgggacaggcgtggtgattggcgaaaccgcgatcatcggcgagcgggtgcggatctatcaggccgtgaccctgggcgccaagcgcttcccctcagacgaggacggccagttgcagaaaggccatgcacggcatccgatcgttgaagacgacgtggtgatctacgctggcgcgacgattctggggcgcatcaccatcggcaaaggttcgaccatcggcggcaatgtctggctgacgcgcagcgtaccggcagactgcaacctgacccaggccaacctgctgcaacaggacgactgcagccgcaagtag

SEQ ID NO: 7891 - protein, 317 aa, Pseudomonas syringae pv. syringae B728a
MSDIPEASADGRSSHWQLQRIVSQLRGAREDWRARNRRVSGEHGGRELPSRAAMGEILEALSGALFPMRLGPVDLREESEDFYVGHTLDVALNALLAQARLELRYVAHQQGGDLKSIDARALELIQGFAMALPGIRLLLDTDVLAAYHGDPAARSVDEVLLCYPGILAVIHHRLAHYLYRAGLPLLARISSEIAHSATGIDIHPGAQIGPSFFIDHGTGVVIGETAIIGERVRIYQAVTLGAKRFPSDEDGQLQKGHARHPIVEDDVVIYAGATILGRITIGKGSTIGGNVWLTRSVPADCNLTQANLLQQDDCSRK

SEQ ID NO: 7892 - DNA, 777 bp, Pseudomonas syringae pv. syringae B728a
  CDS (1)..(777): transl_table=11
atgttcgagcgtctgcgagaagacattcaaagcgtgttccaccgcgatcccgcagcgcgcaacgcctttgaagtcctgacctgctatccggggatgcacgcgatctggctgcaccgcttcgcccacattctgtggcgcaacggctggaaatggccagcgcgggtagtctcgaacttcggccgctggatgaccggtatcgagatccatccgggtgcgcgcatcggtcgccgcttttttatcgaccacggcatgggcatcgtgattggcgagaccgccgagatcggcaatgacgtcaccctctatcagggtgtgaccctgggcggcaccacttggaatgccggcaagcgccatccgacgctggaggacggtgtggtggtcggggcgggtgccaaggtacttgggccgttcactgtcggcgccggcgccaagattggctccaacgcagtggtcaccaaggctgtgcctgcgggcgcaaccgcagtgggcatcccggggcggatcatcgtcaagtcggacgacgaggttgaggccaggcgcaaagccatggccgagaagctcggcttcgacgcgtacggtgtcagtgcagatatgcctgatccggtcgcgcgcgccattggccagttgcttgaccatttgcaggctgtcgacggccgtcttgaaggcatgtgcgatgcgctcggcaggcttggcagcgattaccgcgccaaggagctgccggagttgcgcgacgaggttttcgactgcgtcaaggactgccaggaaggcaaggtcggctag

SEQ ID NO: 7893 - protein, 258 aa, Pseudomonas syringae pv. syringae B728a
MFERLREDIQSVFHRDPAARNAFEVLTCYPGMHAIWLHRFAHILWRNGWKWPARVVSNFGRWMTGIEIHPGARIGRRFFIDHGMGIVIGETAEIGNDVTLYQGVTLGGTTWNAGKRHPTLEDGVVVGAGAKVLGPFTVGAGAKIGSNAVVTKAVPAGATAVGIPGRIIVKSDDEVEARRKAMAEKLGFDAYGVSADMPDPVARAIGQLLDHLQAVDGRLEGMCDALGRLGSDYRAKELPELRDEVFDCVKDCQEGKVG

SEQ ID NO: 7894 - DNA, 705 bp, Pseudomonas syringae pv. syringae B728a
  CDS (1)..(705): transl_table=11
atggacatacgatcagtaccttcttcccgactcgccgtcgcaggtggtcaggagtcgtttcaactggtcaagaaccttgtcatcgcagcattgctggaatgctgttctgtagaggagttcaatgaattaaaagaaacccttctcattgagtacgttaccgagcagtcgcacgaggatctattgatgttcgcgcgcaaggacccggcctcttgcggcgatcctttggtcattgcaaggacttacacgtccttcgcagcggtaatgcattaccgcctggcccactgtgtataccaaaatgcaaaaagaagctgtaactcccacgaacagtctctggcagccatcatttccaggcgaggaaaaatgctctctggcgcagaaatccatttccgctgcagcataggtgctcgacttatcatcgatcatgggttcggtactgtaattggcgagaccgccataattggcgacgactgttatattctcggaggtgtaacactgggagccagaggtatcagcagtaatccttcgataccgcgtcatcctaaagtaggcagtcgcgtgcagataggcgctttttcaagcgtattgggtccggtgaacataggtgacgatgcattcagtggaccgcgctgtatcatcacccaagacgttccctcgggtgctcgagtgcaagtgaaaacatcactgcaggtggtaattgagcaatga

SEQ ID NO: 7895 - protein, 234 aa, Pseudomonas syringae pv. syringae B728a
MDIRSVPSSRLAVAGGQESFQLVKNLVIAALLECCSVEEFNELKETLLIEYVTEQSHEDLLMFARKDPASCGDPLVIARTYTSFAAVMHYRLAHCVYQNAKRSCNSHEQSLAAIISRRGKMLSGAEIHFRCSIGARLIIDHGFGTVIGETAIIGDDCYILGGVTLGARGISSNPSIPRHPKVGSRVQIGAFSSVLGPVNIGDDAFSGPRCIITQDVPSGARVQVKTSLQVVIEQ

SEQ ID NO: 7896 - DNA, 927 bp, Pseudomonas fluorescens Pf-5
  CDS (1)..(927): transl_table=11
atgagcgagcgttccagccattggcaattgcagaccatcgttggccaactgcgtgatgcccgtgaccagtggcgtacccgcaacggtcgggtcagcggcgagcagggcgggcgtgagctgccgtcgcgggcggccatggcggaaatcctcgaggccctgtgcggtgccctgtttcccatgcgcctggggccggtggacctgcgcgaagagagcgaggatttctacgtgggccacaccctggacgcggcgctcaacgctttgctggcccaggcgcgcctggagctgcgctatgtggcccggcagagcggcgaggccgatgccgaagtcaacgcccgggcgatccgcctgatccaggatttcgccctggccctgcccggcctgcgggtgctgctggacaccgatgtgctggcggcctatcacggcgaccctgcggcccgcagcgtggatgaggtgctgctgtgctaccccggcatcctggcggtgattcaccaccgcctggcgcaccatctgtatcgcgccggcctgccgctgctggcgcggatcagctcggaaatcgcccactcggccaccggcatcgacatccacccgggtgcgcagatcggccgcagcttcttcatcgaccacggtaccggcgtggtgattggcgagaccgcgatcatcggcgagcgggtgcgcatctatcaggcggtgaccctgggcgccaagcgcttcccggcggacgaggacggccagttgcagaagggccacccgcgccacccgatcgtcgaggacgacgtggtgatctacgccggcgcgaccatcctggggcgcatcaccatcggcaagggctcgaccattggcggcaacgtctggctgacccgcagcgtgccggccggctgcaacctgacccaggccaacctgcagcacgacgacggctcgcagaagtag

SEQ ID NO: 7897 - protein, 308 aa, Pseudomonas fluorescens Pf-5
MSERSSHWQLQTIVGQLRDARDQWRTRNGRVSGEQGGRELPSRAAMAEILEALCGALFPMRLGPVDLREESEDFYVGHTLDAALNALLAQARLELRYVARQSGEADAEVNARAIRLIQDFALALPGLRVLLDTDVLAAYHGDPAARSVDEVLLCYPGILAVIHHRLAHHLYRAGLPLLARISSEIAHSATGIDIHPGAQIGRSFFIDHGTGVVIGETAIIGERVRIYQAVTLGAKRFPADEDGQLQKGHPRHPIVEDDVVIYAGATILGRITIGKGSTIGGNVWLTRSVPAGCNLTQANLQHDDGSQK

SEQ ID NO: 7898 - DNA, 777 bp, Pseudomonas fluorescens Pf-5
  CDS (1)..(777): transl_table=11
atgttcgaacgtctgcgtgaagatatccaaagtgttttccatcgtgacccggcagcgcgcaacgcctttgaggtgctgacctgctacccggggatgcatgcgatctggatccatcgcctgtccggcgccttgtgggggatgggctggaagtggctggcgcggctggtctcgaacttcgggcgctggctgaccgggatcgagattcatccgggggccaaggtcggtcgtcgcttctttattgaccatggaatgggcatcgtcattggcgaaaccgccgagatcggtgatgacgtcacgctttaccagggggtgaccctgggtggcaccagttggaataaaggcaagcgccacccgaccctggaagatggtgtggtggtgggggctggcgccaaggtgctggggccgttcacggtcggggccggggccaaggttggttccaatgccgtggtgaccaaggcagtgccggccggtgcgaccgtagtggggattccggggcggatcatcatgaaatccaatgatgagcaggaagccaagcgcaaggccatggcggaaaagctcggcttcgatgcctatggcgtcagcgaagatatgcctgaccccgtggcgcgggccattggtcagttgcttgatcacctgcaagcggtcgatggtcgtctggaggggatgtgtggcgcgctgaaggatctgggcagtgactactgcgccaaggacttgcctgccctgcgtgaagaagacttcgctgaagtcaagggcaagggcgacagccaggtcggctga

SEQ ID NO: 7899 - protein, 258 aa, Pseudomonas fluorescens Pf-5
MFERLREDIQSVFHRDPAARNAFEVLTCYPGMHAIWIHRLSGALWGMGWKWLARLVSNFGRWLTGIEIHPGAKVGRRFFIDHGMGIVIGETAEIGDDVTLYQGVTLGGTSWNKGKRHPTLEDGVVVGAGAKVLGPFTVGAGAKVGSNAVVTKAVPAGATVVGIPGRIIMKSNDEQEAKRKAMAEKLGFDAYGVSEDMPDPVARAIGQLLDHLQAVDGRLEGMCGALKDLGSDYCAKDLPALREEDFAEVKGKGDSQVG

SEQ ID NO: 7900 - DNA, 912 bp, Psychrobacter arcticus 273-4
  CDS (1)..(912): transl_table=11
atgtcattgccaactgctttattcaaatcgcttgtccgcatcaaaaaagacttaaaagaagatatcgatgcggtattcaatcgcgaccctgccgcgcgtaacagtctagaggtaatcttaacctaccctggcatccacgcacttattctacatcgcggcgcgcattgtctttggcaaaatgagcaaaagcttgctgctcgagtgatttcttatggctcgcgcatcatcactggtatcgagattcatcctgctgccaaaatcggtcgtcggttttttattgaccatggcatgggtatcgtcattggtgaaacggcagagattggcaatgatgtgaccctttatcatggtgtgacgcttggcggtgtgtcttggaataatggcaaacgccaccctactttggaagatggtgtcatcgtcggtgccggtgccaaagtattagggccattcactgtcggtaaaggcgctaaaatcggctcaaatgcggtggtggtaaaagcggtgccagcaggtgcaactatggtcggtagcgccgctcgtatgatttcagagcatcatgacgaaaaaggcaatcctatcacgaccaaagtcaatgacaccaaacaacaagaaaaattggtgccagccgcttctacagagaacccttccgataaaaaaccgacaaatcacacagcgcgcgaaaccacttttcaagcttatggcattgatcctatgtcacaagatcctgtcgctgaagcctttgctaaaatgcttgaacacattcaacaatcagaaaatcgtttagatcaactacaaactgccatgtgcaaaatcgatcctaatttttgcaaaaaagaatatgacaaattgtgcttagaggatttggacgtgattggcagaagtgatatgaatgagataggcgctgaatcgcaatag

SEQ ID NO: 7901 - protein, 303 aa, Psychrobacter arcticus 273-4
MSLPTALFKSLVRIKKDLKEDIDAVFNRDPAARNSLEVILTYPGIHALILHRGAHCLWQNEQKLAARVISYGSRIITGIEIHPAAKIGRRFFIDHGMGIVIGETAEIGNDVTLYHGVTLGGVSWNNGKRHPTLEDGVIVGAGAKVLGPFTVGKGAKIGSNAVVVKAVPAGATMVGSAARMISEHHDEKGNPITTKVNDTKQQEKLVPAASTENPSDKKPTNHTARETTFQAYGIDPMSQDPVAEAFAKMLEHIQQSENRLDQLQTAMCKIDPNFCKKEYDKLCLEDLDVIGRSDMNEIGAESQ

SEQ ID NO: 7902 - DNA, 810 bp, Colwellia psychrerythraea 34H
  CDS (1)..(810): transl_table=11
atgtttagtcgtatcaaagaagatatcaatagtgtctttgatagagatccagccgctcgtactagttttgaggttatcctcaattacccgggtttacatgcaatttggattcaccgattaagttatagattatggtgtgctgattggaaacttatagcgagaactatatcaactttctctcgttggttaacgggtattgagatccaccctggcgctaaattaggtcgccgtgtttttattgaccacggtatgggcattgttattggtgaaacagctgaagtaggcaatgatgtcacgctttatcacggtgtcaccttaggtgggacgagttggaaggcaggaaaacgtcatccaactttggaagacaatgttgttataggtgctggtgcgcaagtacttggaccaataactataggtaagggcggaaaagtcggttctaactcagttgttgttaaagatttacccgctaatgcaacagcagttggtattcctggtcgaatcgtgcccgataaacacagtaaagatgaaaaccagcaacgagaagaagttgctaaaaaatatggctttgatgcttatgcggtgtcccatgataatccagatcctgtggctaaagccattggtcgtttacttgatcatatgcatttaatggatgatagagtgagtgaactttgcaaagaaattaacaccttaggtggtgatatttgccctaaaaacttgcctgagttaagagtaggtgagtttgtcgaagatgaaaaagcagcggcagagcgccgtgaaaataaagtggcaagctttgatcctgaaatttaa

SEQ ID NO: 7903 - protein, 269 aa, Colwellia psychrerythraea 34H
MFSRIKEDINSVFDRDPAARTSFEVILNYPGLHAIWIHRLSYRLWCADWKLIARTISTFSRWLTGIEIHPGAKLGRRVFIDHGMGIVIGETAEVGNDVTLYHGVTLGGTSWKAGKRHPTLEDNVVIGAGAQVLGPITIGKGGKVGSNSVVVKDLPANATAVGIPGRIVPDKHSKDENQQREEVAKKYGFDAYAVSHDNPDPVAKAIGRLLDHMHLMDDRVSELCKEINTLGGDICPKNLPELRVGEFVEDEKAAAERRENKVASFDPEI

SEQ ID NO: 7904 - DNA, 954 bp, Pseudomonas syringae pv. phaseolicola 1448A
  CDS (1)..(954): transl_table=11
atgagcgatattccagaagcatccgccgacggcagttccagccactggcagttgcagcggatcgtcagccagttgcgcggcgcgcgtgaagactggcgggcgcgcaaccgtcgggtaagcggcgagcacggcgggcgcgaactgccttcgcgtgcagccatgggcgaaattcttgaagcgctgagcggggcgttgttcccgatgcggcttggcccggtggacctgcgtgaagaaagcgaagatttttacgtggggcatacgctggatgtggcactcaatgcgctgctggcccaggcccgcctggagctgcgctacgtcgcccatcagcagggcggtgacctgaagagcatcgatgcacgagcgctcgagctgattcagggtttcgccatggccctgccgggtattcgtctgttactggacactgacgtgctggccgcctaccacggcgacccggccgcacgcagcgtcgatgaagtgctgctgtgctaccccggcattctggcggtgatccaccatcgtctggcgcaccatttgtatcgcgccggtttgccattgctggcgcgcatcagctcggagatcgcccattcggcgaccggtatcgacattcatccgggcgcgcagatcggcccgagcttctttatcgaccatggaacaggcgtagtaattggcgaaaccgcgatcatcggcgagcgggtgcggatctatcaggccgtgaccctgggcgccaagcgcttcccgtcggacgaggacggccagttgcagaaaggccatgcacggcatccaatcgttgaagacgacgtggtgatctacgcgggtgcgaccattctggggcgcatcaccattggtaagggctcgaccatcggcggcaatgtctggctgacccgcagcgtaccggcgggctgcaacctgacccaggccaatttgctgcaacaggatgattgcagcaagaagtga

SEQ ID NO: 7905 - protein, 317 aa, Pseudomonas syringae pv. phaseolicola 1448A
MSDIPEASADGSSSHWQLQRIVSQLRGAREDWRARNRRVSGEHGGRELPSRAAMGEILEALSGALFPMRLGPVDLREESEDFYVGHTLDVALNALLAQARLELRYVAHQQGGDLKSIDARALELIQGFAMALPGIRLLLDTDVLAAYHGDPAARSVDEVLLCYPGILAVIHHRLAHHLYRAGLPLLARISSEIAHSATGIDIHPGAQIGPSFFIDHGTGVVIGETAIIGERVRIYQAVTLGAKRFPSDEDGQLQKGHARHPIVEDDVVIYAGATILGRITIGKGSTIGGNVWLTRSVPAGCNLTQANLLQQDDCSKK

SEQ ID NO: 7906 - DNA, 765 bp, Pseudomonas syringae pv. phaseolicola 1448A
  CDS (1)..(765): transl_table=11
atgagccctctttggcagcgccttcgcgatcaagcccggcaactgaccgagcgcaacccggtactcggcgattatgcgacaagccacctgctggtctattcgactttcgaggatgcgctcgctgcgaaccttgcccgacagatgcaggcccaagcgagtaacgtggcgctggaagactggttcaaggcgatcataaaggccagcccgtccgtcgctcagtcagcggctgccgatatcaaccatctggaaaccgtcaatcctgcctgcccggatcacctcaccgcctttctgaccttccgtggcatacaggccgttcaggcataccgcatcgcccatgcactgtgggctgagggcgatgagcaaagcgcggtgctagtacagaactgggcggccaacacctggagcatcgatattcacccggcggcacgcctcggcaaatccttgtttgtcgaccatggcatcggccttgttatcggggaaaccgctgtagtcgaagatcaagtgagcctctggcacggtgtcacgctgggcagcaccctcaacgaagcaggcgaccgacacccgaaaatccgcagaggcgcacttatttgcgccggagcaaccgttctgggaaacatcgaagtaggagccaatgccattgtggcggccaactcggtcgtactcaaagctgtgggcgctggaacggtcgtcgctggcacaccggcaaaggtggtgggtaatgcccctgcttttctggcgacctttacgacaaaatccaaaggctaa

SEQ ID NO: 7907 - protein, 254 aa, Pseudomonas syringae pv. phaseolicola 1448A
MSPLWQRLRDQARQLTERNPVLGDYATSHLLVYSTFEDALAANLARQMQAQASNVALEDWFKAIIKASPSVAQSAAADINHLETVNPACPDHLTAFLTFRGIQAVQAYRIAHALWAEGDEQSAVLVQNWAANTWSIDIHPAARLGKSLFVDHGIGLVIGETAVVEDQVSLWHGVTLGSTLNEAGDRHPKIRRGALICAGATVLGNIEVGANAIVAANSVVLKAVGAGTVVAGTPAKVVGNAPAFLATFTTKSKG

SEQ ID NO: 7908 - DNA, 777 bp, Dechloromonas aromatica RCB
  CDS (1)..(777): transl_table=11
atgtctgaagcgatgaccatgaccgcaagcacaatggcagcacccggcctctgggcgaccctgaaggaagacctgagctgcgtctttcagcgcgacccggcggcccgctcgacactggaggtactgaccacctaccccggcgtccatgccatcctcgcccaccgcctgtcgcaccgcctgtggcagaacggctggcgcttcccggcccgcttcctctccttcctgagccggacgctgaccaacgtagacatccaccctggtgccaccatcggccaccgcttcttcatcgatcatggcgcctgtgtggtcatcggcgaaacggctgaggtcggcgacgatgtcacgctctaccatggtgtaacgctcggtggcacctcgtggaacaagggaaagcgccacccgaccctggccgacggtgtcgtcgtcggggccggcgccaagatactcggcccgatctgcattggcgaacgcgtccgcgtcggcgccaattcggtggtcgtcaaggatgtgccggccgaccggacggtggtcggcgtacccggccggatcgtcgacacccgggtcggcacggcacgccccgaaaatggcatcagcctggaccataacgtgatgcccgatccggtcgccaagtccatcgcctgcctgatcgaacgcatcgaaaccctggagaaggaactggctgagatccgccatgaaccgcctccccccgaccacagtggcgattgccgcacctgcaccgccggcgacttgtgctgcgagcacgaggccatgcactga

SEQ ID NO: 7909 - protein, 258 aa, Dechloromonas aromatica RCB
MSEAMTMTASTMAAPGLWATLKEDLSCVFQRDPAARSTLEVLTTYPGVHAILAHRLSHRLWQNGWRFPARFLSFLSRTLTNVDIHPGATIGHRFFIDHGACVVIGETAEVGDDVTLYHGVTLGGTSWNKGKRHPTLADGVVVGAGAKILGPICIGERVRVGANSVVVKDVPADRTVVGVPGRIVDTRVGTARPENGISLDHNVMPDPVAKSIACLIERIETLEKELAEIRHEPPPPDHSGDCRTCTAGDLCCEHEAMH

SEQ ID NO: 7910 - DNA, 750 bp, Dechloromonas aromatica RCB
  CDS (1)..(750): transl_table=11
atgttccggcatctgcgtgaggacatccgtgcggtttttgaccgcgacccggcggctcgttcatcctgggaggtgcttacctgctacccgggtattcacgccctgatcatgcatcgtctggctcactggctgtggggccatcgcctgcgctggctggcgcggtttacggcgcatatttcccgcatgttgactggtatcgaaatccacccgggagccacgattggtcgacgctttttcatcgatcacggcatgggggtcgtcatcggtgaaaccgcagtgatcggtgacgacgtcacgctctaccatggcgttacgctgggtggcacctcatggaacaagggcaagcgtcacccgacactggaaaacggcgtggtcatcggtgctggtgccaaggtgcttggcccgatcaccatcagcgccggcgccaaggtcggctcgaatgcagtcgtaaccaagcctgtcccggaaggtgctacagccgttggcaacccggcccggattatcgaccagctaacccgcgaacgtgaggcgcaagcggaaaagctggggttctctgcgtatgccgttgctcgcaatcaggatgatccgttggccaaggccatccatgcgctgcttgatcatgcgtccgagacggatcgtcgtcttgcctctctggtcaaggagcttgaggcgcaaggcgtgaagtgcgatgaagaagttcagcaggctgattcctttgatccgaaatacctgagcaaaatagttgactaa

SEQ ID NO: 7911 - protein, 249 aa, Dechloromonas aromatica RCB
MFRHLREDIRAVFDRDPAARSSWEVLTCYPGIHALIMHRLAHWLWGHRLRWLARFTAHISRMLTGIEIHPGATIGRRFFIDHGMGVVIGETAVIGDDVTLYHGVTLGGTSWNKGKRHPTLENGVVIGAGAKVLGPITISAGAKVGSNAVVTKPVPEGATAVGNPARIIDQLTREREAQAEKLGFSAYAVARNQDDPLAKAIHALLDHASETDRRLASLVKELEAQGVKCDEEVQQADSFDPKYLSKIVD

SEQ ID NO: 7912 - DNA, 741 bp, Prochlorococcus marinus str. NATL2A
  CDS (1)..(741): transl_table=11
atgcttaaaattattaaggcagatttctcaattatcaaagaaagagatccggctgctagaggttttttagagattgttttttgttacccagggtttcaagccctggttgtacatagaattagtcataaactctggaatctaaaacttccactagtcccaagattactcagccaaataacacggtttttaacaggtgtagagattcatccgggagcgaaaattggtaaagctgtatttatagatcatggaatgggagttgttattggcgagacgagtgagataggcaacagatgccttttatatcaaggagttactcttggtggaacaggtaaagaaaatgggaaaagacatccaactttagaagcaaatgttgtcgttggagccggagctaaagttcttggtgcaatcattgttggcacgaatacaagaattggggctgggtcagtggtagttagagatgtagaagctgatagcactgtagtagggatcccaggcagggtagtgcatcaaagtggagtcaaaatcaatccacttgctcactctgcgttacctgatacagaaggaaatgtaataagaaatttaatggaaagaattgatgagcttgaaaatcaagtaattaactttcaagagataatcagaaattcaaatatagggataaatgataagaacttccatcaaggagaatcacaaaatttaaaagacaaagaaatcatcgaattcatcggaaagaataaaaaataa

SEQ ID NO: 7913 - protein, 246 aa, Prochlorococcus marinus str. NATL2A
MLKIIKADFSIIKERDPAARGFLEIVFCYPGFQALVVHRISHKLWNLKLPLVPRLLSQITRFLTGVEIHPGAKIGKAVFIDHGMGVVIGETSEIGNRCLLYQGVTLGGTGKENGKRHPTLEANVVVGAGAKVLGAIIVGTNTRIGAGSVVVRDVEADSTVVGIPGRVVHQSGVKINPLAHSALPDTEGNVIRNLMERIDELENQVINFQEIIRNSNIGINDKNFHQGESQNLKDKEIIEFIGKNKK

SEQ ID NO: 7914 - DNA, 744 bp, Ralstonia eutropha JMP134
  CDS (1)..(744): transl_table=11
atgttctctcgtctgaaggaagatatcgacaccatcatgctgcgcgatcccgccgcgcgcagccgcctcgaagtcctgacctgctatcccggcctgcatgccgtggtgttccaccgctttgcccacgcttgctggaatggcggctttcattggctgggacgctggatctcgcactggtcccgctttctcaccggcatcgagattcatcctgcggtgaagctgggccgtcgcgtatttatcgaccacggcatgggtgtggtgatcggcgaaaccgcggagatcggcgacgactgcacgatctaccagggcgtgacgctgggcggtacgtcgctgtacaagggccagaaacggcatccgacgctgggcgccaacgtggtggtcagcgcgggcgccaaggtgcttggcggtttcgtggtcggtgacggcgctcgtgtgggctccaatgccgtggtgctcaagcccgtgcctcccggtgcgacggcggtgggcattccggcgcgtatcatcctgcccgacgcgccgacatcgcagcagggtgcgaagcaggagttctcagcctatggcatcacgcctaatgcggatgatccggtgtctctcgcgctcaaggggctgatcgacaatgcagccaagcagaatgatcgtatcgaggccgtactggccgcactcgatcgcctgggcgagcatctcgagaacacgccgaacgaccgcttcgatgccagcgaactgcgcaggctgatgaagtag

SEQ ID NO: 7915 - protein, 247 aa, Ralstonia eutropha JMP134
MFSRLKEDIDTIMLRDPAARSRLEVLTCYPGLHAVVFHRFAHACWNGGFHWLGRWISHWSRFLTGIEIHPAVKLGRRVFIDHGMGVVIGETAEIGDDCTIYQGVTLGGTSLYKGQKRHPTLGANVVVSAGAKVLGGFVVGDGARVGSNAVVLKPVPPGATAVGIPARIILPDAPTSQQGAKQEFSAYGITPNADDPVSLALKGLIDNAAKQNDRIEAVLAALDRLGEHLENTPNDRFDASELRRLMK

SEQ ID NO: 7916 - DNA, 675 bp, Methanosarcina barkeri str. Fusaro
  CDS (1)..(675): transl_table=11
atgacgatctggattattcataggcgagcttttatgattcaatcaaagaaagattatatattttatttaaaagcagatgagattgcacttaaaaaaaaaagaggtacagtccagtattatagggattatcttttggatgatatctggagatttgagagattactaaggaaaagagaattttatataaattgtaaaaaaggtattatatataaactatatcttccgtacctttattttaaattccaaagattaagcacgaaattaggatttactatacctccaaatgtattcgggcctggattatctattgctcataaaggtactttaattgtaaatagcaatgcaaaagttggtgaaaattgtcgcattcatactggtgtaaatattggaacaaatgcctatagtatggaggacgaattaagaccggattttgtattacctgtgccaaaaataggaaataatgtatatattggtcccggcgttaaaatctttggagatattgaaattgcagataatatcgcaataggtgcaaattcagtagtaaacaaatcctttaaagaagaaggtattacaatagcaggagttccagcaaaaaaagttagtagtgaaggatttgataaatgttactataaagctacagacattttaagaggattctataaacctcctcagtaa

SEQ ID NO: 7917 - protein, 224 aa, Methanosarcina barkeri str. Fusaro
MTIWIIHRRAFMIQSKKDYIFYLKADEIALKKKRGTVQYYRDYLLDDIWRFERLLRKREFYINCKKGIIYKLYLPYLYFKFQRLSTKLGFTIPPNVFGPGLSIAHKGTLIVNSNAKVGENCRIHTGVNIGTNAYSMEDELRPDFVLPVPKIGNNVYIGPGVKIFGDIEIADNIAIGANSVVNKSFKEEGITIAGVPAKKVSSEGFDKCYYKATDILRGFYKPPQ

SEQ ID NO: 7918 - DNA, 945 bp, Methanosarcina barkeri str. Fusaro
  CDS (1)..(945): transl_table=11
atgggaatcaaggaagatatcaggaccgtttttgaaaaagaccccgcagcgaggtctacacttgaggtaatctgctgctatccgggccttcatgctatctggatacaccggatatctcattcgctctgggagagacacttttattttctggcccgtctgctctctcacatctcaaggatgttaacaggtattgaaatccatccaggggcaaagcttggaaggagagttttcatagaccatggttccggagttgtgattggagaaactgctgaggtaggggatgacgttctgatatatatgggagttgtgttaggcgggacagctctggaaaaggtaaagcgtcatcctactattgaaaatgatgtggttattggttcaggagcatctgtacttggaccgattactgttggaagaggcgctaaaataggcgccggttcagttgtgatccggtcagttccagccggagctacggttgtgggagtccctgcaagaattgcagagacacatccttcggtttctgcaggacaacttgaccatgataagctgcctgatcccggacttattgtgataagccagatacttgaccggctgagcagtctagaagacaagttccaggcacatgaagagttagtttccggacatggaaaaactccacaaggaacagtacttaaagatgagcaaatttattccctgctaaaagacgtggtcgacccaggagtagggatggatatcgtcaaactgggcctggtaaaggaagtagtagtcgacggaccaaatgtagaggtaaaccttgtattgacaacaagcgcctgccctatgatcgagtattttaaggaacagatccggcgaaaagtcctgagtgcggaaggtgtagaaaaagttaatgtcaatatccttgatgagccctggagctgggaccaaaacaaaaaaaaggtcgttcattaa

SEQ ID NO: 7919 - protein, 314 aa, Methanosarcina barkeri str. Fusaro
MGIKEDIRTVFEKDPAARSTLEVICCYPGLHAIWIHRISHSLWERHFYFLARLLSHISRMLTGIEIHPGAKLGRRVFIDHGSGVVIGETAEVGDDVLIYMGVVLGGTALEKVKRHPTIENDVVIGSGASVLGPITVGRGAKIGAGSVVIRSVPAGATVVGVPARIAETHPSVSAGQLDHDKLPDPGLIVISQILDRLSSLEDKFQAHEELVSGHGKTPQGTVLKDEQIYSLLKDVVDPGVGMDIVKLGLVKEVVVDGPNVEVNLVLTTSACPMIEYFKEQIRRKVLSAEGVEKVNVNILDEPWSWDQNKKKVVH

SEQ ID NO: 7920 - DNA, 693 bp, Dehalococcoides sp. CBDB1
  CDS (1)..(693): transl_table=11
atgataaaagatattaaaaatgttttcagcaaagatccggctgccagaagtgtggcagaggttctattttgttatcccggtttgcatgctctctggtttcaccgggtggcaaactggctgtggcggcataaactccatttctgggcacgctggctttcccatggcgggcggttctgcaccggcattgagattcatccgggggcaaaaataggtcagcgtttcttcattgaccatgggatgggggtagtcattggcgaaacctctgaaattggcaatgacgtgcttatgtatcagggtgtggtgcttggcggaaccagtctgtccaaaggcaaacgccaccctactatctgcgataatgcagttatcggtacaggcgcaatagtgctgggcggcattacggtgggtgaaggggctaaagtaggggcaggttcggtggttaccaaagatgttccggccggggcgactgtagttggcatacccgggcgggtggttgaagaatcacgccgtatggttattgatctggaacacggcaaactgcctgacccggtagcagacgctctgaaagtggttctgaccgaacagcaaaaactgatggacaggcttgcccagcttgaaaaaaacagcggactgaaagtgcctcaggatgagcttcgcgggcagatacgcgagattatgaaagagtttaacctgtag

SEQ ID NO: 7921 - protein, 230 aa, Dehalococcoides sp. CBDB1
MIKDIKNVFSKDPAARSVAEVLFCYPGLHALWFHRVANWLWRHKLHFWARWLSHGGRFCTGIEIHPGAKIGQRFFIDHGMGVVIGETSEIGNDVLMYQGVVLGGTSLSKGKRHPTICDNAVIGTGAIVLGGITVGEGAKVGAGSVVTKDVPAGATVVGIPGRVVEESRRMVIDLEHGKLPDPVADALKVVLTEQQKLMDRLAQLEKNSGLKVPQDELRGQIREIMKEFNL

SEQ ID NO: 7922 - DNA, 759 bp, Thiobacillus denitrificans ATCC 25259
  CDS (1)..(759): transl_table=11
atgagcctgttcagccaactgaaggaagacatcgcggtcgtcttcgaccgcgatcccgcggcgcgctcgaccttcgaggtggtgacgacctatcccggctttcatgccgttttgatccatcgcctcgcgcaccgcctgtggcgcatgcagtggaagtggctcgcgcgattcacctcgcacctcggccgctggctcacgggcatcgaaatccaccccggggcgacgatcgggcggcgcgtcttcatcgaccacgggatgggcgtggtcgtcggcgagaccgcggaaatcggcgacgactgcaccctctaccacggcgtgacgctcggcggcacgtcctggaacaagggcaagcgccatccgaccctgatgaacggggtggtcgtcggcgccggcgccaagatcctcggcccgatcaccgtcggggccaacgcgcgggtggggtcgaatgcggtcgtggtcaaggacgtgccggaggatgcgaccgccgtcggcatccccgcgcggatcctcgacagcgcggcggaaaagcagcgcaaccggcaagccgaaaagctcggcttctcggcgtacgcgatttcggcggacatgaacgacccggtggtcaaggcgatccacgggctgatcgatcattcggcgcatatcgaccaccggctcgacctgattctggcccagctccaaaagctcggcgtggagatgccggcggggcaggacaagcccgacgatttcgacgcgaactatttgaacaaaatagttgactaa

SEQ ID NO: 7923 - protein, 252 aa, Thiobacillus denitrificans ATCC 25259
MSLFSQLKEDIAVVFDRDPAARSTFEVVTTYPGFHAVLIHRLAHRLWRMQWKWLARFTSHLGRWLTGIEIHPGATIGRRVFIDHGMGVVVGETAEIGDDCTLYHGVTLGGTSWNKGKRHPTLMNGVVVGAGAKILGPITVGANARVGSNAVVVKDVPEDATAVGIPARILDSAAEKQRNRQAEKLGFSAYAISADMNDPVVKAIHGLIDHSAHIDHRLDLILAQLQKLGVEMPAGQDKPDDFDANYLNKIVD

SEQ ID NO: 7924 - DNA, 762 bp, Anabaena variabilis ATCC 29413
  CDS (1)..(762): transl_table=11
atgctatctatactgcgtgctgactttcgtatcatctttgaacgtgacccggctgctcgtaatttgctggaagtcttgttttgttaccctggtttgcaggccttattattccatcgggtagctaactggctgtatcgtcttgggttaccatttattccccgcttaatttctcacatagctcggtttttgacaggtattgaaattcaccctggtgccacaattggacgaggtgtatttattgaccacggtatgggtgtggttattggtgaaactgcgatcgtgggagactatgctttgatttatcaaggtgtcacccttgggggaacgggtaaagaaagcggtaaacgccaccctaccttaggcgaaaacgttgttgttggtgctggtgctaaggtactgggcaatcttcaaatcggaaataacgtccgcattggtgctgggtctgttgtccttagggatgtacccgccaattgtactgttgtaggtattcctgggcgcattgtttatcgttctggtggaagagttgaccccctagaacataacaatttaccagactcggaagctcaagcaattcgtgctttggttgaccgcattgaatcgctagaacaacaaatacaagccttacaaaataatcaatctgctgctaaagttccggttttggttgctgcaagttcacaagaagcagagatatcccacgattcccagtggtgcaacctcagagataaggcaattcaagagtttctagatggtgccggcatttaa

SEQ ID NO: 7925 - protein, 253 aa, Anabaena variabilis ATCC 29413
MLSILRADFRIIFERDPAARNLLEVLFCYPGLQALLFHRVANWLYRLGLPFIPRLISHIARFLTGIEIHPGATIGRGVFIDHGMGVVIGETAIVGDYALIYQGVTLGGTGKESGKRHPTLGENVVVGAGAKVLGNLQIGNNVRIGAGSVVLRDVPANCTVVGIPGRIVYRSGGRVDPLEHNNLPDSEAQAIRALVDRIESLEQQIQALQNNQSAAKVPVLVAASSQEAEISHDSQWCNLRDKAIQEFLDGAGI

SEQ ID NO: 7926 - DNA, 753 bp, Anabaena variabilis ATCC 29413
  CDS (1)..(753): transl_table=11
atgcaacaatccttagacggtatcgagaatccacctgattcgacacatacatccttggtgaaaaatctactctctggcgtttttctagagccattgttgagtgattttctgattatttttgaacgcgacccggcggcgcgtaattggctggaggtaatattctgttaccccggactgcacgcgatttgtttgcaccgttttgctcattggttgcaccgtcgtggggtggttttcttcccacgcttaatttctcacttggctaggtttctcacaggaattgagattcacccaggtgcagtgattggtaaaggtgtgtttatcgaccacgggatgggcgttgtcattggtgaaacggcgattgtgggagattatgccctaatttatcaaggggtgactctgggcggtactgggaaggaaagtggtaagcgtcatcccacggttggggatcatgtggttgtgggttcgggggcgaaggtgttggggaatattcaaattggcgatcgcgtgcggattggcgctggttcggttgtgttgcgtgatgttcctcatgattgcacagttgtgggcattcctgggcggattatcacccacaagcccaagactgatctctctcccctggaacatgggaagttacctgatgtggaagcagatgtgattcgttctttgctatcgcgcatcgaacaattggagcaaaaactgcaaaccctgacaaatcagccgaaggaaccagaactgttgacgaaagataagtaa

SEQ ID NO: 7927 - protein, 250 aa, Anabaena variabilis ATCC 29413
MQQSLDGIENPPDSTHTSLVKNLLSGVFLEPLLSDFLIIFERDPAARNWLEVIFCYPGLHAICLHRFAHWLHRRGVVFFPRLISHLARFLTGIEIHPGAVIGKGVFIDHGMGVVIGETAIVGDYALIYQGVTLGGTGKESGKRHPTVGDHVVVGSGAKVLGNIQIGDRVRIGAGSVVLRDVPHDCTVVGIPGRIITHKPKTDLSPLEHGKLPDVEADVIRSLLSRIEQLEQKLQTLTNQPKEPELLTKDK

SEQ ID NO: 7928 - DNA, 720 bp, Anabaena variabilis ATCC 29413
  CDS (1)..(720): transl_table=11
atgcttttaactgacttacgcacaatttatgaacgcgatcccgcagcccgtaattggctagaaattttattttgttatcctggccttcaagccttgatgtttcatcgccttacccattggttgtataagattggaattcccttatttccacgattgatttcgagtatcagtcgatttttgacaggaattgaaattcaccctggtgcaaagattggtaaaggcgtatttattgaccacggtatgggtgtagttattggtgaaaccgccattgttggtgattatgcactgatttatcaaggtgttacccttggcggcacaggaaaggaaagcggtaagcgtcatcctacattgggtgagaatgtagttgtaggagcgggtgcaaaagtattaggtaatattcacattggtaacaacgttcgtattggtgcaggttcagtagttttgcgcgatgttcccagcaatacgacagtcgtaggcgttccagggcgtttgattcgggttgatcaagctcatgttttagcccatggaaaagtccgtgatatggaagcagaggctatccgcgccctctttgaacgtgtgaaggatttagaacagcaggtagaacagttaggaggtaattttcatgtatccatcaaccaggtggacaatcaacacctccaagagactaaagctgagagtaatttagtcattgaagagtttttggatggtgcaggaatttaa

SEQ ID NO: 7929 - protein, 239 aa, Anabaena variabilis ATCC 29413
MLLTDLRTIYERDPAARNWLEILFCYPGLQALMFHRLTHWLYKIGIPLFPRLISSISRFLTGIEIHPGAKIGKGVFIDHGMGVVIGETAIVGDYALIYQGVTLGGTGKESGKRHPTLGENVVVGAGAKVLGNIHIGNNVRIGAGSVVLRDVPSNTTVVGVPGRLIRVDQAHVLAHGKVRDMEAEAIRALFERVKDLEQQVEQLGGNFHVSINQVDNQHLQETKAESNLVIEEFLDGAGI

SEQ ID NO: 7930 - DNA, 777 bp, Pseudomonas fluorescens PfO-1
  CDS (1)..(777): transl_table=11
atgttcgagcgtttgcgtgaagatatccagagcgtattccaccgagacccggcggcgcgtaacgcttttgaagtcctgacctgctaccccggcatgcatgcgatctggattcatcgactggccgggatgctctggcgcaacgatctgaaatggctggcgcggctggtgtcgaacttcggtcgctggctgaccgggatcgagattcatccgggtgccaaggtcggtcgacgcttcttcatcgaccacggcatgggcatcgtgattggcgaaaccgctgaaatcggcgatgacgtgacgatctatcagggcgtgacgctcggcggcaccagctggaacaagggcaagcgtcatccgaccctcggtgatggcgtggtggtgggcgcaggtgcgaaggtgctcggcccgttcactgtgggtgccggcgccaaggtcgggtccaatgctgtcgtcaccaaagaagtgccaccgggtgccaccgtggtcgggattccgggacggatcatcgtcaagtccgatgatgaggccgacgccaagcgcaaggcgatggccgagaagatcggcttcgatgcctacggcgtcagtgaagacatgcccgatccggtggcgcgtgccatcggccagttgcttgatcacctgcaagcggtggatgggcgtctggaaggaatgtgcggcgcgctgaaggatctgggcagcaattactgtgcgaaagatctgcccgagctgcgtgaagaagacttcgcctgcgtcaagggcaagggcgaatccaagctccactga

SEQ ID NO: 7931 - protein, 258 aa, Pseudomonas fluorescens PfO-1
MFERLREDIQSVFHRDPAARNAFEVLTCYPGMHAIWIHRLAGMLWRNDLKWLARLVSNFGRWLTGIEIHPGAKVGRRFFIDHGMGIVIGETAEIGDDVTIYQGVTLGGTSWNKGKRHPTLGDGVVVGAGAKVLGPFTVGAGAKVGSNAVVTKEVPPGATVVGIPGRIIVKSDDEADAKRKAMAEKIGFDAYGVSEDMPDPVARAIGQLLDHLQAVDGRLEGMCGALKDLGSNYCAKDLPELREEDFACVKGKGESKLH

SEQ ID NO: 7932 - DNA, 672 bp, Carboxydothermus hydrogenoformans Z-2901
  CDS (1)..(672): transl_table=11
atgtttgggtggtatcgccgactaaaaagagatattcaggtggtttttgaaagggacccagcggttaaaagcgtttgggaagttttgttgtgttatcctggttttcatgccattcagtttcaccgtatagcccactttttttataaaaagcgctggtttgttttagccagatttatttcccaaatttcaagatttttaaccggaatagaaattcatccgggggctaaaattggcgaaggattgtttattgatcatgggatgggtgtagtaattggtgaaacggctgagattggtgataatgtaaccatttatcaaggtgttaccctgggcggaactggtaaggaaaagggtaagcgccatccaactattggaaataatgtggtgatcagtgccggagcaaaaattttaggctccttcaaagtaggtgacaactctaaaattggagctggttcagtagtgttaaaagaagttcctcccaactctacagtggtgggtgttccgggtaaagtggtgattagggacggcaaacgggttgatgaggaaatcgaccttcgccacgatctgttaccggacccgattgctgagatgttgatgtgtatgcaccggaagatagaaaggttggaaaagagaattgccgagcttgaggaggaaagaaaacgtgaaaatttataa

SEQ ID NO: 7933 - protein, 223 aa, Carboxydothermus hydrogenoformans Z-2901
MFGWYRRLKRDIQVVFERDPAVKSVWEVLLCYPGFHAIQFHRIAHFFYKKRWFVLARFISQISRFLTGIEIHPGAKIGEGLFIDHGMGVVIGETAEIGDNVTIYQGVTLGGTGKEKGKRHPTIGNNVVISAGAKILGSFKVGDNSKIGAGSVVLKEVPPNSTVVGVPGKVVIRDGKRVDEEIDLRHDLLPDPIAEMLMCMHRKIERLEKRIAELEEERKRENL

SEQ ID NO: 7934 - DNA, 804 bp, Burkholderia sp. 383
  CDS (1)..(804): transl_table=11
atgcgcgccggccttttcccagaccacatcatgttcacgagactgcgcgaagacgttgcaacgattcgcgagcgggatcccgccgctcgcagtgcatgggaagtgctgacctgttatccggggttgcatgcgctcttgctgcatcgtttcgcgcacgcatgctggcgcgcgaagcgttactggctcgcgcgtttcgcgtcgcaggccggccggttcatgacggggatcgagatccaccccggcgcgacgatcggccggcgcgtgttcatcgatcacgggatgggtgtcgtgatcggcgagacggcaatcgtcggcgacgattgcacgatctatcagggcgtgacgctgggcggcacgtcgctcacgcgcggcgccaagcgccacccgacgctcgaggccggcgtgatcgtcggtgcgggcgcgaaagtgctcggcggcttcacggtcggtgcgggtgcgaagatcggttcgaacgcggtcgtcgtgaagccggtgccggcaggcggcacggcggtgggcaatccggcgcgcgtcgtgatgccggcgcagccgaagccgcagcccgaacgtgcggcgttctgcgcatacgggatcacgccgaatgccgatgatccgatgtcgcttgcgattcacggactgatcgatcatgcggcgaaggaaagccgccgcgtcgacgagatcgtcgccgcgctcgagcggctcggcacgcacctggaaacgctgcagggcgccgatgcggcgcgtctcgacctgcgccggctgtcggccgtgctggaaggcaagtcggtcgaacgccaggcgtaa

SEQ ID NO: 7935 - protein, 267 aa, Burkholderia sp. 383
MRAGLFPDHIMFTRLREDVATIRERDPAARSAWEVLTCYPGLHALLLHRFAHACWRAKRYWLARFASQAGRFMTGIEIHPGATIGRRVFIDHGMGVVIGETAIVGDDCTIYQGVTLGGTSLTRGAKRHPTLEAGVIVGAGAKVLGGFTVGAGAKIGSNAVVVKPVPAGGTAVGNPARVVMPAQPKPQPERAAFCAYGITPNADDPMSLAIHGLIDHAAKESRRVDEIVAALERLGTHLETLQGADAARLDLRRLSAVLEGKSVERQA

SEQ ID NO: 7936 - DNA, 939 bp, Burkholderia sp. 383
  CDS (1)..(939): transl_table=11
atggccgcattcgacatcgacgacatcgttcaatcgctgcagaccgtgcgccgcgcatggcgcgagaagcagcggcgctccctcgaaccgggtgggcgcgacctgccggcgcgcgaggcgctcgcgcagatcatcggcgcgctgaaaggcgtgctgttcccgatgcggctcgggccgcccgacctgcgccaggagagcgagaactttcacgtggcccatgcgctcgacgcggcactgaatgcgctgctcgcgcaggtgaagctggaattgcgctacgcggcgcgacagcgcaatgccgacgggccggtcgatcgcgtcgatgacgtggcgtcgacggccgtgcaggcatttgccgcacgcttgcccgagattcgccggctgctcgacagcgacgtgctggccgccttccacggcgatccggcggcgggcagtgtcgacgaggtgctgctgtgctacccgggcatcctcgcgatgatccaccaccggctcgcgcacgagctgtacggcctcggcctgccgctgctcgcgcggatcatcgccgagcaggcgcatgcggagacgggcatcgacattcatccgggcgcacgcatcggcgcgggtttcttcatcgatcacggcacgggtgtcgtgatcggcgagacggcgatcatcggcgagcgcgtgcgcgtgtaccaggccgtcacgctcggcgcgaagcgctttccgcgcgatgcggcaggtcacctcgagaaggggctggcacgtcatccgatcgtcgaggacgacgtcgtgatatatgcgggcgcaacgatcctcggccgcgtgacgatcgggcgtggcgcggtgatcggcggcaacgtgtggctcacgcaggacgtgccggccggcgcgaacatcacgcaggccgtgctgcgcagcgaagcgaacaccgcaccgcgcgcggccgcgcgtgtcgcctag

SEQ ID NO: 7937 - protein, 312 aa, Burkholderia sp. 383
MAAFDIDDIVQSLQTVRRAWREKQRRSLEPGGRDLPAREALAQIIGALKGVLFPMRLGPPDLRQESENFHVAHALDAALNALLAQVKLELRYAARQRNADGPVDRVDDVASTAVQAFAARLPEIRRLLDSDVLAAFHGDPAAGSVDEVLLCYPGILAMIHHRLAHELYGLGLPLLARIIAEQAHAETGIDIHPGARIGAGFFIDHGTGVVIGETAIIGERVRVYQAVTLGAKRFPRDAAGHLEKGLARHPIVEDDVVIYAGATILGRVTIGRGAVIGGNVWLTQDVPAGANITQAVLRSEANTAPRAAARVA

SEQ ID NO: 7938 - DNA, 921 bp, Burkholderia sp. 383
  CDS (1)..(921): transl_table=11
atgtcgacatcacccgcccgtcagtggggccttgaagaaatcgttgccggcttgcgcgagtcgcgcgaggaactccatcgcacgcgccatccgcgcggcatccgcgaactgccgtcgcgcgatgcaatctgcaagattgtgaccggcctgcgcgcgtcgatgtttccgacgcactacggcgcaccggacctgaccgatgaaagcgtcgacttctacgtcggccacacgctcgaaagcacgctgcgcatcctgtccgaacagatccgccgtgcgctgccgttcctgcccgagcatgtcgatacgccgttcgccgagctcgacgaacgcgcgttcgaaatcgcgcgcgaattcggccggcagttgccggcggtgcgcgcgctgctcgtcagcgacatccaggccgcgtatgcgggcgatccggccgcgcagcacatcaccgagatcctgctgtgctacccgggcgtgctggcgatgatgcatcaccggctcgcgcatgcgctgcaccggctcggcgtgccgctgctcgcgcgattcatcaatgaaatcgcccactcggccaccggcatcgacatccacccgggtgcgcacatcggcccgagcttcttcatcgaccacggcacgggcgtcgtgatcggcgagacggcgatcatcggcgagcgcgtgcgcgtgtaccaggccgtcacgctcggcgcgaagagcttcccggccgatggcgaaggtgcactggtcaagggtaatgcgcggcacccgatcgtcgaggacgacgtggtgatctacgcgggcgcgacgattctcggccgcgtgacgatcgggcgcggctcggtgatcggcggcaacgtgtggctcacgcacagcgtgccgcccggcacgagcgtcgcgcagggcaaggtgcgcgaaggcgggagcgccgacaagccgtaa

SEQ ID NO: 7939 - protein, 306 aa, Burkholderia sp. 383
MSTSPARQWGLEEIVAGLRESREELHRTRHPRGIRELPSRDAICKIVTGLRASMFPTHYGAPDLTDESVDFYVGHTLESTLRILSEQIRRALPFLPEHVDTPFAELDERAFEIAREFGRQLPAVRALLVSDIQAAYAGDPAAQHITEILLCYPGVLAMMHHRLAHALHRLGVPLLARFINEIAHSATGIDIHPGAHIGPSFFIDHGTGVVIGETAIIGERVRVYQAVTLGAKSFPADGEGALVKGNARHPIVEDDVVIYAGATILGRVTIGRGSVIGGNVWLTHSVPPGTSVAQGKVREGGSADKP

SEQ ID NO: 7940 - DNA, 747 bp, Synechococcus sp. CC9605
  CDS (1)..(747): transl_table=11
atgtttgatcacatccgtgccgacctcgcgatcatccgcgagcgcgatccggctgcccgtggctggctggagatcctgttttgttatcccggcttccaggcgatcagcctgcaccggatcagccatcgcctttggagctgtcagctgcccctgaagctggctgcccgttgcctcagccagattggccgtgcactcaccgggatcgagattcaccccggcgcccggatcggccacagcgtgttcattgaccatggcatgggggtggtgatcggcgagaccgccgaaatcggccaccgttgcctgctgtatcaaggcgtcaccctgggaggcacaggcaaggaacacggcaagcgccacccaaccctggcggagaacgtggtagtgggtgcaggcgccaaggtgttgggtgcaatcacgatcgggaccaacacccgcattggcgctggatccgtggtggtccgcgatgtggagagcgactgcacggtggtgggcatccccggaagggtgatccaccagagcggtgtaaggatcaatccacttgcccattcggcccttccggatgcggaagcaaacgtgatccgcaacttgatggaacggatcgatcagctcgagaacacagtgatgaacctcaaacgctgcctacaggaggtggcggccggtcggcagctccttgaagaatgctctggtgaagcccagaatctcaaagaccgagaaatcttggaattcctgggagatagcactagataa

SEQ ID NO: 7941 - protein, 248 aa, Synechococcus sp. CC9605
MFDHIRADLAIIRERDPAARGWLEILFCYPGFQAISLHRISHRLWSCQLPLKLAARCLSQIGRALTGIEIHPGARIGHSVFIDHGMGVVIGETAEIGHRCLLYQGVTLGGTGKEHGKRHPTLAENVVVGAGAKVLGAITIGTNTRIGAGSVVVRDVESDCTVVGIPGRVIHQSGVRINPLAHSALPDAEANVIRNLMERIDQLENTVMNLKRCLQEVAAGRQLLEECSGEAQNLKDREILEFLGDSTR

SEQ ID NO: 7942 - DNA, 678 bp, Geobacter metallireducens GS-15
  CDS (1)..(678): transl_table=11
atgttcgcacgcctgcatgaggatatccaatcggtcaaagaacgggaccccgccgcccgcagcagcgttgaggtctttttctgctaccccggccttcacgccatctggttccatcggtttgcccactggttctggatgcgtgagttcttttttctcggccgatttctctcgcacattggtcgcttctttaccggcatcgagatccatcccggcgccaccatcgggcggcggctcttcatcgaccacggcatgggggtggtgatcggcgagacggccgagatcggcgacgatgtcaccatctaccacggggtcacccttggtggcgtgagcctggagaagaagaagcgccatcccacggtggataacaatgcagtcatcggctccggcgccaaggtgctcggcccctttacggttggggtgggggcgaagatcggctccaactcggtggtggtgaaggaggtgccggcgaacgcaacggtagtcggcattccgggacgggtggtcatggctgccgatgagccggccaagaaagcagacttcgagcacgggaagcttcccgacccggaagcgaaagccatttcgtgcctcttcgatcaactgcgggaactggagcgcaagtatgccgatcttgcggacgaacatgccgcgctcaggcgtcgggtggagtcagggaagtag

SEQ ID NO: 7943 - protein, 225 aa, Geobacter metallireducens GS-15
MFARLHEDIQSVKERDPAARSSVEVFFCYPGLHAIWFHRFAHWFWMREFFFLGRFLSHIGRFFTGIEIHPGATIGRRLFIDHGMGVVIGETAEIGDDVTIYHGVTLGGVSLEKKKRHPTVDNNAVIGSGAKVLGPFTVGVGAKIGSNSVVVKEVPANATVVGIPGRVVMAADEPAKKADFEHGKLPDPEAKAISCLFDQLRELERKYADLADEHAALRRRVESGK

SEQ ID NO: 7944 - DNA, 966 bp, Desulfovibrio desulfuricans G20
  CDS (1)..(966): transl_table=11
atgaggaactgcagtaaagaaccggacaacatatgcgcagacggcatggactggcttgacgatgtggtggagaccatgtgcagcccggaatcgtgcagcaaagtgttcagcaaaccgctgaacaacgcgcccatgccctcgctggaagagctgacggaaatagtggacaggctgaaggcagccctgtttccgggatatttcggcaaatcatccatcgagatggagtccatgcgctaccatctggcggccaatcttgattccatctaccgcaaactggcagaccagatacgacggggcggctgcttcacctgcgccgaattcgccaacgactgccacagctgcgatgtctattcccacgaccttgcaaaacggttcatcgaacagttgcctcagatacgcgggctgctgctgggtgatgtcaccgcagcattcgagggcgaccccgccgcaaaaacccccggcgagaccgttttctgctatccgtccataaccgccatgctgcatcaccgcatcgcccatgccctgtatgaccttgatgtgccgctcattccgcgcatcataagcgaaatgtcacactccagaacgggcatagacattcaccccggcgcccgcatcggcgaagacttcttcatcgaccacggcacgggcgttgtcataggggaaacatgcatcatcggcaaaggctgccgcctgtatcagggggtcacgctgggggcgctttctttccccaaagacgccagcggaacactcatcaaaggtaatccgcgccatcccattctggaagacaatgtcaccgtgtatgccggtgccaccattctcgggcgcgtgaccatcggcaaagggtccatcatcggcggtaacgtgtggctgacacacgatgtgcccgaaggatcaaaaatcgtccagcagcgcagcacgcgcccgcaggcggacgaaaaaatgctgggtaccaaaaacggacgctga

SEQ ID NO: 7945 - protein, 321 aa, Desulfovibrio desulfuricans G20
MRNCSKEPDNICADGMDWLDDVVETMCSPESCSKVFSKPLNNAPMPSLEELTEIVDRLKAALFPGYFGKSSIEMESMRYHLAANLDSIYRKLADQIRRGGCFTCAEFANDCHSCDVYSHDLAKRFIEQLPQIRGLLLGDVTAAFEGDPAAKTPGETVFCYPSITAMLHHRIAHALYDLDVPLIPRIISEMSHSRTGIDIHPGARIGEDFFIDHGTGVVIGETCIIGKGCRLYQGVTLGALSFPKDASGTLIKGNPRHPILEDNVTVYAGATILGRVTIGKGSIIGGNVWLTHDVPEGSKIVQQRSTRPQADEKMLGTKNGR

SEQ ID NO: 7946 - DNA, 738 bp, Prochlorococcus marinus str. MIT 9312
  CDS (1)..(738): transl_table=11
atgattttaagaacttttaaatctgatatagcaattatcaaagagagagatcctgctgctagaggaatattagagatttttctttgttacccaggtttccaatcaatagttattcataggttaactcatcaattatggcaattaaaaattcctctaattccccgcttattaagtcatctcaataggttagtaacaggtattgaaatccatcctggagcaaaaattggtaaacgggttttcatagatcatggtatgggagttgttattggtgaaacggctgagataggaaataattgtcttctttatcagggagttacattaggaggaactggtaaaagtcatggtaaaagacacccaaccttaatggaaaatgttgtagttggagcaggtgcaaaagttcttgggtccatcacagtaggatctaatacacgtattggggcaggttcagtagttgtccgtaatgtagaagggaacagtactgtggttggagttcctggaagagtggtgcatcagagtggggtcaaagttaatccattagctcactctgccctaccagatacagaagctaatgttataaaaaatttaatggatagaatagactcacttgagaatgaaattcttaagttacaaaaaaccctgctgtgtctagctaactcagaatctattgatatttctaaacttggtgaggctcaaaatcttaaagacaaagaaatcatagaatttcttggagatgattaa

SEQ ID NO: 7947 - protein, 245 aa, Prochlorococcus marinus str. MIT 9312
MILRTFKSDIAIIKERDPAARGILEIFLCYPGFQSIVIHRLTHQLWQLKIPLIPRLLSHLNRLVTGIEIHPGAKIGKRVFIDHGMGVVIGETAEIGNNCLLYQGVTLGGTGKSHGKRHPTLMENVVVGAGAKVLGSITVGSNTRIGAGSVVVRNVEGNSTVVGVPGRVVHQSGVKVNPLAHSALPDTEANVIKNLMDRIDSLENEILKLQKTLLCLANSESIDISKLGEAQNLKDKEIIEFLGDD

SEQ ID NO: 7948 - DNA, 867 bp, Rhodospirillum rubrum ATCC 11170
  CDS (1)..(867): transl_table=11
atgcgctcaacccttggacgactgaccgtcatcgccggcacggggggcgatggggtgccaccgagtgaaggctttctcgacgccctgtggctgcgcctgcgccaggaagcgcgcgaggcctatgcccatgccccgatgctggcgccgctgttcgtcgagtccatcctcaatcagccaaccctggaggccgccgcctttcaccgcatcgctgcccgcctgaaaaacgatttggtcggcctgggcatcatcatcgatgccttcaaccgcgcggtcgaggccatgcccgagattgcccaggacctgcgcaccgatatcgccgccgttgtcgaacgtgatccggcctgcgcgcgcttcatcgagcccttcttgtatttcaagggcttccacgccatccagacccaccgtttggcccattggctgtggcatcacgacgaacgcgacttcgccctttatctgcaaagccgctcgtcggatgtttttcaaaccgacatccaccccgccgcccgcttcggccgcggcattttccttgatcacgccaccggccttgtcgtcggtgaaacggcggtggtcgaaaacgacgtctgcctgttgcagaacgtgacgctgggcggcaccggcaaggacagcggcgaccgtcaccccaaggttcgccagggggcgatgatcggcgccggggccaagatcctcggcaatatcgaaatcggcgccagcgcccgggtcgccgccggatcggtggtgctgcgctcggtcgaagccggaaccaccgtggccggcgtccccgccaagctcatcacccgcgccgccgcgccaaccgaagaccagatcctcaacgacctgctttatgagtcgttcgcctataccatctga

SEQ ID NO: 7949 - protein, 288 aa, Rhodospirillum rubrum ATCC 11170
MRSTLGRLTVIAGTGGDGVPPSEGFLDALWLRLRQEAREAYAHAPMLAPLFVESILNQPTLEAAAFHRIAARLKNDLVGLGIIIDAFNRAVEAMPEIAQDLRTDIAAVVERDPACARFIEPFLYFKGFHAIQTHRLAHWLWHHDERDFALYLQSRSSDVFQTDIHPAARFGRGIFLDHATGLVVGETAVVENDVCLLQNVTLGGTGKDSGDRHPKVRQGAMIGAGAKILGNIEIGASARVAAGSVVLRSVEAGTTVAGVPAKLITRAAAPTEDQILNDLLYESFAYTI

SEQ ID NO: 7950 - DNA, 765 bp, Rhodospirillum rubrum ATCC 11170
  CDS (1)..(765): transl_table=11
atgagcggccctatggttttcaagcgtttaagggaagatatcgacgccatcatgcaccgggacccggcggctcggtcgcgtctcgaggttttgctgtgctatcccggccttcacgccgtgctgattcatcgccttgccagtgcgctgtggcggcgcggctggctgaccacgggccgtttcgtcagctatctggctaagatcgtcaccggcgtcgagatccatccgggggcgaccatcggccgacggttgttcatcgaccatgcgaccggggtggtgatcggcgagaccgccgaggtcggcgatgatgtgaccctttatcagggggtgaccctggggggcacctcgctgctgccgggcaagcgccatccgacggttgaagacggcgtgatcatcggcgccggggcccagatcctcgggcccttgcgtgtgggcgccggcgcccgggttggcgccaacgccgtggtggtgaccgaggtgcccgccgatgccaccatggtcggcatcccggcgcgcatcgccagccgcagcctgcgcaaggaggatggcgaattctgcagttacggcattcccgagggggtgcccgatccgatcgccggaaccctgaacggcctgatggacgatgtgcgccgcctgaacgcccgcatcgccgaactggaaggccggcttgacgagacggggtccggggtgggggacccccccgccgaacgccggggcccggccctggtcgaagaccgcctcaaagacggagcgcgggttaatggataa

SEQ ID NO: 7951 - protein, 254 aa, Rhodospirillum rubrum ATCC 11170
MSGPMVFKRLREDIDAIMHRDPAARSRLEVLLCYPGLHAVLIHRLASALWRRGWLTTGRFVSYLAKIVTGVEIHPGATIGRRLFIDHATGVVIGETAEVGDDVTLYQGVTLGGTSLLPGKRHPTVEDGVIIGAGAQILGPLRVGAGARVGANAVVVTEVPADATMVGIPARIASRSLRKEDGEFCSYGIPEGVPDPIAGTLNGLMDDVRRLNARIAELEGRLDETGSGVGDPPAERRGPALVEDRLKDGARVNG

SEQ ID NO: 7952 - DNA, 726 bp, Moorella thermoacetica ATCC 39073
  CDS (1)..(726): transl_table=11
atgagagctttgtggcggcggataaaaagggacattgaagtggtcttcgagagggaccctgcggcccgtagcgtcctggaggtgatcctctgctatcccggctttcatgccctgatcctccatcgcttggcccacgcctgttatcgccgggggctggttttgctggcccgactcatatcccagttcaaccgtttcctgaccggtatagagatccaccctggggccaagttgggagaggggatctttatcgatcacggtatgggagtagtcatcggcgagacggctgaagtgggtaataacgttaccctctatcagggagtaaccctggggggaaccggtaaagaaaaggggaaacgccacccaactattggcaataatgtagttatcagtgccggggccaaggttttaggcaatattaccatcggtgacaacgtcaagatcggcgccggttccgttgtcctccgggatgtgccggccaactgcacggtagtcggcgttccggggaaggtggttgtgcgtaacggtcgcaagattgccgacgccgaagtaagcgaagtagacctccgccatgaagaattaccggacccgatggcggagatgctcctctgcctgcaacgccagatccagcgtctggagcaacgggtagaagaactggaggccgaaaaggattggcatgtatctctacaatacgctgacgggacgcaaggaagagttcaccccagttga

SEQ ID NO: 7953 - protein, 241 aa, Moorella thermoacetica ATCC 39073
MRALWRRIKRDIEVVFERDPAARSVLEVILCYPGFHALILHRLAHACYRRGLVLLARLISQFNRFLTGIEIHPGAKLGEGIFIDHGMGVVIGETAEVGNNVTLYQGVTLGGTGKEKGKRHPTIGNNVVISAGAKVLGNITIGDNVKIGAGSVVLRDVPANCTVVGVPGKVVVRNGRKIADAEVSEVDLRHEELPDPMAEMLLCLQRQIQRLEQRVEELEAEKDWHVSLQYADGTQGRVHPS

SEQ ID NO: 7954 - DNA, 1068 bp, Burkholderia thailandensis E264
  CDS (1)..(1068): transl_table=11
atggatcgacgcgagcagtctcaccatataggacggcgcggcggcgcgcgcactccgccgacacggcgaaaacgcggtaaccttgcggaacccgtcacttttatttggcggccgtgtgcgcaagcgcggccgtgcgttttgcctatgtcgaaatccgctcgaaactggggcctcgaacagatcgtcgccgacctgcgcgaatcgcgcgagaaactgcaccgcacgcgccatccgcgaggcattcgcgaactgccgtcgcgcgacgcggtctgcacgatcgtatcggggctgcgcgcgtcgatgttcccgacgcactacggcgcgcccgatctgaccgacgagaccgtcgactactatgtcggccacacgctcgaaagcacgctgcgcctgctctccgagcagattcgccgcgcgctgcggtttttgcccgagcacgccgaaacgccgcttgccgcgctcgacgaacgcgcgttcgagatcgcgcgcgagttcggcacgcagttgccccgcatccgcgcgctgctcgtcagcgatatccaggccgcgtacaccggcgatccggccgcgcaacacatcactgaaatcctgctctgctatccgggcgtgctcgcgatgatgcaccaccggctcgcccatgcgctgtatcggctcggcgtgccgctgctcgcgcgcttcatcaacgagatcgcgcactcggcgacgggcatcgacatccatccgggcgcgcaaatcggcccgagcttcttcatcgaccacggcacgggcgtcgtgatcggcgagaccgcgatcatcggcgagcgcgtgcgcgtctatcaggcggtcacgctcggtgcgaagagctttcccgccgacggcgacgggatactcgtcaaaggtaacgcgcggcatccgatcgtcgaggacgatgtggtcatctatgcgggcgcgacgattctcggccgcgtgacgatcggcaagggctcggtgatcggcggcaacgtatggcttacgcacagcgtgccgcccggcagcagcgtcgcgcaggggaagattcgcgagagcgacaaggatcaggccgagaaggactga

SEQ ID NO: 7955 - protein, 355 aa, Burkholderia thailandensis E264
MDRREQSHHIGRRGGARTPPTRRKRGNLAEPVTFIWRPCAQARPCVLPMSKSARNWGLEQIVADLRESREKLHRTRHPRGIRELPSRDAVCTIVSGLRASMFPTHYGAPDLTDETVDYYVGHTLESTLRLLSEQIRRALRFLPEHAETPLAALDERAFEIAREFGTQLPRIRALLVSDIQAAYTGDPAAQHITEILLCYPGVLAMMHHRLAHALYRLGVPLLARFINEIAHSATGIDIHPGAQIGPSFFIDHGTGVVIGETAIIGERVRVYQAVTLGAKSFPADGDGILVKGNARHPIVEDDVVIYAGATILGRVTIGKGSVIGGNVWLTHSVPPGSSVAQGKIRESDKDQAEKD

SEQ ID NO: 7956 - DNA, 783 bp, Burkholderia thailandensis E264
  CDS (1)..(783): transl_table=11
atgttcacgagacttcgcgaagacgttgccacgatccgcgcgcgcgatcccgccgcccgcagcgcgtgggaagtgctcacgtgctatccggggctgcatgcgctcgtatttcaccggatcgcacacgcgtgctggcgttcggactggcgctggctcggccggttcgtgtcgcaggtcggccgcttcctgaccggcatcgagatccacccgggagcgacgctcggccggcgcgtgttcatcgatcacggaatgggcgtcgtgatcggcgagacagccgtcgtcggcgacgactgcacgatctaccagggcgtgacgctcggcggcacgtcgctcacgcgcggcgcgaagcgtcacccgacgctcgagtgcggcgtgatcgtcggcgcgggcgcgaaggtgctgggcggcttcacggtcggcgcgggcgcgaagatcggctcgaatgcggtcgtcgtgaagccggtgccggcggggggcactgcggtcggcaatccggcgcgggtcgtgatggcagccgatgcgaaacgtacgcccgagcgcgcggcgttctgcgcgtacgggatcacgccgaacgccgacgatccgatgtcgctcgcgattcacggcctcatcgatcatgcggcaaaggaggcgcagcgcgtcgacgagatcgtcgtcgcgctcgagcgtctgggggcgcatctcgacgcgctgcagggctcggacggcgcgcggctcgatttgcgtcgcctgtccgccgcgttcgaggggcgagcgctggacgggaagtcggccgagcgctga

SEQ ID NO: 7957 - protein, 260 aa, Burkholderia thailandensis E264
MFTRLREDVATIRARDPAARSAWEVLTCYPGLHALVFHRIAHACWRSDWRWLGRFVSQVGRFLTGIEIHPGATLGRRVFIDHGMGVVIGETAVVGDDCTIYQGVTLGGTSLTRGAKRHPTLECGVIVGAGAKVLGGFTVGAGAKIGSNAVVVKPVPAGGTAVGNPARVVMAADAKRTPERAAFCAYGITPNADDPMSLAIHGLIDHAAKEAQRVDEIVVALERLGAHLDALQGSDGARLDLRRLSAAFEGRALDGKSAER

SEQ ID NO: 7958 - DNA, 957 bp, Syntrophus aciditrophicus SB
  CDS (1)..(957)
atgatcaatacagaaattgtatgggaaaaaagcaaagaaatgtccccggacaggtacatggactctctcgtcgaagctctctgctccatcaatgtcggtcttaacggcgggtgccggaatgacaggcataaccagtccctgccttctcagaacgtcatcagagaagtcatggagacattgcggtcgattcttttccccggctacttcgggttttcccacctgaagaaagacagcgttcattttcatatcggatccgcattggatcgcgtgcaacctgttctggtcgatcaaatccagaagggactgtgttttgcctgccgggatggagtaacatgcctgtccgattgtcatgagcaggcgcagttcatcgcgaccgccttttttaaacgactgccggtcatccagcggttgctcatgaccgacgcctgtgcggcctatgaaggcgacccggcggcttccagtctggatgaagtcatcttctgctatccggggctgctggcgctcaccaaccatcgcctggctcatgaacttcaaaagctggaggtgcccttcatccctagaatgattgcggaacaggcccacagcctcaccggaatcgacatccatcccggcgcggcaatcggagagtccttcttcatcgatcacggcgccggcgtggtgatcggcgaaacgagcatcatcggcaaccgggtgcgcatctatcagggcgttaccctgggagcaaagagttttcagaaggatgaaaacggcatgctggtcaaaggggtgccccgccatcccattatagaagatgacgtcatcgtatattccggggctacgatattgggaagggtcacgatcggtcgcggatcggtcgtcggaggcaacgtctggctggttaacagcgtgccgcctcaaagccggatcacccaggcgcagtcctgccagagtgatttcagtgatggcgccgggatctga

SEQ ID NO: 7959 - protein, 318 aa, Syntrophus aciditrophicus SB
MINTEIVWEKSKEMSPDRYMDSLVEALCSINVGLNGGCRNDRHNQSLPSQNVIREVMETLRSILFPGYFGFSHLKKDSVHFHIGSALDRVQPVLVDQIQKGLCFACRDGVTCLSDCHEQAQFIATAFFKRLPVIQRLLMTDACAAYEGDPAASSLDEVIFCYPGLLALTNHRLAHELQKLEVPFIPRMIAEQAHSLTGIDIHPGAAIGESFFIDHGAGVVIGETSIIGNRVRIYQGVTLGAKSFQKDENGMLVKGVPRHPIIEDDVIVYSGATILGRVTIGRGSVVGGNVWLVNSVPPQSRITQAQSCQSDFSDGAGI

SEQ ID NO: 7960 - DNA, 735 bp, Frankia sp. CcI3
  CDS (1)..(735): transl_table=11
atgctctcgacgctgcgccatgacctgcgcacggtgaaggaacgggatccggccgcccgctccaccctcgagatcgccctgtgctatcccggcgtgcacgccgtctggggccaccggatcagccactggctgtggacccgtgacctgcggctgcccgggcgcgtggttgccacgctcacccgcatgctcaccggggtcgagatccaccccgccgccacgctcggccccggcgtcttcatcgaccacgccaccggcgtggtcatcggggagaccgccgaggtcggcgccgacgtcacgatctaccacggggtcaccctcggcggcaccagcctggaaccgaccaagcggcaccccaccatcggcgaccgagtgatcatcggtgccggcgccaaggttctcggcaacatcaccgtcggctcggacagccgcatcggggccaacgccgtcgtcgtgcggcccgtgccgcccggctcagtggtcgttggcgtccccggccaggtcatcacccccagccgtccccggccggccaccgccctgcccggtcaggacgacgtgctccccgacctcgtcggcgtcagcctgaagtccctgctcacccgggtcgaccagctggaggcggtgctcgacgggaacaccgggaacaccgacggccgcgccgacgggcgggtcgcagcccgtcccacgatccgcccgccccaggccggtgtgtggcacggcgaggacttctccatctga

SEQ ID NO: 7961 - protein, 244 aa, Frankia sp. CcI3
MLSTLRHDLRTVKERDPAARSTLEIALCYPGVHAVWGHRISHWLWTRDLRLPGRVVATLTRMLTGVEIHPAATLGPGVFIDHATGVVIGETAEVGADVTIYHGVTLGGTSLEPTKRHPTIGDRVIIGAGAKVLGNITVGSDSRIGANAVVVRPVPPGSVVVGVPGQVITPSRPRPATALPGQDDVLPDLVGVSLKSLLTRVDQLEAVLDGNTGNTDGRADGRVAARPTIRPPQAGVWHGEDFSI

SEQ ID NO: 7962 - DNA, 723 bp, Novosphingobium aromaticivorans DSM 12444
  CDS (1)..(723): transl_table=11
atgttcaacggcctgatcgcctatctggactcgatccgctcgcgcgatcccgcgccgcgatcgcgttgggaaatcctgctctacccggggctgtgggccgtcgggttccaccgcgtggcgcactggctgttcgaggcggagctgtatttccttgcccgcgcgatcaatcacttctcgcgtttcctgaccgccatcgacatccatccgggcgcgaagatcgggaagcacctgttcatcgagcatggctttaccgtgatcggcgagaccgccgagatcggcgacaacgtgacgatctaccagtgcgtgacgctgggcgggaccaatccgaccaacggcattccgggcaagcgccaccctaccttgtgcgacgaggccatcatcgggtccggcgcgcagatcctggggccgatcaccgtgggcgcccgtgcacgcgtcggcgcgaatgcggtggtgaccgacgacgtgccggaaggcgcgacgatgattggcctcaaggcgcgttcgacgctggtcccggccgagacctggctcaagcagttcattccctatggcacgccctgcaaggagccgtgcgagcccaatggcggaacgcgggtcgacgatctcgaggcggaagttgccgcgctcaaggcccaggtggccgcgctgatggcggcgcgcgacgggggtgacgacctgacgcccgcgccgacgccaagccgggcgcggaggacgcgcagctga

SEQ ID NO: 7963 - protein, 240 aa, Novosphingobium aromaticivorans DSM 12444
MFNGLIAYLDSIRSRDPAPRSRWEILLYPGLWAVGFHRVAHWLFEAELYFLARAINHFSRFLTAIDIHPGAKIGKHLFIEHGFTVIGETAEIGDNVTIYQCVTLGGTNPTNGIPGKRHPTLCDEAIIGSGAQILGPITVGARARVGANAVVTDDVPEGATMIGLKARSTLVPAETWLKQFIPYGTPCKEPCEPNGGTRVDDLEAEVAALKAQVAALMAARDGGDDLTPAPTPSRARRTRS

SEQ ID NO: 7964 - DNA, 672 bp, Desulfitobacterium hafniense Y51
  CDS (1)..(672)
atggtgtttggccaaattaagcaagacattaaagtgatttttgaaagagatccggcggctaaaacgatagttgaggttatcctgtgctatccgggtcttcatgcgttgatcgcccatcgtctggcacactgtctgtataaaaagaatatggttttaatccctcgcttaatctcccagacctcccgtttttttacggggatagaaattcatcccggtgcgaaaatcggccaggggctctttattgatcacgggatgggagtggtcatcggggagacggccgaagtgggggataatgttaccatctaccaaggggtcactctgggcggaacaggtaaggaaaaagggaaaagacaccctactgttgggaataatgtttttatcggttcgggagctaaaatattaggttccattaaaattggggataatgttaaaatcggggcaggatctgtggtcacgaagcctgttcccagcaataccacggtggtgggtgttcctggaaaggttgtctcacgccacgggatgcccttaaaggaattgcatgtggttacgaaatccgtatgtaataaagagatccgggcagaagaaatgccggatcctgttcaagaaacattgcaaatcctcatggaacggattaattatctggagaaaaaactaggggaaaaggagagctga

SEQ ID NO: 7965 - protein, 223 aa, Desulfitobacterium hafniense Y51
MVFGQIKQDIKVIFERDPAAKTIVEVILCYPGLHALIAHRLAHCLYKKNMVLIPRLISQTSRFFTGIEIHPGAKIGQGLFIDHGMGVVIGETAEVGDNVTIYQGVTLGGTGKEKGKRHPTVGNNVFIGSGAKILGSIKIGDNVKIGAGSVVTKPVPSNTTVVGVPGKVVSRHGMPLKELHVVTKSVCNKEIRAEEMPDPVQETLQILMERINYLEKKLGEKES

SEQ ID NO: 7966 - DNA, 834 bp, Saccharophagus degradans 2-40
  CDS (1)..(834): transl_table=11
atgcacaaaacaacacccatttcgacccttgcggaccaaaagtctcaggagttggacccagtttggcaaaccatccgccaagaaactcgggaacaagtggaagaagaacccgcattggcgagtttcttacacgcaactattttaaatcacgatacactagaaagcgccttgagctttcacttggcccacaaactggcaaaccctgcgatatcggccctgcaaattcgtgagattattgaagagtcgatgagccacgacagctgcattagcgaagccgtgcgcgcagatattcgcgccgttttcgatcgcgattcggcctgcaattcgtatgcattgccctttttatactttaaaggttttcacgcgttgcaagcattccgcgtggcccactgcctgtacaaacgcggtcgtaaatctttggcctatttcttacaaagccatattgcgcttacctttggggtagacattcaccctgctgcgcgcataggtaaaggcattatgatggaccacgccacaggaatagtaattggtgaaactaccgtcgtcgaagatgatgtatcgctaatgcaaggcgtcacccttggcggaaccggcaaagaagccagcgatcgtcaccccaaagtacgcaagggcgtgttggtgggcgccggcgctaaaattcttggcaatatagaaattggcgaaggggcaaaggtaggcgctggcagtgtggtgcttgaagctgtgcctccacacactacggttgttggtgtgcctgcacgcgtcgtcggtgtaccacagtcgcaaagcccagcactagatatgaaccacggtattcagtgcgattgcgagtaa

SEQ ID NO: 7967 - protein, 277 aa, Saccharophagus degradans 2-40
MHKTTPISTLADQKSQELDPVWQTIRQETREQVEEEPALASFLHATILNHDTLESALSFHLAHKLANPAISALQIREIIEESMSHDSCISEAVRADIRAVFDRDSACNSYALPFLYFKGFHALQAFRVAHCLYKRGRKSLAYFLQSHIALTFGVDIHPAARIGKGIMMDHATGIVIGETTVVEDDVSLMQGVTLGGTGKEASDRHPKVRKGVLVGAGAKILGNIEIGEGAKVGAGSVVLEAVPPHTTVVGVPARVVGVPQSQSPALDMNHGIQCDCE

SEQ ID NO: 7968 - DNA, 954 bp, Methylobacillus flagellatus KT
  CDS (1)..(954): transl_table=11
atgagtcaacttcgaaacaatgctgagctcggtgatgaactggggatcagccagatcgtcactagcttgcgcgaagtcaggttaactgcgttggagcaccgcaaccggctgaaccgccctcccaagcttcctgcgcgcaaggcgcttgcgggagtcgtagaggggttgggagccgccttatttcccaaccgccttggtttgccggacctgcgggaggagggcattgattatttcgtggggcatacgctggatgtggcactacgggaactggtcgctcaggtgcggctggagttgagcttcatcgcagagctcgatcaggtcgaggacctgaaagtgcgcgcaacggccttggtgcgtgagttcgcttcccagctgcccgccatccggcatttgctcgacagcgacatccgcgcggcttatgaaggtgatccggcagcgcgcagcgtagacgaagtgctggtgtgctacccaggtatcaacgctatcacccactaccgtattgctcatgtgcttcaccagttgggtgtgccgttgattgctcgcatgatcactgaaattgcccattccgccacaggcatcgacattcatcccggtgcccagatcggtgaggggttttttattgaccacggtacgggcgttgtcatcggagagaccagcattattggccgccatgtacgcctctaccaggcagtcacgctgggcgccaagcgctttcctgtagatgccgatggcaccctggtgaaggggaatgcgcgccacccgattgtcgaggatgacgtcgtcatctacgccggagccacgatcctgggccgcattacgataggtcgcggctcggtgatcggcggcaatgtctggctcacttacagtgttccacccaatagcaatatcacccaggcgcagatgggggaaggcgcgcctgcaggcccgcgcaacggcactgtgactcatcagtaa

SEQ ID NO: 7969 - protein, 317 aa, Methylobacillus flagellatus KT
MSQLRNNAELGDELGISQIVTSLREVRLTALEHRNRLNRPPKLPARKALAGVVEGLGAALFPNRLGLPDLREEGIDYFVGHTLDVALRELVAQVRLELSFIAELDQVEDLKVRATALVREFASQLPAIRHLLDSDIRAAYEGDPAARSVDEVLVCYPGINAITHYRIAHVLHQLGVPLIARMITEIAHSATGIDIHPGAQIGEGFFIDHGTGVVIGETSIIGRHVRLYQAVTLGAKRFPVDADGTLVKGNARHPIVEDDVVIYAGATILGRITIGRGSVIGGNVWLTYSVPPNSNITQAQMGEGAPAGPRNGTVTHQ

SEQ ID NO: 7970 - DNA, 753 bp, Methylobacillus flagellatus KT
  CDS (1)..(753): transl_table=11
atgttcagcaaaataaaagaagatatcggcgttgtgtttgagcgagatcccgcagcgcgtacacgttgggaaatcctcaccacctaccctggcgtccatgctttgctcattcaccgtttctcgcaccggctttggcggatgcgcctttactggttggcacggctcagctcttatatcgcacgctggtttacggggatcgaaatccacccaggcgccgtcattgggcgccgtgtgtttatcgaccacggcatgggcgtggtcatcggtgaaacggccgtgataggagatgactgcactctatatcacggcgtcaccctgggcggtacatcctggaacaagggcaagcgccatccaacattgctaaatggcgtcgtgattggcgctggcgccaaagtgctgggcccaatcaccatcggcgcaaaggccaagatcggatccaatgccgtcgtcgtcaaggatgtgccggacaatgccaccgcagtgggtattcctgcaagaatcgtcgaccaggaacaaccgcgcccgcaggacaatatggcagagaaaatcggctttgccgcctatgctgtcagcgaaaagatgaatgacccattgaacaaggccattcaaaccctcatcgatcatattgccaatcaggacaatcaactgcaagaggtcaggcaacagctggcaaaactcggcgctgatatcgaaaccgatgtcgaaatcggacatgctttcgatgtgaactccatcaacaaaatagttgactaa

SEQ ID NO: 7971 - protein, 250 aa, Methylobacillus flagellatus KT
MFSKIKEDIGVVFERDPAARTRWEILTTYPGVHALLIHRFSHRLWRMRLYWLARLSSYIARWFTGIEIHPGAVIGRRVFIDHGMGVVIGETAVIGDDCTLYHGVTLGGTSWNKGKRHPTLLNGVVIGAGAKVLGPITIGAKAKIGSNAVVVKDVPDNATAVGIPARIVDQEQPRPQDNMAEKIGFAAYAVSEKMNDPLNKAIQTLIDHIANQDNQLQEVRQQLAKLGADIETDVEIGHAFDVNSINKIVD

SEQ ID NO: 7972 - DNA, 978 bp, Burkholderia xenovorans LB400
  CDS (1)..(978): transl_table=11
atggctgtgtttgatgtcgatgaaatcgtggcggcgcttcagacggtccgccagcaatggcgcgaagtgcagaagcgctcgctcgaaccgggtgggcgcgaattgccggggcgcgaggcgctcgcggagattgtcgatacgctcaagggcgtgctctttccgatgcggcttggaccacccgatctgcgtcaggaaagcgaaaacttctatgtcgggcacgcgctcgatgccgcgctgcatgcgttgttgagtcaggcgcggctggagctgcattatcgaagccgccatcagccgccgccggccgccacgatcgaggctcaggcgggcattgctgtgcgtgcgttcgcagcacgtctgccggcgattcgcagcctgctcgacagcgacgtactggcggcgtttcacggcgatcccgcagccggcagcgtggacgaagtgctgctgtgttatcccggcgtgctggcgatgatccatcaccggctggcacacgagctttatgggttgggcttgccgctgctggcccgcattgtcgctgagctcgcgcatgcacaaaccggtatcgacattcatccgggtgcgaagatcggtgcgggatttttcatcgatcacggcacgggcgtggtgatcggcgaaacagcggtcattggcgagcgcgtacgtctttatcaggccgtcacgctgggcgctaaacgctttccacgcgatgcacagggccatctggaaaagggccacgcgcgccatccgatcgtcgaggacgacgtggtgatctacgcgggcgcgaccattctcgggcgcgtcacgcttggacagggttcggtgatcggcggcaatgtctggctgacgcaggacgtcgcgccgggctcgcatgtcacgcaggccgtgtcgcgcagcgagggcaccggcactgccgtgagcgccgagcgcacgccgcgcggtcatacagacactgtccctgtcgcggcgggggccgcgacatga

SEQ ID NO: 7973 - protein, 325 aa, Burkholderia xenovorans LB400
MAVFDVDEIVAALQTVRQQWREVQKRSLEPGGRELPGREALAEIVDTLKGVLFPMRLGPPDLRQESENFYVGHALDAALHALLSQARLELHYRSRHQPPPAATIEAQAGIAVRAFAARLPAIRSLLDSDVLAAFHGDPAAGSVDEVLLCYPGVLAMIHHRLAHELYGLGLPLLARIVAELAHAQTGIDIHPGAKIGAGFFIDHGTGVVIGETAVIGERVRLYQAVTLGAKRFPRDAQGHLEKGHARHPIVEDDVVIYAGATILGRVTLGQGSVIGGNVWLTQDVAPGSHVTQAVSRSEGTGTAVSAERTPRGHTDTVPVAAGAAT

SEQ ID NO: 7974 - DNA, 846 bp, Burkholderia xenovorans LB400
  CDS (1)..(846): transl_table=11
atgttcacgagacttcgcgaagacatcgccacgatccgcgagcgcgaccccgccgcccgcagcgcctgggaagtcctcacgtgttatccgggtctgcacgcgctcgtgctgcaccggttcgcccatgcgtgctggcaggcgaggcgccgctggctcgcgcgcttcgtctcgcagttggcgcgtttcatgaccggcatcgaaatccatccgggcgcaaccctcgggcggcgcgtgttcatcgaccacggcatgggtgtggtgatcggcgagaccgcccaggtcggcgacgactgcacgatctaccagggcgtgacgctcggcggcacgtcgctcacgcgcggggcgaaacggcatccgacgctcgagcgcggcgtgatcgtcggcgcgggcgcgaaggtgctcggtggctttacgatcggcgccgaggcgaagatcggttcgaacgcggtggtgaccaagcccgtgccggcacggggcacggcggtgggcaatccggcgcggatcatcgtgccggcggcggctgccgtggcgtcggaaggcgcttccgtcgtggcgaattccgattccggcggcgccgcgcgcggtgcaaaacgctccgctggaagcagccgcttctgcgcgtacggcatcacgccgaatgcggacgatcccgtctcgctggcgattcacggcctgatcgatcacgctgccacgcaagcgaagcgcatcgacgaaatagtcgatgcgctggagcggctgggcacgagtctcgaagcattgcaaggtgcggacgcggcgctgctcgatctgcggcgtctgtcggccgcgatcgcaggcaaggtggatggggtggtcgcggagcgctga

SEQ ID NO: 7975 - protein, 281 aa, Burkholderia xenovorans LB400
MFTRLREDIATIRERDPAARSAWEVLTCYPGLHALVLHRFAHACWQARRRWLARFVSQLARFMTGIEIHPGATLGRRVFIDHGMGVVIGETAQVGDDCTIYQGVTLGGTSLTRGAKRHPTLERGVIVGAGAKVLGGFTIGAEAKIGSNAVVTKPVPARGTAVGNPARIIVPAAAAVASEGASVVANSDSGGAARGAKRSAGSSRFCAYGITPNADDPVSLAIHGLIDHAATQAKRIDEIVDALERLGTSLEALQGADAALLDLRRLSAAIAGKVDGVVAER

SEQ ID NO: 7976 - DNA, 963 bp, Methanococcoides burtonii DSM 6242
  CDS (1)..(963): transl_table=11
atgttagacaaaagaacgaaacgatgttcgatgcaatattcaattatgggaatgagttatcgttcaaaattaccggagatcatcgattccgttgcaagtagctgctcagataaaggctgctttgaacatattgattcagcggtcataccttcaagggaatcaattgttgagatcatagacctttttaaggatgtgcttttcccgggttattttggagatcaaacggttgaaaggagcaatctgatatatcatattggaaatgagatcaacgaactttttgaaaaactgtcaaaacaggtgacgaacagtattcttcatgagtgtcgtcgcacggaagaggattgtgccgaatgtattgaaaaaggacaggaagaaacagttatgctgttaaggaagataccacagataaggtcacttcttgcagcagatattattgcagcctatgagcatgacccggctgcaaaagggtacgatgagatcattttcagttatccgggaatttttgctcttatggtctacaggatagctcatgagttgaatgaacaggatattaagatccttccgcgtattatgaccgaatatgcccacagcgtagttggaatcgatatccatccgggtgcaaagatcggaaaaggattttttatcgaccatggtacaggggtggtcataggggagacttcagagataggagacaatgtaaggatataccagggggttaccctcggttcacttagtttcccaaggggtgaagagggacagatacttcgtgaccttaaaagacatcccacgatagaggatgatgtcgtgatatattccaattcaacgatccttggcggtgataccgttataggagcgcgctccgttataggaggtaatgtctggttaacgagatcagtaccagcagatactaaagtactgatagaagaaccaaagctggttttcaaggatagaacatcttcctga

SEQ ID NO: 7977 - protein, 320 aa, Methanococcoides burtonii DSM 6242
MLDKRTKRCSMQYSIMGMSYRSKLPEIIDSVASSCSDKGCFEHIDSAVIPSRESIVEIIDLFKDVLFPGYFGDQTVERSNLIYHIGNEINELFEKLSKQVTNSILHECRRTEEDCAECIEKGQEETVMLLRKIPQIRSLLAADIIAAYEHDPAAKGYDEIIFSYPGIFALMVYRIAHELNEQDIKILPRIMTEYAHSVVGIDIHPGAKIGKGFFIDHGTGVVIGETSEIGDNVRIYQGVTLGSLSFPRGEEGQILRDLKRHPTIEDDVVIYSNSTILGGDTVIGARSVIGGNVWLTRSVPADTKVLIEEPKLVFKDRTSS

SEQ ID NO: 7978 - DNA, 744 bp, Ralstonia metallidurans CH34
  CDS (1)..(744): transl_table=11
atgttcactcgcctgaaggaagatatcgatacgatcatgctgcgcgaccccgccgcgcgcagccgtctggaagtcctgacttgctatcccgggctgcacgccgtggtgtttcaccgcgtggccaatgcgtgctggcgaggtggatttcactggctggggcgctggatctcgcactggtcccgctttctgaccgggatcgagatccacccggcggtcaagctgggtcgtcgcgtgttcatcgaccatggcatgggcgtggtgatcggcgaaaccgccgagattggcgacgattgcacgatttaccagggtgtgacgttgggcggcacgtcgctgtacaagggccagaaacgccatccgacgctgggtgtcggcgtggtggtgagcgccggcgccaaggtgctcggcggcttcgaggtgggcgcgggcgcgcgcgttggatctaatgccgtcgtgctgaagcctgtgcccgctggggcgacggcagtggggattccggcacgcatcatcatgcccgatgcgccttccacgcagcagggcgcgaaacaggaattctcggcctacggcatcacgccgaacgcggacgatcccgtgtccctggcgctcaagagcctgatcgacaacgcggccaagcaacatgaccgcatcgaggccgtgctggccgcgctcgaccggctcggcgagcatctcgagaacacgccgaacgaccgcttcgacgcgagcgagctgcgcaagctgatgaagtag

SEQ ID NO: 7979 - protein, 247 aa, Ralstonia metallidurans CH34
MFTRLKEDIDTIMLRDPAARSRLEVLTCYPGLHAVVFHRVANACWRGGFHWLGRWISHWSRFLTGIEIHPAVKLGRRVFIDHGMGVVIGETAEIGDDCTIYQGVTLGGTSLYKGQKRHPTLGVGVVVSAGAKVLGGFEVGAGARVGSNAVVLKPVPAGATAVGIPARIIMPDAPSTQQGAKQEFSAYGITPNADDPVSLALKSLIDNAAKQHDRIEAVLAALDRLGEHLENTPNDRFDASELRKLMK

SEQ ID NO: 7980 - DNA, 777 bp, Acidobacteria bacterium Ellin345
  CDS (1)..(777): transl_table=11
atgggcttttggcagggagttcgggaagacattcaggcgatcttcgagcatgatccggcggcaacgtccatgctcgcggtgttgctctgctatcccggactccatgcccgcacctttcaccgcttcaaccactggctgtggatcaaacgctttcgcctgctggcgcgttggctgtcgcaggtcgtgcgctttttcaccggcatcgagatccatcccggcgcagtcctcggacgccgcgtctttatcgatcacggcatgggagtagtcatcggcgagactgcgttcgtgggcgatgacgttacgctctaccagggtgtgacgctcggcggcactggcaaggaaaaagggaagcgccaccctacgctacgcagcggcgtgttcgtcgggaacaatgccaatattctgggaaacattacgattggggagaattcgcgcgtaggcgccgggtcggttgtattacgagatgtgccgccgaactcgacagtggtcggcgtgcccgcgcacatcatttaccaggacggcaagcgcgttctcatcaccgaccccaaggacgtaaaagacccgctctcggatgtgattatcgcgctggccggcgaagtccgcgaattgaaggagcggctcggatttagcgaacccgcgagtgccagcggagatcacgccgtacagcatctgcaatccgtacgaactcttgccgacgaagacagcgagcgcgatgagtatcgcttcacgcagcggccgtttgacgaacagttcactgagattgcatcaggcatatag

SEQ ID NO: 7981 - protein, 258 aa, Acidobacteria bacterium Ellin345
MGFWQGVREDIQAIFEHDPAATSMLAVLLCYPGLHARTFHRFNHWLWIKRFRLLARWLSQVVRFFTGIEIHPGAVLGRRVFIDHGMGVVIGETAFVGDDVTLYQGVTLGGTGKEKGKRHPTLRSGVFVGNNANILGNITIGENSRVGAGSVVLRDVPPNSTVVGVPAHIIYQDGKRVLITDPKDVKDPLSDVIIALAGEVRELKERLGFSEPASASGDHAVQHLQSVRTLADEDSERDEYRFTQRPFDEQFTEIASGI

SEQ ID NO: 7982 - DNA, 780 bp, Silicibacter sp. TM1040
  CDS (1)..(780): transl_table=11
atgggcgccaatcccctgagacagagccttctgcaagaggtgcgtgatctttttgcgcaggagccagccctgcgcggcctctacggctatgaccccgatcaggtcggtaccgtgcctgcgttgttcgctgcggtgctttcctccagttcgcccgacccaaagctgcgggatctggtgcgtgaccttgctcttaaggtttttgaaactgggtctgagcttgtggaggttattctggacgatttgctggcaacaaccgcccgggatgaggccgagagtgctgcgcaggtgctgcacagcgcgcatgggtttcaggcgctgatgtcctaccgtctgacccgcgcgctctggcttgatgggcggcaaacgcttgcgctggcgctcaagcttcagtttacccgcgtgttctcggtcgagatctggcctcaggcccaaatcggacgcggggtctgggtggatcacgggcttgggctggtgattggccaggccgccgtgatcgaggacgacgtctgcctctggcatggcgtcacgctgggatcgaacttcgtcgatatgggcgaggcccgccacccaaccctgcgccgtggcgttgtggtgggagccggcgcgaccctccttggtccgatcgagatcggtgccggcgcgaccatcgcagccggcgcggtcgtcacccgcgatgtgcccgcgggccatgtggttgcggggccacccgcgtcagatcggggtgtcggtcgcttcgcgggcttcacacctttgcagcaactcagggggcaagacagatga

SEQ ID NO: 7983 - protein, 259 aa, Silicibacter sp. TM1040
MGANPLRQSLLQEVRDLFAQEPALRGLYGYDPDQVGTVPALFAAVLSSSSPDPKLRDLVRDLALKVFETGSELVEVILDDLLATTARDEAESAAQVLHSAHGFQALMSYRLTRALWLDGRQTLALALKLQFTRVFSVEIWPQAQIGRGVWVDHGLGLVIGQAAVIEDDVCLWHGVTLGSNFVDMGEARHPTLRRGVVVGAGATLLGPIEIGAGATIAAGAVVTRDVPAGHVVAGPPASDRGVGRFAGFTPLQQLRGQDR

SEQ ID NO: 7984 - DNA, 807 bp, Silicibacter sp. TM1040
  CDS (1)..(807): transl_table=11
atgttggatacacataaggccgtgaggcaaatcgaccctgtctggggccggatcaccgaagaagcggaaagagccgtcgcagaacaacccttgatgggtgggctgattcatgcctgcattctccaccacaagacgctcgacaaggcgctgagttaccggattgcggccaagctctgttccaacgagatgtcgatggtgatcctgcgcgagatcgttgatggcgcttatgaggccgagcccgcgctggttgaggccgcgcgcgccgacctgatggccgtctttgagcgcgaccctgcctgccaccggctcttgcagccgatcctctacttcaaaggctatcaggccattcaggcctaccgcgtgggccattggctctggcagcagggcgattgggacctggcctatttcttccagatgcggatctccgagatctttggcgtcgatatccatccggcggcgaagatcggcaaggggatcatgatcgaccacgcccattccatcgtgatcggggaaaccgccgtggtgggggacaatgtgtcgatgctgcattcggtgacgctgggcgggaccggcaaggaagaagaggaccgtcaccccaagatcgaggatggcgtgctgatcggtgcgggcgccaaggtgctgggcaatatccgcatcggtcactgctcgcgcattgcggcggggtccgtggtgctgcaggaggtgccgccctgcaagaccgtggccggggtgcccgcaaagatcgtgggcgaggcgggctgcgatcagccctccgtcagcatgaaccaggtgcttgcggggaaatag

SEQ ID NO: 7985 - protein, 268 aa, Silicibacter sp. TM1040
MLDTHKAVRQIDPVWGRITEEAERAVAEQPLMGGLIHACILHHKTLDKALSYRIAAKLCSNEMSMVILREIVDGAYEAEPALVEAARADLMAVFERDPACHRLLQPILYFKGYQAIQAYRVGHWLWQQGDWDLAYFFQMRISEIFGVDIHPAAKIGKGIMIDHAHSIVIGETAVVGDNVSMLHSVTLGGTGKEEEDRHPKIEDGVLIGAGAKVLGNIRIGHCSRIAAGSVVLQEVPPCKTVAGVPAKIVGEAGCDQPSVSMNQVLAGK

SEQ ID NO: 7986 - DNA, 846 bp, Myxococcus xanthus DK 1622
  CDS (1)..(846): transl_table=11
atggatgactccaacgccaggctggtcgcggccctgctggaagcccggcagcgacactgcttccctgcggacgtacggcgcgctgcccccgaattcgtaggccaggtgctcggcctgctcttcccccacttcgccgagcgcctggagtgtacggccgcggccgtccaccgcgacgtcaccaccgtggaggccagcctccaccgcatccgggacacgctggcgcccctgtacccgggcattgaacgggacttgccggcgcgcttcatggagcggctgcccggcctctatgactggctgcgacaggacgcggacgccatcttcgaggcggacccggccgcgcgcaccgtggacgaggtcatcctcacctacccgggcttcaccgccatcgccatctaccgggtggccaacgcgctgcacgccctgggcttcccgctgctgcctcgcttgctcacggagtacgcgcaccagcgaaccggcgtggacatccacccgggtgccaccattggccggcgcttcgtcatcgaccatggcactggcgtcgtcatcggtgagacgacgctcattggcgacaacgtcaaaatctatcagggcgtcaccctgggcgcgctcgtcgtggagaaggggctgacggacaagaagcgtcaccccaccatcgaggacgacgtggtggtgtacgccaacgccaccatcctgggcggagaaaccgtggtgggccggggcagcatcatcgccggcaacgcctggctcacgcagagcatcccttctcaatccgtggttacccgccgcagcgaggtgcgtcagcgcggcgagaatggctcgctggacgcactcgaattccacatctga

SEQ ID NO: 7987 - protein, 281 aa, Myxococcus xanthus DK 1622
MDDSNARLVAALLEARQRHCFPADVRRAAPEFVGQVLGLLFPHFAERLECTAAAVHRDVTTVEASLHRIRDTLAPLYPGIERDLPARFMERLPGLYDWLRQDADAIFEADPAARTVDEVILTYPGFTAIAIYRVANALHALGFPLLPRLLTEYAHQRTGVDIHPGATIGRRFVIDHGTGVVIGETTLIGDNVKIYQGVTLGALVVEKGLTDKKRHPTIEDDVVVYANATILGGETVVGRGSIIAGNAWLTQSIPSQSVVTRRSEVRQRGENGSLDALEFHI

SEQ ID NO: 7988 - DNA, 819 bp, Mesorhizobium sp. BNC1
  CDS (1)..(819): transl_table=11
atgacggccagacaagcggttcgttcgaatgcgccgcaacagatcgacccgatttggtccgagatccgggccgaggcacggactgcggtcgagaatgacgcattgctcgcagctttcctttattccacgatcctcaatcaggcgacccttgaagacgccgtcattcatcggatttcgcagcggctcgatcatgcggatctcagcgcggatcttctccagcagacgttccttgccatgtgggaagatcagccggactggagcagcattctgcgagtcgacattcaggcctattacgatcgggatccggcctgcgaccggtttttgatgccggtgctctatttcaagggattccacgccattcagacacatcgtctggcccattggctttggggcaagggccgcaaggatttcgcgctttacctgcaaagccgctcctccgccgtgttccagacggacattaaccccgcagcgacaatcgggcgcgggatcttcctcgaccatgccacgggcctcgtcgtcggcgagacagccgtcatagaagacgatgtatcaatcctccaggacgtaacgctgggcggaaccggcaaggaaacgggcgaccgtcatccgaagatccgtcacggagtgctgattggcgccggcgccaaaatcctcggaaatatcgagatcggccactgcacgaaggtcgccgccggatctgtcgtcgtcaagcccgtgccgcccaacaagacggtggcgggcgtccccgcacgtatcatcggagaggctggctgcaacgagccgtcacgcgctatggatcagcttctgcttgaggaatag

SEQ ID NO: 7989 - protein, 272 aa, Mesorhizobium sp. BNC1
MTARQAVRSNAPQQIDPIWSEIRAEARTAVENDALLAAFLYSTILNQATLEDAVIHRISQRLDHADLSADLLQQTFLAMWEDQPDWSSILRVDIQAYYDRDPACDRFLMPVLYFKGFHAIQTHRLAHWLWGKGRKDFALYLQSRSSAVFQTDINPAATIGRGIFLDHATGLVVGETAVIEDDVSILQDVTLGGTGKETGDRHPKIRHGVLIGAGAKILGNIEIGHCTKVAAGSVVVKPVPPNKTVAGVPARIIGEAGCNEPSRAMDQLLLEE

SEQ ID NO: 7990 - DNA, 894 bp, Cytophaga hutchinsonii ATCC 33406
  CDS (1)..(894): transl_table=11
atgaataagcactttttagaaacgctcttacaaaaacaccagcaggcaggtacctttccatctacttccgatatctgcagattggttacgcgcattctattggttttatttccggaacaaacgcaggcaaaatataaagatgttgctgatgttgaaatacaaatgggcgtgtatcaaaaagaactgacacgattgttaggatccatgcaaaaagatctgcctgctcctgcaaatgaattgtcagatgctttcatgaatgaactttctgtgatctatgataaactcttactcgacatacaggctatcttaaacggtgatcctgctgcacgttcggagtttgaagtgatccgtgcctatccgggtttttatgcgattgctttttaccgcatggcgcatgcgttatacaaattgaatattcccttaatgccgcgtattataatggaatatgcgcatagcaaaacaggtattgatattcatccgggtgctacaatcggtaaaaacttttatatcgatcacggtacaggtattgtaatcggagaaacggcgcacattggagacaatgttaaagtgtatcagggtgtaacacttggtgccttgagtgtttcaaaagataaggcggataccaaacgccatccaacaattgaagacaatgtgatcatttactcaggtgctaccatattaggcggcaaaacagttgtaggccatgacagcatcattggcggaaacgtctggcttacagaaagcgtacaaccgtttacgcgtgtgtatcacaaagcacagatcgaagtaataataaaaaatgctgatccttctttaaacgaaaccgaaaacaatgaagaagctattcgaaaaatgaagaaggctgaatcagaaaacacaaaaaagaattcctga

SEQ ID NO: 7991 - protein, 297 aa, Cytophaga hutchinsonii ATCC 33406
MNKHFLETLLQKHQQAGTFPSTSDICRLVTRILLVLFPEQTQAKYKDVADVEIQMGVYQKELTRLLGSMQKDLPAPANELSDAFMNELSVIYDKLLLDIQAILNGDPAARSEFEVIRAYPGFYAIAFYRMAHALYKLNIPLMPRIIMEYAHSKTGIDIHPGATIGKNFYIDHGTGIVIGETAHIGDNVKVYQGVTLGALSVSKDKADTKRHPTIEDNVIIYSGATILGGKTVVGHDSIIGGNVWLTESVQPFTRVYHKAQIEVIIKNADPSLNETENNEEAIRKMKKAESENTKKNS

SEQ ID NO: 7992 - DNA, 798 bp, Haemophilus somnus 129PT
  CDS (1)..(798): transl_table=11
atgtcaatagaagtatggagtcttattcgtgctgaagcagcaaaactcgctgaaaatgaaccaatgctagccagtttctttcatgcaactatcttaaaacataacaatctaggcagtgcattaagctatattcttgcgaacaaattagctaatccaattatgcccgctattgcattgcgagaaattattgaagaagcacatcaaaatcaaccgcaaattatcgaaagtgcggcttgcgatatccgggccgtgcgtcagcgagatcctgccgtagaacaatactctacaccgttactttatttgaaaggcttccacgcattgcaaagttatcgtattacccattatttatggcaacaaggacgaaaagcattggcgatctatttacaaaaccaaatatccgttgcctttgatgtagatatccatcccgcagcaagaatcggttgtggcattatgttcgatcatgccacaggtattgtgataggagaaacatctgtcattgaaaatgatgtatctattttgcaaggtgtaactttagggggaacgggtaaagaaagcggcgatcgtcatcctaaaattcgagaaggtgtgatgattgggtccggagctaaagtgttaggaaatatcgaaattgggcgttacgctaaaattggtgcaaactccgtagtgttacaatccgtttcagaatacactactgtcgctggtgtgccttctcaaatagtaggcaaaaataaaggggcgaaacctgcatttgatatggaccaatactttattgatgatgcaattaacttaaatatctaa

SEQ ID NO: 7993 - protein, 265 aa, Haemophilus somnus 129PT
MSIEVWSLIRAEAAKLAENEPMLASFFHATILKHNNLGSALSYILANKLANPIMPAIALREIIEEAHQNQPQIIESAACDIRAVRQRDPAVEQYSTPLLYLKGFHALQSYRITHYLWQQGRKALAIYLQNQISVAFDVDIHPAARIGCGIMFDHATGIVIGETSVIENDVSILQGVTLGGTGKESGDRHPKIREGVMIGSGAKVLGNIEIGRYAKIGANSVVLQSVSEYTTVAGVPSQIVGKNKGAKPAFDMDQYFIDDAINLNI

SEQ ID NO: 7994 - DNA, 909 bp, Trichodesmium erythraeum IMS101
  CDS (1)..(909): transl_table=11
atgtttaatactctgttggctgatttccgaattatttttgagagagaccctgctgctcgaaactggttggaggttctcacttgctaccctggttttcaggctttagtatttcatcgcatagctcatagtttgtattttcacaaagttcctttcctacctcgtttaatttctcatatagcccggtttttaactggaattgaaattcatccaggggctgttattggtcaaggtgtgtttattgatcacggtatgggtgttgtaattggagagactgctattataggagactcttgcttgatttatcaaggagtaactcttggtggcactggtaaagaaactggtaaacgacatcctactttgggagaaaatgtagttgttggcggaggagcaaagattcttggtaatattaacattggtagtaatgttcgtattggtgctagttctgtagttttgaaagatgttcctcctaattgtacagtggtgggaataccaggtagagttgtagatcgttctggagttaaagtaaatcctttagaacatggtagtttgcctgattctgaagctaaagtcatgcgtgcattatttaatcgaattaattctcttgaggaacaagtgcagttgatcaaaattctacaatttcaagagccagaattagagtctgttgtggcaaagcctcacctcaaatcttttgctaatcattctaattatcgtctcacagatttagcattgtttaatcgaattaattatcttgaggaacaagtgaagttgatcaaaagtttacagtctcaattactagagttagactctactgtagcgaagcctcccctcaaatcttctgctaataattattctaattatgatttccaagatttagaaattcaggattttttcgatggctcaggaatctaa

SEQ ID NO: 7995 - protein, 302 aa, Trichodesmium erythraeum IMS101
MFNTLLADFRIIFERDPAARNWLEVLTCYPGFQALVFHRIAHSLYFHKVPFLPRLISHIARFLTGIEIHPGAVIGQGVFIDHGMGVVIGETAIIGDSCLIYQGVTLGGTGKETGKRHPTLGENVVVGGGAKILGNINIGSNVRIGASSVVLKDVPPNCTVVGIPGRVVDRSGVKVNPLEHGSLPDSEAKVMRALFNRINSLEEQVQLIKILQFQEPELESVVAKPHLKSFANHSNYRLTDLALFNRINYLEEQVKLIKSLQSQLLELDSTVAKPPLKSSANNYSNYDFQDLEIQDFFDGSGI

SEQ ID NO: 7996 - DNA, 867 bp, Trichodesmium erythraeum IMS101
  CDS (1)..(867): transl_table=11
atgaccaccttactgactgacaatatccgcaccttacctaatacaactcacaattctaccttgcaaaaataccaaggtaacttgaggtctcaaaacaaaccaacggtagagactgaagtttctcaagaaaatctaatatcagaatctaatagagagctttcttcctcttcttgttttcatagattttggtacaaatattttatatttcctgaaatagagacaattttaacagattttcagataattttcgagcgagacccagcagcacggaactggatagaagtcttatgttgctatccaggtttgcacgctttattattgtaccgtcttgctcataaattgcactatcacaaaatacctttaattccaagattgatttctcatttcggacgattcttcacaggaatagaaattcacccaggagcacaaattggacagggagtatttatagatcatggtatgggagtggttattggtgaaacagcaattgttggagattactcattaatttatcagggtgtcactcttggtggtacaggaaaagaaattggtaaacgccatcctactattggtacaaatgttgtagttggtgctggtgccaaagtattaggaaatatcaatattggtaataacgttcgtatcggtgctggttccattgtattgcgtcatgttccttctgactgcaccgttgttggtatacctggtagagtcgtatcaaaatctagcgaacggactgaagttctcgatcatggaaaattcccagatactgaagctaccgcaactcgtgctttagttgagaaaattcagcaacttgaagaaaaattacaaactcttataggcgagacaaggaaaaataataatgtttaa

SEQ ID NO: 7997 - protein, 288 aa, Trichodesmium erythraeum IMS101
MTTLLTDNIRTLPNTTHNSTLQKYQGNLRSQNKPTVETEVSQENLISESNRELSSSSCFHRFWYKYFIFPEIETILTDFQIIFERDPAARNWIEVLCCYPGLHALLLYRLAHKLHYHKIPLIPRLISHFGRFFTGIEIHPGAQIGQGVFIDHGMGVVIGETAIVGDYSLIYQGVTLGGTGKEIGKRHPTIGTNVVVGAGAKVLGNINIGNNVRIGAGSIVLRHVPSDCTVVGIPGRVVSKSSERTEVLDHGKFPDTEATATRALVEKIQQLEEKLQTLIGETRKNNNV

SEQ ID NO: 7998 - DNA, 747 bp, Synechococcus sp. CC9311
  CDS (1)..(747): transl_table=11
atgcttgatcaaattcgggccgactttgcaatcatccgcgaacgggatcctgcggcgcgcggacctttggagatcctgctctgctacccaggctttcaagcgatcagcttgcacaggctgagccatcggctttggcgctcccgcctacccctgaaattgccggcacgcctgcttagccagctggggagaggaatcaccggggtggaaatccacccgggagccacgattggccaaggcgtgttcattgatcacggcatgggggtggtgattggtgaaacgagcgaaattggcgatcgctgccttctttatcaaggcgtgaccctgggcggaactggcaaagacagcggcaagcgtcacccaaccctcgccaacaacgttgtggtgggagctggcgccaaggtgctgggagccattgaggtgggcgctaacaccagaattggcgctggatccgtcgttgtgcgcagtgttgagcagaactgcactgttgtaggcatccccgggcgggtcatccatcaaagcggcgtacggattaaccccctggcgcactcagctctacctgatgctgaagccaatgtgatccgaaacttgatggagcggattgatcaacttgaaaatcaggtaagcgaattgcaaagctgcctgagcgctgttgccgcaggaggaaccggagaaaccattcgcgaaataagcatgggcaaatcccaaaacctcaaggacagggaaattcttgagttcctgggagattaa

SEQ ID NO: 7999 - protein, 248 aa, Synechococcus sp. CC9311
MLDQIRADFAIIRERDPAARGPLEILLCYPGFQAISLHRLSHRLWRSRLPLKLPARLLSQLGRGITGVEIHPGATIGQGVFIDHGMGVVIGETSEIGDRCLLYQGVTLGGTGKDSGKRHPTLANNVVVGAGAKVLGAIEVGANTRIGAGSVVVRSVEQNCTVVGIPGRVIHQSGVRINPLAHSALPDAEANVIRNLMERIDQLENQVSELQSCLSAVAAGGTGETIREISMGKSQNLKDREILEFLGD

SEQ ID NO: 8000 - DNA, 843 bp, Alkalilimnicola ehrlichei MLHE-1
  CDS (1)..(843): transl_table=11
atgttcaaacggatcaaagaggacatccgctgcgtcatggatcgcgacccggcggcccgtaacgcattcgaggtgctcaccacctacccggggctgcacgccctgctgttccaccgctgtaaccactggctgtggcgcaagcggttgcgctggctggcccggtttttctccaccatcgcccgctggctcaccggcatcgaaatccacccgggtgcgcggatcgggcgccgtttctttatcgatcacggcatgggggtggtgatcggcgagaccgcggagatcggtgatgatgtgaccctctaccacggcgtgaccctggggggcaccagctgggagcagggcaagcgccacccgaccttgggcgatgacgtggtggtgggtgccggtgccaagattttgggaccgctccaggtgggcagcggggcgcgtgtgggctccaatgcggtggtgctgcgcgatgtgcccgagggtgccaccatggtcggcatcccggcgcgcatggccggggtgcgtccgcgcacggacagcgccgatgaccgacggcgggcggcggttgcccgcaagatcggcttcgatgcctatggcaccaccgatatgccggacccggtcgccaacgcggtcaacgcgatcctggaccatatccacgttaccgacgcgcgcctggagcagatgtgccgggccatccgcggcatgggcggggacgtggaggacacccgcattcccgacgtcgaggtggacgagctcgattgcggggagcctgccccggaggcgggcgagcagggtgtcgacgtcactgccggctcgggccaggtgcgcgggcgccaggaccgtaccggtagctga

SEQ ID NO: 8001 - protein, 280 aa, Alkalilimnicola ehrlichei MLHE-1
MFKRIKEDIRCVMDRDPAARNAFEVLTTYPGLHALLFHRCNHWLWRKRLRWLARFFSTIARWLTGIEIHPGARIGRRFFIDHGMGVVIGETAEIGDDVTLYHGVTLGGTSWEQGKRHPTLGDDVVVGAGAKILGPLQVGSGARVGSNAVVLRDVPEGATMVGIPARMAGVRPRTDSADDRRRAAVARKIGFDAYGTTDMPDPVANAVNAILDHIHVTDARLEQMCRAIRGMGGDVEDTRIPDVEVDELDCGEPAPEAGEQGVDVTAGSGQVRGRQDRTGS

SEQ ID NO: 8002 - DNA, 810 bp, Hyphomonas neptunium ATCC 15444
  CDS (1)..(810)
atggaaaatcctgacatcggcgccccccctccgccctggaaaaggctgcgttttgaggcgcaggcggctgcggccgaggagccaacgctggcgagctatctcaacgccgcgatcctttcgcatgccactttggggcaagcattgtcctttcatctggcggagaagctctccgggccgggcatgggcccccagcaggtgcggcacattctttcggccgtttatgacagcgcgccgggcctgatcgagtttgccgaaagcgatatgcaggccgttctggagcgtgacccggcagcacgcgggatgttgcagcctttcctgtttttcaagggcttcctggcgcttcagacgcaccggattgcacacgagctgtggcggcagggcagggagacgctggcgtttcatttccagagccgggcgtcggagcttttcgatgtggatattcacccggcagcgcggatcgggcgcgcggtaatgctggatcatgcctccggcatcacgatcggtgagacggcgattgttggcgatggctgctcgttgcttcatggggttacgctcggcggaaccggcaaggaagtgggtgatcgccaccccaagatcgggcgcggtgtgctgctttcggtgggcgcgaagatcctcggcaatatctccattggcgacgaggccaaggtggcagccggcagtgtggtgctcaaagatgttccggcgcggtgcaccgttgccggtgtgccagcaaagattgttgcgggaccggcgtgctgccagcctgcgcagagcatggatcaggcaatccccgaaacttcggcagaataa

SEQ ID NO: 8003 - protein, 269 aa, Hyphomonas neptunium ATCC 15444
MENPDIGAPPPPWKRLRFEAQAAAAEEPTLASYLNAAILSHATLGQALSFHLAEKLSGPGMGPQQVRHILSAVYDSAPGLIEFAESDMQAVLERDPAARGMLQPFLFFKGFLALQTHRIAHELWRQGRETLAFHFQSRASELFDVDIHPAARIGRAVMLDHASGITIGETAIVGDGCSLLHGVTLGGTGKEVGDRHPKIGRGVLLSVGAKILGNISIGDEAKVAAGSVVLKDVPARCTVAGVPAKIVAGPACCQPAQSMDQAIPETSAE

SEQ ID NO: 8004 - DNA, 834 bp, Rhizobium leguminosarum bv. viciae 3841
  CDS (1)..(834): transl_table=11
atggtcgcaaagactgacatccgtgcttttgagacaggccatccgctgaaggtgatggatcccatctgggacagcctgcgcgaggaagcccggctcgccgccgaacgggacccggttctcgcggccttcctctattcgaccgtgatcaactaccactcgctcgaggaatgcgtcatccaccgcatctgcgagcgtctcgatcaccccgacatgcaggcgaacctgcttcgccagaccttcgaggaaatgctcctcgactggccggactggagctccatcctgcgcgtcgatatccaggcgatctatgaccgcgatcccgcctgcctgcgcttcatggaggcggtgctttatttcaagggcttccacgcgctgcagacacatcgtctcgcccattggctgctgaaccgcggccggcgtgattttgcgctctatctgcagagccgctcctccagcgtctttcagaccgacatcaatccggccgcccgtatcggcaagggcatcttcctcgatcacgccaccggcctcgtcgtcggcgagacggccgtcatcggcgacaacgtttcgatcctgcacggcgtcacactcggaggcaccggcaaggagggcgctgaccgccatcccaagatcggctccggcgtcatgatcggcgccggcgccaagatcctcggcaatatcgagatcggctactgctcacgagtcgccgcaggctccgtcgtattgaaggcggtgccgcccaagaagacggtggcgggcgtgccggccaaggtcgtcggtgaggccggttgttccgagccgtcgcgcaacatggaccaggtgattggcgccgatatctga

SEQ ID NO: 8005 - protein, 277 aa, Rhizobium leguminosarum bv. viciae 3841
MVAKTDIRAFETGHPLKVMDPIWDSLREEARLAAERDPVLAAFLYSTVINYHSLEECVIHRICERLDHPDMQANLLRQTFEEMLLDWPDWSSILRVDIQAIYDRDPACLRFMEAVLYFKGFHALQTHRLAHWLLNRGRRDFALYLQSRSSSVFQTDINPAARIGKGIFLDHATGLVVGETAVIGDNVSILHGVTLGGTGKEGADRHPKIGSGVMIGAGAKILGNIEIGYCSRVAAGSVVLKAVPPKKTVAGVPAKVVGEAGCSEPSRNMDQVIGADI

SEQ ID NO: 8006 - DNA, 819 bp, Rhizobium leguminosarum bv. viciae 3841
  CDS (1)..(819): transl_table=11
atgtcgaaatcgaccggcctcggtttagccgggcaacagccgcagcctttgggtgatgcatccgtctggaccgtgatccgcgccgaggcgaccgagcttgccgcgcgcgagccgatattgcggcagctgcttgccgctgacgtaaccgacactgccggcaacgatgagatcatcgcccgcgtgctggccgcgcggctctccgtagcgcaggtggaaacgagtgatctgttcgatctcatcctgtccgcacttgatgacgatatcatgcgcaaggtcgaggcggatctcatcgccgtgcgcgagcgcgatccggcctgcacgacatttctgcacgcgcttctcaatctgaagggctttcatgcccttgagacgcatcgcatcgcccatgcgctctggatcgccggccgtccggagatcgccagttggctcgccaatctcgtttcgctggtcttcggccctgatatccatccggcggcacggatcggcgcatccatcatgctcgaccacggttcgggcatcgtcatcggcgaaacggctgtcatcgaggatgaagtgtctatcctgcagaacgtcacgctcggcggcaccggcaaggagaccggcgaccgccacccgaagatccgccacggcgtgatgatcggcgccggcgccaagatcctcggcaatatcgaaatcggcgccttcagcaaggtcgccgccggcagcgtcgtgctcaagtcggttcccacgcattgcacggtcgccggcgtgccggcaacggtcgtgcgcatccaccgcgccgacgaaatcccggccgagacgatggatcagaatatctag

SEQ ID NO: 8007 - protein, 272 aa, Rhizobium leguminosarum bv. viciae 3841
MSKSTGLGLAGQQPQPLGDASVWTVIRAEATELAAREPILRQLLAADVTDTAGNDEIIARVLAARLSVAQVETSDLFDLILSALDDDIMRKVEADLIAVRERDPACTTFLHALLNLKGFHALETHRIAHALWIAGRPEIASWLANLVSLVFGPDIHPAARIGASIMLDHGSGIVIGETAVIEDEVSILQNVTLGGTGKETGDRHPKIRHGVMIGAGAKILGNIEIGAFSKVAAGSVVLKSVPTHCTVAGVPATVVRIHRADEIPAETMDQNI

SEQ ID NO: 8008 - DNA, 777 bp, Pseudomonas aeruginosa UCBPP-PA14
  CDS (1)..(777): transl_table=11
atgttcgaacgtgtgcgtgaagatatccaaagcgtattccaccgtgatccggcggctcgcaacgcactcgaggtcctcacctgttatccgggcctgcacgccgtctggctgcatcggctggcccacggcttgtggacgtccggctggaagtggctggcgcgcctggtgtccaatttcggccgctggatgaccggcatcgagatccacccgggggccaggatcggccggcgcttcttcatcgaccacggcatgggcatcgtcatcggcgaaaccgccgagatcggcgacgacgtcaccctctaccagggcgtcaccctgggcggtaccacctggaacaagggcaagcgccaccccaccctcggcaacaacgtggtggtcggtgccggtgccaaggtgctcggcccgttcaccgtcggcgagggcgccaaggtcggctccaatgccgtggtgaccaaggaagtcccgccgggtgccaccgtggtcggcattcccgggcggatcatcatgcgcgaggataccgagcagcaggccaagcgccaggcgatggcggagaaactcggcttcgatgcctacggagtcagtcaggacatgccggacccggtggcgcgtgccattggtcagttgctcgatcacctgcaggccgtcgacggccggctcgagggcatgtgccaggcgctcaccgccctggggagcgactactgcgcgaaggatctgccggtattgcgcgaggaggatttcgccggggtcaaggacgaggatggcaatccggccgcgtaa

SEQ ID NO: 8009 - protein, 258 aa, Pseudomonas aeruginosa UCBPP-PA14
MFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDTEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 8010 - DNA, 879 bp, Pseudomonas aeruginosa UCBPP-PA14
  CDS (1)..(879): transl_table=11
ctggcaggcaggaccatcaggaaccgccagaatcatgctgaaaaccccgttatcgtccgaccggcagcctgccgaacagcagcaaagggtatctgtatgaggaacagtcccgcagaggcgctggccgcggcttgcaccccgacagcgtcagtcaggtgcgtctggcaacagcttcaggcggaggccaggcgcgcgccgcaggaagactctgtattggggccgctcatcgatagatccattctctgccgcagctcattctggcaggcgctgtcctccctgctgagcgctaagctgtccatccaaacggtgtccatggacatatggctggagtgctttgccgatgctcatggaccggaggccgaggaggcggcgaaagacgacttggccgcgaccctccttcgggatccggcagcggagaacctgttggtgccctttctctgctacaagggcttccacgcactgcagtgccaccgggttgcccaccagctatggaacgcccgcagaaggacactcgcgcgtctgttgcagagccgggtttctgaagtcttcggtgtggatatccatcctgccgttccggtggggcggcgcgtcttcatagatcacgcaacaggaatcgtcatcggcgagactgccagcatcggtaacgacgtctcgattctccagaaagttactctgggtggaaccggcaaggagtatggggaccgccatccgaagatacgggaccgagccttcattgcagcaggcgcgacgatactgggcaacattgaaatcggctttgcctccaccgtcggcgctggaagcgtcgtgcttgagccggttccgccttactccacggtcgttggcgtacctgctcgcattctttgcacgaatggactttga

SEQ ID NO: 8011 - protein, 292 aa, Pseudomonas aeruginosa UCBPP-PA14
MAGRTIRNRQNHAENPVIVRPAACRTAAKGICMRNSPAEALAAACTPTASVRCVWQQLQAEARRAPQEDSVLGPLIDRSILCRSSFWQALSSLLSAKLSIQTVSMDIWLECFADAHGPEAEEAAKDDLAATLLRDPAAENLLVPFLCYKGFHALQCHRVAHQLWNARRRTLARLLQSRVSEVFGVDIHPAVPVGRRVFIDHATGIVIGETASIGNDVSILQKVTLGGTGKEYGDRHPKIRDRAFIAAGATILGNIEIGFASTVGAGSVVLEPVPPYSTVVGVPARILCTNGL

SEQ ID NO: 8012 - DNA, 498 bp, Oenococcus oeni PSU-1
  CDS (1)..(498): transl_table=11
atgtttactgccgctaaatttattcagcaacacgatccggctgctcctggtatttgggaaattttgttaacctattccggctttcatgccgtcggtttttatcggattgcccattatttttggcagcacaaacatcgtttactcgcgatgttgatttctcactggggcaaaaaagcaaccggtgttgaaattcatcctgccgcagtaattggcaaaaacctttttatcgatcatggattgggtgtagtgattggtgaaacagctgtaattggtaaccaggttacaattttacaaaatgtaactcttggctcgcggcggccaatacctggtttgcgtcatcctcacattgccgataatgtttttattggtgccaacgctcaaattttgggagctgttaaaattggcaagtacgcaaaaatcggggctggaagcgtcgttttgaataacgtgccggcccatcgaacgatcgtcggtaatcccggtagattagtcgactaa

SEQ ID NO: 8013 - protein, 165 aa, Oenococcus oeni PSU-1
MFTAAKFIQQHDPAAPGIWEILLTYSGFHAVGFYRIAHYFWQHKHRLLAMLISHWGKKATGVEIHPAAVIGKNLFIDHGLGVVIGETAVIGNQVTILQNVTLGSRRPIPGLRHPHIADNVFIGANAQILGAVKIGKYAKIGAGSVVLNNVPAHRTIVGNPGRLVD

SEQ ID NO: 8014 - DNA, 504 bp, Leuconostoc mesenteroides subsp. mesenteroides ATCC 8293
  CDS (1)..(504): transl_table=11
atgatcagaaattacgatcccgccatttcttctaatttgcaaattattttaacttattctggtttgcatgccgtttggttttatcgcattagtcatcagttgtggcaactcaatttgaagcttcttgcgcatctatgttcgcaatggggacgtttaatcacgggagtcgagatacatcctggcgcgcaaattgggagacgtctgttaattgaccatggttctggaactgtgattggtgaaacagcaattattggtgatgatgttattttatatcatggtgtaactctaggcagcacccatcatgcacttggagatacaagtcgccggcacccaaaaatcggcaatcacacattgattggtgcccatgctactattttgggaaatattacaattggaaatcatgtgaagattggagctgcaacagtggtcttacatgatgttccaagccacgtgactatcgttggtaatcctgcgcatatattgcacaaaaatccgaatatctaa

SEQ ID NO: 8015 - protein, 167 aa, Leuconostoc mesenteroides subsp. mesenteroides ATCC 8293
MIRNYDPAISSNLQIILTYSGLHAVWFYRISHQLWQLNLKLLAHLCSQWGRLITGVEIHPGAQIGRRLLIDHGSGTVIGETAIIGDDVILYHGVTLGSTHHALGDTSRRHPKIGNHTLIGAHATILGNITIGNHVKIGAATVVLHDVPSHVTIVGNPAHILHKNPNI

SEQ ID NO: 8016 - DNA, 495 bp, Leuconostoc mesenteroides subsp. mesenteroides ATCC 8293
  CDS (1)..(495): transl_table=11
atgttttttactgctaaatcaattctaaagcgcgacccagccgcaaaaagccttatgatggtgattttaacttaccctgggttacatgcactgtggtttcatcgcgttgctcattggcttcatattcatcaccgttatttgctcgctgccatcatttctcgttggtcagccaaacgaactgatatatttattgcccccggtgcacaaattggtcgtggcgtatttattgatcacggtgtaggtgttgttattggtgaaactgcaattattgacgatggtgtaaccatattacatggtgtcactctgggtgctcgtcatgcggtgacagaacgtagacaccctcatatcgagagctacagcttcattggtgctcatgcgcaaatattgggcaatattactattggtgcaaatagtaaagttggtgctaatgctgtggttttaaacgatgttcccgcctattctactgctgtgggtaatcctgcacgcctagtctag

SEQ ID NO: 8017 - protein, 164 aa, Leuconostoc mesenteroides subsp. mesenteroides ATCC 8293
MFFTAKSILKRDPAAKSLMMVILTYPGLHALWFHRVAHWLHIHHRYLLAAIISRWSAKRTDIFIAPGAQIGRGVFIDHGVGVVIGETAIIDDGVTILHGVTLGARHAVTERRHPHIESYSFIGAHAQILGNITIGANSKVGANAVVLNDVPAYSTAVGNPARLV

SEQ ID NO: 8018 - DNA, 657 bp, Solibacter usitatus Ellin6076
  CDS (1)..(657): transl_table=11
atgttccgcgccatcagggagcagatcgacacgatcttccgggaagatccggccgcgaagagtgtgctcgagatcgtcctgtgttacccgggatttcaggcgatcctgctgcatcgggtggcgcacagactttacggctggggatggccgctcctcccgcgcgtgatctcgcagttcagccgctttttcacagggatcgaaatccacccgggcgcgaccatcggccgccgcttcttcatcgatcacggcagcggcgtagtcatcggcgaaactaccgaaatcggcgacgacgtgctgctctatcagggcgtgactttgggcggtaccggaaacgagaagggcaaacgccatccgactatcggcaacagcgtggtggtgggaaccggcgccaagattctgggcaacatccggatcggcgataacgtgaaggtgggcgcaggttcggtggtggtgcatcccgtccccgacaattccaccgtggtcgggattcccggccgcgtggtgcgcatccggcccgagggcggcacactcgaacatgggcgcctccccgatcccgaaggacaggcgatcgacgacctggcgcgccgggtggcggagttggaaagcatgctgcgcaagatgatcgccgagcacgaagtagagcaccaccggcaataa

SEQ ID NO: 8019 - protein, 218 aa, Solibacter usitatus Ellin6076
MFRAIREQIDTIFREDPAAKSVLEIVLCYPGFQAILLHRVAHRLYGWGWPLLPRVISQFSRFFTGIEIHPGATIGRRFFIDHGSGVVIGETTEIGDDVLLYQGVTLGGTGNEKGKRHPTIGNSVVVGTGAKILGNIRIGDNVKVGAGSVVVHPVPDNSTVVGIPGRVVRIRPEGGTLEHGRLPDPEGQAIDDLARRVAELESMLRKMIAEHEVEHHRQ

SEQ ID NO: 8020 - DNA, 714 bp, Magnetococcus sp. MC-1
  CDS (1)..(714): transl_table=11
atgtttaaaaccatacgtgacgacatcgctgtaatctttgaccgtgacccggctgctcgcaatgtcttagagatcgtgctctgttaccctggcgtacacgccatgattgcttatcgcttttcccataaattatggcaatggaattttaaactggccgcacgttttatctcccatgtggggcgggtgttgaccggtattgagatccaccctggggccaaaattggtaaaggcttttttattgatcatggcatgggtgtggtcattggcgaaacctgtgagatcggcgataactgcaccctctatcacggcgtaaccctgggggggaccacttggaacaaaggtaaacgccatcccacccttaaagatggggtggtggtgggggccggggccaaggtattggggccgatcaccttacatgaaggggcacgggtaggttccaacgcggtggtggttaaagatgtcccgcacgataccaccgtggtgggtatcccggggcgcgaggtgcgggcgaaaaaagagttaagccccgatcaagcccatgctttcccctcttacggggtagaggggcagatgcctgacccggtcgccaaagcggtaacctgtgtgctggagcagatgcaccaaatggagcgccgtctgcacacactagaagaagaaaaacgggcactcgtggcccaggaaaccgaacagcaacccgataaaaagcgggcctga

SEQ ID NO: 8021 - protein, 237 aa, Magnetococcus sp. MC-1
MFKTIRDDIAVIFDRDPAARNVLEIVLCYPGVHAMIAYRFSHKLWQWNFKLAARFISHVGRVLTGIEIHPGAKIGKGFFIDHGMGVVIGETCEIGDNCTLYHGVTLGGTTWNKGKRHPTLKDGVVVGAGAKVLGPITLHEGARVGSNAVVVKDVPHDTTVVGIPGREVRAKKELSPDQAHAFPSYGVEGQMPDPVAKAVTCVLEQMHQMERRLHTLEEEKRALVAQETEQQPDKKRA

SEQ ID NO: 8022 - DNA, 609 bp, Nocardioides sp. JS614
  CDS (1)..(609): transl_table=11
atgagcatcccgagcctcgtcacctcggcgctcgtcgcgccgacgccgggcccggtgcggtggcggcaccggctgcgcgaggacctgcgcgccgctcgcgagcgtgatcccgccgcgcggtccacaccggagctggtgctcgcctacccgggtctgcatgcggtctggctgcaccggctcgcccaccggctgtggcaccggcccggtggccggctggccgcccggctggtctcgcacgccggccgggcgctgaccgggatcgagatccacccgggtgccgagatcggccgccggctgttcatcgaccacggcatgggggtggtgatcggcgagaccgcggtggtcggcgacgacgtgctgctctaccacggggtcacgctcggcagccggtcgacggcaccgggccgccggcacccggtggtcggcgacggcgtggtgatcggcgcgggcgcccgggtcctgggcccggtcgtcgtcggtgccggcgcccgggtaggggcgaactcggtggtggtccgtgacgtcgccccgggcagcaccgtgctcggcatccccgcccgcgtgcccgacgcccagctcgatgacatcgacccggccctgctgatctga

SEQ ID NO: 8023 - protein, 202 aa, Nocardioides sp. JS614
MSIPSLVTSALVAPTPGPVRWRHRLREDLRAARERDPAARSTPELVLAYPGLHAVWLHRLAHRLWHRPGGRLAARLVSHAGRALTGIEIHPGAEIGRRLFIDHGMGVVIGETAVVGDDVLLYHGVTLGSRSTAPGRRHPVVGDGVVIGAGARVLGPVVVGAGARVGANSVVVRDVAPGSTVLGIPARVPDAQLDDIDPALLI

SEQ ID NO: 8024 - DNA, 963 bp, Azoarcus sp. BH72
  CDS (1)..(963): transl_table=11
atgagcgcgagcacgggtgcggtggaggccgcttacgaggacgtaggtggctggggcgtgagccaggtggtggccgaattgcgcgccgcgcgcgagcgctggcgcgcggcgcaacaacgcaaccgcgagttcgcagtgcgcgagttcccgtcgcgcgatgcgctgcgccagatcgccgccgacctgtgcggggtgctgttcccgatgcggctggggccgcccgagctgcaccaggaaggcgaggactactacgttggccacacgctggatagcacgctgaatgcgctcttccaccaggtccggctggaactcggctacctcgcgcgccatcgcggtatcgaggcggacatcgacgccgacgccgcgcgcatcgtgaagcgctttgccggcggcctgccggcgctgcgcaccctgctcgacagcgacgtggaggccgcctataccggcgatcccgccgcgcgcagcgtggacgaagtgctgctgtgctatccgggcacgctcgccatcatccaccatcgcctcgcgcacagcctgcacgcgctgggtgcgcgtctggtggcccgcatcatcgccgagatcgcccactcggcgaccggcatcgacatccatcccggcgcgcagatcggttcgggctttttcatcgaccacggcacgggcgtcgtgatcggcgaaaccacggtcatcggcaaccgggtgcggctgtaccaggcggtcacgctgggtgcgcggcgctttgcggtcgatgagaacggtgcgctggagaagggcgccgcgcgccatccggtgctggaggacgatgtggtggtctatgccggcgccaccatcctcggccgcgtcaccatcgggcgcggttccagcatcggcggcaatgtgtggctgacgcgcagcgtgccgcccggcagccacgtgtcgcaggccagcctgcagcacgagtcggccgcgcagcgggtggccgcatcgtga

SEQ ID NO: 8025 - protein, 320 aa, Azoarcus sp. BH72
MSASTGAVEAAYEDVGGWGVSQVVAELRAARERWRAAQQRNREFAVREFPSRDALRQIAADLCGVLFPMRLGPPELHQEGEDYYVGHTLDSTLNALFHQVRLELGYLARHRGIEADIDADAARIVKRFAGGLPALRTLLDSDVEAAYTGDPAARSVDEVLLCYPGTLAIIHHRLAHSLHALGARLVARIIAEIAHSATGIDIHPGAQIGSGFFIDHGTGVVIGETTVIGNRVRLYQAVTLGARRFAVDENGALEKGAARHPVLEDDVVVYAGATILGRVTIGRGSSIGGNVWLTRSVPPGSHVSQASLQHESAAQRVAAS

SEQ ID NO: 8026 - DNA, 849 bp, Azoarcus sp. BH72
  CDS (1)..(849): transl_table=11
atgaagaccgaatcgatgagcatgaccaaccccgtccgcggccccggcctgttcgcgctgctgcgcgaagacgtgcgttgcgtgttcggccgcgacccggccgcccgcaccgtgtgggaagtcctgaccacctaccccggcgtgcatgcggtgatgtcccaccgcatcgcccacgcgctgtggcgtcgcggctggcgctacccggggcggctggtgagcttcctggcgcgggtgttcaccaatgtggacatccaccccggcgcccagatcggccgccgcttcttcatcgaccacggcgccggcgtggtggtcggcgaaaccgccgagatcggcgacgacgtcacgctgtaccacggcgtcaccctcggcggcaccacctggaacccgggcaagcgccatcccacgctgggcgaccacgtggtggtcggcgccggcgccaagatcctcggcgccatcaccatcggcagccgcgtgcgcgtgggtgccaactcggtggtggtgaagaacgtgccggccgaccgcaccgtggtcggcatcccggcaaaggtggtcaagcgcgaatcgcccatcctgtcggcgaccgacgagctgaacctggaccaccacgtgatgcccgaccccgtcggccacacgctcaactgcctgctcgaccgcatcaagatgctggagagcgagctggccacgctgcaggccgaaggcaaggccgcgctggcggcggcgagcgcgccgcccaagccggtgcagaccgtgttcccgctgatcaacgccaacccgctcgattgccaggccaacaccgacgccgcctgtccggaatgcgcctgtcagcccgaagcccaggaggcccgctga

SEQ ID NO: 8027 - protein, 282 aa, Azoarcus sp. BH72
MKTESMSMTNPVRGPGLFALLREDVRCVFGRDPAARTVWEVLTTYPGVHAVMSHRIAHALWRRGWRYPGRLVSFLARVFTNVDIHPGAQIGRRFFIDHGAGVVVGETAEIGDDVTLYHGVTLGGTTWNPGKRHPTLGDHVVVGAGAKILGAITIGSRVRVGANSVVVKNVPADRTVVGIPAKVVKRESPILSATDELNLDHHVMPDPVGHTLNCLLDRIKMLESELATLQAEGKAALAAASAPPKPVQTVFPLINANPLDCQANTDAACPECACQPEAQEAR

SEQ ID NO: 8028 - DNA, 756 bp, Azoarcus sp. BH72
  CDS (1)..(756): transl_table=11
atgttcagccacctccgtgaagacctggccagcgttcgcgagcgcgatcccgcagcccgatcgacatgggaagtgctgacctgttatcccggcgtgcacgcgttgatgttccatcgcgtggcgcacgccgcgtggacgcgcaagctgttctggctgggacgcttcatcagccatgtcagccgcttcctcaccggcatcgaaatccatccgggcgccacgatcgggcgccgggtcttcatcgaccacggcatgggcgtggtgatcggggaaacggcggagatcggtgacgactgcacgatctaccaggctgtcaccctcggcggcacctcgctctatcgcggcaccaagcgccatccaacgctgggcaagggggtggtggtgggtgcgggcgccaaggttctgggcggtttcacggtcggcgatggagccaagatcggctccaacgcggtggtcgtcaaaccggtgccggcgggggccaccgcggtgggcaatcccgcgcgcgtactggattcggagcgcgacagcgtccgcgcccagaaggccgagcagatgggcttttccgcctacggcgtcacgcgggacatggacgatccgctctccaaggcgctgcacggactgctcgaccatgcggtcgagaccgatcgccgcctccagtgcctgctggaccggctcgccgccgccggcatcaacctcgaccgcgcgaccgaacagaacgacgatttcgacgcgggacggctctcgcgcatggtcgattga

SEQ ID NO: 8029 - protein, 251 aa, Azoarcus sp. BH72
MFSHLREDLASVRERDPAARSTWEVLTCYPGVHALMFHRVAHAAWTRKLFWLGRFISHVSRFLTGIEIHPGATIGRRVFIDHGMGVVIGETAEIGDDCTIYQAVTLGGTSLYRGTKRHPTLGKGVVVGAGAKVLGGFTVGDGAKIGSNAVVVKPVPAGATAVGNPARVLDSERDSVRAQKAEQMGFSAYGVTRDMDDPLSKALHGLLDHAVETDRRLQCLLDRLAAAGINLDRATEQNDDFDAGRLSRMVD

SEQ ID NO: 8030 - DNA, 792 bp, Acidovorax sp. JS42
  CDS (1)..(792): transl_table=11
atgcttgcccgcctgcgatccgacgtccagtgcatcctcgaacgcgacccggctgcgcgcagcacctgggaggtcattacctgctatcccggcctgcacgccatctggctgcaccggccggcgcactggtgctggacgaacggtttcaagtggctggggcgcttcatctcgcactttgcgcgctggttcacgggcatcgagatccacccgggcgccaagatcggcgagcgggttttcttcgaccacgccatgggggtggtggtgggcgagaccgccgagatcggcgacggctgcaccatataccagggcgtgacgctgggcggaacctcgctctacaagggcaccaagcgccatcccacgctgggcaagaacgtggtggtgagcgcgggggccaaggtgctgggcggcttcgaggtgggcgatggggccaagatcggcagcaacgccgtggtcatcaagccggtgccggcgggtgcgacggccgtgggcatccccgcgcgcatcattccgtccaaggaaggccagagcgccgacgtgaccgagccgcacaagcccgaggaggccaagttcagcgcctacggcgtgacctccctgcaggacgacccgctgacccaggccatgcgcggcctgatcgattccgccgccacgcaggagcaccagatctcactgctgtggcaggccattgaaaagctctccaggtccaccccgcaaagcggcggctgcgtacccgacgaggccgtgcgctgcgagcaattccaggcggccaagctcaacgacatcattggcaagtaa

SEQ ID NO: 8031 - protein, 263 aa, Acidovorax sp. JS42
MLARLRSDVQCILERDPAARSTWEVITCYPGLHAIWLHRPAHWCWTNGFKWLGRFISHFARWFTGIEIHPGAKIGERVFFDHAMGVVVGETAEIGDGCTIYQGVTLGGTSLYKGTKRHPTLGKNVVVSAGAKVLGGFEVGDGAKIGSNAVVIKPVPAGATAVGIPARIIPSKEGQSADVTEPHKPEEAKFSAYGVTSLQDDPLTQAMRGLIDSAATQEHQISLLWQAIEKLSRSTPQSGGCVPDEAVRCEQFQAAKLNDIIGK

SEQ ID NO: 8032 - DNA, 861 bp, Magnetospirillum magnetotacticum MS-1
  CDS (1)..(861): transl_table=11
atgtccgccagcccgtcgctcagcccggcctccgggcgcgaggtgatcgccggcatcgtcgacccgctctggacgcgcgtgcgcaccgaggcggaaacggtgctgcgcgacgagccgcaactcgcctcgttcttcgtcgctacgatcctcaaccatccgactctggaagcggcggtatcccaccgggtcgccgcccgcctcgggcacggatcgctgccgacggaactcgtcgcccacggctttcacgaggcgttgcaggacgatccccgcatcggccagagcatgcgcgccgacatcctggcggtgatggaccgcgacccggcgacgacgcgggcgatcgaaccgctgctctatttcaagggcttccacgccctccaggcacaccgtctggcccattggtactggggccagggccggcgtgacctcgccctctacctccagagccggtcctcggaagtgttccagaccgacatccatccggcggcccggatcgggcgcggcgtgttcctcgatcacgccaccggtgtcgtggtcggctccactgcggtgatcgaggacgacgtctcgatcctgcaagcggtgacgctcggcggcaccggcaagcatggcggcgaccgccatcccaagatccgccgcggcgtgatgatcggtgcgggcgccaagatcctcggcaatatcgaggtcggggcctgcgcccgggtcgcggcgggctctgtcgtgcttcggccggtgccgccgcacaccaccgtcgtcggggtgccggcccgcgtcgtcggcgctgccggctgcgccgagcccgcccgctcgatggatcaactcgtggcgatgagcgagttcgtcgacatcgccggcggcatctga

SEQ ID NO: 8033 - protein, 286 aa, Magnetospirillum magnetotacticum MS-1
MSASPSLSPASGREVIAGIVDPLWTRVRTEAETVLRDEPQLASFFVATILNHPTLEAAVSHRVAARLGHGSLPTELVAHGFHEALQDDPRIGQSMRADILAVMDRDPATTRAIEPLLYFKGFHALQAHRLAHWYWGQGRRDLALYLQSRSSEVFQTDIHPAARIGRGVFLDHATGVVVGSTAVIEDDVSILQAVTLGGTGKHGGDRHPKIRRGVMIGAGAKILGNIEVGACARVAAGSVVLRPVPPHTTVVGVPARVVGAAGCAEPARSMDQLVAMSEFVDIAGGI

SEQ ID NO: 8034 - DNA, 729 bp, Nostoc punctiforme PCC 73102
  CDS (1)..(729): transl_table=11
atgctactaactgatttgcgaaccatttttgagcgtgacccagcagcgcgtaactggctagaagtattgttctgttaccctggactccaagccctagtgtttcatcgattagcacactggctgtataaaattgggattcccttcatacctcggtttatctctcatattagtcggtttttaactgggattgaaatccatcctggggcattaattggacagggagtgtttattgaccacggcatgggagttgtgattggtgaaactgcgatcgtgggcgactatgccctgatttatcaaggtgtcacccttggcgggactgggaaagaaagcggcaaacgccatccaactttaggctctcatgtggttgtgggagcgggtgcaaaagtattgggaaatattcaaattggcgatcgcgtccgtattggagctggttctgtggtgttacgagatgtacccagtaacacaactgtagtcgggattccagggcgcgtaactcgtcagaacaacttgtctaccaatattctggatcatgataaagtgcgcgacgtagaagctgaagtcatccgcgctttatttgaacgtgtcaaggctctagaaaaacagtttgaggagttgcaagatcaatcaagtttctctgcaactgagcttggcgacgaacaaacatacaaccctaagagcaataagtctgatgggatgattgaagattttcttgatggtgcgggaatttaa

SEQ ID NO: 8035 - protein, 242 aa, Nostoc punctiforme PCC 73102
MLLTDLRTIFERDPAARNWLEVLFCYPGLQALVFHRLAHWLYKIGIPFIPRFISHISRFLTGIEIHPGALIGQGVFIDHGMGVVIGETAIVGDYALIYQGVTLGGTGKESGKRHPTLGSHVVVGAGAKVLGNIQIGDRVRIGAGSVVLRDVPSNTTVVGIPGRVTRQNNLSTNILDHDKVRDVEAEVIRALFERVKALEKQFEELQDQSSFSATELGDEQTYNPKSNKSDGMIEDFLDGAGI

SEQ ID NO: 8036 - DNA, 741 bp, Nostoc punctiforme PCC 73102
  CDS (1)..(741): transl_table=11
atgcaacagtctttagacagtattagcgatccccccagtaccaaaacgcaggattctgcacataaatccatgctgaaaaatttactctctggcgttttttttgagccattattgagtgattttcgcattatctttgagcgcgatcccgcagcacgtaattggttagaggtggtgttttgctatcccggattgcacgcactctgtttgcatcgtcttgctcactggttacatggtcgaggagtgggttttatccctcgtttcatttcccatttggggagatttttgacgggaattgaaattcacccaggtgcagagattggccagggcgtgtttatcgaccacggaatgggtgttgtcattggcgaaactgcgatcgtgggcgactacacactgatttaccagggcgttacccttggcggaactggtaaagaaactggtaagcgtcatcccacagtgggcaaaaatgcagtgatcggggcgggtgcgaaagttttaggtaatctgcaaattggcgatcgcgtccgcattggtgcaggttcgattgtcttgcggaatatacccaacgattgcacagttgtgggaattcccggtcgaattatttcccgaaatgaaaacgccagcctttctcctttagaacatggaaagctacccgatatggaagcaaccgtgattcgttctttgctctcgcgcgttgagcaactcgaaaaacaactgcaaactctaggcgttaagagtcattag

SEQ ID NO: 8037 - protein, 246 aa, Nostoc punctiforme PCC 73102
MQQSLDSISDPPSTKTQDSAHKSMLKNLLSGVFFEPLLSDFRIIFERDPAARNWLEVVFCYPGLHALCLHRLAHWLHGRGVGFIPRFISHLGRFLTGIEIHPGAEIGQGVFIDHGMGVVIGETAIVGDYTLIYQGVTLGGTGKETGKRHPTVGKNAVIGAGAKVLGNLQIGDRVRIGAGSIVLRNIPNDCTVVGIPGRIISRNENASLSPLEHGKLPDMEATVIRSLLSRVEQLEKQLQTLGVKSH

SEQ ID NO: 8038 - DNA, 804 bp, Haemophilus influenzae R2846
  CDS (1)..(804): transl_table=11
atgacattagatgtgtggcaacatattcgccaagaagccaaagaacttgctgaaaacgaacctatgcttgctagtttttttcactctacaattttaaagcatcaaaatctgggcggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcctgctgtggagttatggtctactccattgctttatttaaaaggtttccatgcgattcaaagttatcgaatcacccattatttatggaatcaaaatcgtaaatcccttgccctttatttacaaaaccaaatttcagtagctttcgatgtagatattcacccagcggcgaaaattggccacggaatcatgttcgaccatgcaacaggtattgttgtgggtgaaacatctgtaatcgaaaatgatgtttcaattttgcaaggcgtaacacttggcggtacgggaaaagaatcaggcgatcgtcatcccaaagtacgcgagggtgttatgattggggcgggtgcaaaaattctcggtaatattgaagtaggtaaatacgccaaaattggggcaaactctgttgtgcttaaccctgtgccggaatatgccacagcggctggcgtgccagctcgaattgtaagtcaagataaagcagcaaaacctgcttttgatatgaaccaatattttatcggcattgatgatgacatgaatttgaatatttaa

SEQ ID NO: 8039 - protein, 267 aa, Haemophilus influenzae R2846
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDDMNLNI

SEQ ID NO: 8040 - DNA, 750 bp, Crocosphaera watsonii WH 8501
  CDS (1)..(750): transl_table=11
atgattgccgattttcgtgttatctttgagcgtgaccctgctgcccgcaattggctggaggttcttttctgctaccctgggttacaagcaattatgcttcatcgtgttgcccatagtctttataaacaaggaatgccattcttgcctcgtttaatctcccatctggcaaggttttttactggtattgaaattcatccaggggcccaaataggtactggtgtatttatcgaccacggcatgggtgtggtcatcggtgaaactgccgaagttggtgactatagtttaatctatcagggtgtcactcttgggggaactggcaaagaaagcggtaaacgtcatcctacccttggtaaaaacgtggtagtaggcgcaggggctaaagtcctcggcaaccttaatataggtaatagtgtgagaattggagcaggttctgtagtattacgggacgttccctctgactgtaccgttgtgggaattccagggcgcataatttatcaatccggggtcaaagtcaaccccctagaacatggcaacttacctgattccgaagcgaaggtaattcggttattactcgacagaattgaagctttggaaaaacaggttgaagcattacaagaagataagttaaaacaacgagaattagtggttagtggtatatctaagctaacagctagttctgatcatgatgaatctcatagttgttatataaaagataaagaaatcgaggaatttctcggcggtaccatgtga

SEQ ID NO: 8041 - protein, 249 aa, Crocosphaera watsonii WH 8501
MIADFRVIFERDPAARNWLEVLFCYPGLQAIMLHRVAHSLYKQGMPFLPRLISHLARFFTGIEIHPGAQIGTGVFIDHGMGVVIGETAEVGDYSLIYQGVTLGGTGKESGKRHPTLGKNVVVGAGAKVLGNLNIGNSVRIGAGSVVLRDVPSDCTVVGIPGRIIYQSGVKVNPLEHGNLPDSEAKVIRLLLDRIEALEKQVEALQEDKLKQRELVVSGISKLTASSDHDESHSCYIKDKEIEEFLGGTM

SEQ ID NO: 8042 - DNA, 702 bp, Exiguobacterium sibiricum 255-15
  CDS (1)..(702)
atggagaggagaacaaacatgacacggatgcgtgaagatatccgcaatgtatttaaacaggatccggcagcccggagtacgatagaagtcgtcttgacttatccggggttacacgctgtctggatgcaccggttagcccaccgtatgtggaaaatgaatctgcatctcgccgcccgaatgctatcgcaattcagtcggttcctgacaggaatcgaaattcatcccggtgcgacgatcggacgtcgtttcttcattgatcacggtatgggcgtcgtcatcggcgaaacagcgattatcggcgacgatgtcacgttgttccaaggtgtgacactcgggggaacagggaaagaaacgggcaaacggcatccgacactcggaaatggtgtcctcgtatccgccggagcacgcgtactcggtgatatcacgattggtgattcgtcgaagattggtgcaagctccgtcgttttaaaagacgtaccgtccaatgcgaccgttgtcggtattcccggacgtgtcgtgatacaggacggtatcaaggtcgatgcaccgcttgatcatcaattacccgatccggttcgtgaatgccaggaacgggttgaactggaacttgaacaattaaaatatgagattgaacgaataaaaggaggacaccgccatgatacaactttacaacagcatgaccggaaaaaaggaaccgtttaa

SEQ ID NO: 8043 - protein, 233 aa, Exiguobacterium sibiricum 255-15
MERRTNMTRMREDIRNVFKQDPAARSTIEVVLTYPGLHAVWMHRLAHRMWKMNLHLAARMLSQFSRFLTGIEIHPGATIGRRFFIDHGMGVVIGETAIIGDDVTLFQGVTLGGTGKETGKRHPTLGNGVLVSAGARVLGDITIGDSSKIGASSVVLKDVPSNATVVGIPGRVVIQDGIKVDAPLDHQLPDPVRECQERVELELEQLKYEIERIKGGHRHDTTLQQHDRKKGTV

SEQ ID NO: 8044 - DNA, 795 bp, Prosthecochloris aestuarii DSM 271
  CDS (1)..(795): transl_table=11
atggcagcagaggaaatttgggatagaatatgtgctgaggctttgcgcgaggggcagcgggagccttatatgcgaaattttctggagcagcatatcctgcgcttcgatcgctttgtggatgctctttcgatgcttctgtctgtcaagctggcatctaaacattttcctccccaggtcctgcaggagctgttcgatgatttctattcccgcagccctgaggatctcgacaatgccgtagccgatcttacagcaacgcttcagcgagatcctgcggcggtgaattatttcgagattatgctttttctgaagggctatcaggcgttgcagtcttatcggttgtcgcactggctgtggaaccatgatcgcaaatcgatggcgtatctcctgcagaacaggatgtctgaagtctatgctgtcgatatccatcctgcagcgcggatcggcaagggtattctgcttgatcatgcgaccagtctggtgatcggtgaaaccgctgttgtcgaggataatgtatcgatcctgcatgaagtgacgcttggcggtacgggtaaggagagcggtgatcgtcatccgaaagtgaggaaatcggttctgatcggggcaggagcgaagattctcggtaatgtggagatcggggagggggcaaaggtcggcgctggcagtgtggtgcttgagaatgtgccacctcattacacggttgccggtgttccggcccagattgtcggtcgtaccgaggttgccgagccgtcgctcgatatgaaccagcgactgcagaacagtcgccggctcgaatga

SEQ ID NO: 8045 - protein, 264 aa, Prosthecochloris aestuarii DSM 271
MAAEEIWDRICAEALREGQREPYMRNFLEQHILRFDRFVDALSMLLSVKLASKHFPPQVLQELFDDFYSRSPEDLDNAVADLTATLQRDPAAVNYFEIMLFLKGYQALQSYRLSHWLWNHDRKSMAYLLQNRMSEVYAVDIHPAARIGKGILLDHATSLVIGETAVVEDNVSILHEVTLGGTGKESGDRHPKVRKSVLIGAGAKILGNVEIGEGAKVGAGSVVLENVPPHYTVAGVPAQIVGRTEVAEPSLDMNQRLQNSRRLE

SEQ ID NO: 8046 - DNA, 618 bp, Streptococcus suis 89/1591
  CDS (1)..(618): transl_table=11
atgggttggtggaaggacaccattgagattgtaaaagaaaaagatccggcagcacggacgaccttggaagttcttttgacctacccaggtgtcaaggccttggctgcccaccgtctgtcccattggatgtggaaaaaaggctttaaattactagctaggatgcacagccaattttggcgtttttggactaatattgaaattcatccaggggcggatattgcttcaggtgtcttcatcgaccatggagctggtttggttatcggagaaaccgccattattgaatcaggtgtcatgctttaccacggagttacgcttggtggaacgggcaaggatacaggcaagcgccacccgactgtgcgaaaaggggctctggtttctgcccacgctcaagtcattggtcccattgagattggggaaaatgccaaagttggtgcagctgccgttgtcctagccgatgttccagcagatgtgacagtggtcggtatgccagccaaaatcgtccgtgtacacggtcaaaaagatgagaaggtcattcatgacatggaagatggtcgtgaacactacacgactaaattagcagagctgagagaagctagtcaccgttcatcgcacttgtag

SEQ ID NO: 8047 - protein, 205 aa, Streptococcus suis 89/1591
MGWWKDTIEIVKEKDPAARTTLEVLLTYPGVKALAAHRLSHWMWKKGFKLLARMHSQFWRFWTNIEIHPGADIASGVFIDHGAGLVIGETAIIESGVMLYHGVTLGGTGKDTGKRHPTVRKGALVSAHAQVIGPIEIGENAKVGAAAVVLADVPADVTVVGMPAKIVRVHGQKDEKVIHDMEDGREHYTTKLAELREASHRSSHL

SEQ ID NO: 8048 - DNA, 822 bp, Sulfitobacter sp. EE-36
  CDS (1)..(822): transl_table=11
atggcaaatgcacgcacgaatatcgccacggtggatccggtttgggatcagatccagacggaagcacagaatgctgtccgcgatgagccgctgattggcggttttgtccacgccacaattctgcaccataaatccatcgagaaagcgctatcctaccgtatcgcggcgaagctggcctcgaatgaaatgtcgatgatggtggtccatgagatggtggaggaggcctttgccagtgatcccgacctgatcaaggcggcacgggccgatctggtggcgatttacgagcgtgaccccgcctgccaccggctgttgcaaccgatcctgtatttcaaaggctatcaggccgtgcaggcctaccgtgtgggccatcacctgtggaaacaaggtaaacgggatctggcctatttcgtgcagatgcgcgtgagcgagatttttggcgtcgatatccaccctgccgcgacgatcggcaagggaatcatgatcgaccatgcccattccgtcgtgattggcgaaaccgcggtcgtgggcgacaacgtgtcgatgctgcactcggtcactttgggcgggacgggcaaggaagagcaggaccgtcacccgaagattggcaacggcgtgttgatcggcgcgggggcgaaagtgttgggcaatatctctatcgggcattgctcgcgcattgcggcggggtctgtcgtgctggaatccgtgccgccctgcaagaccgtcgcgggcatccctgcgcgggtcgtgggggaggcgggttgcgatcagccgtcggtcctgatggaccacatgctggggccgcagggcgatattaacatgtaa

SEQ ID NO: 8049 - protein, 273 aa, Sulfitobacter sp. EE-36
MANARTNIATVDPVWDQIQTEAQNAVRDEPLIGGFVHATILHHKSIEKALSYRIAAKLASNEMSMMVVHEMVEEAFASDPDLIKAARADLVAIYERDPACHRLLQPILYFKGYQAVQAYRVGHHLWKQGKRDLAYFVQMRVSEIFGVDIHPAATIGKGIMIDHAHSVVIGETAVVGDNVSMLHSVTLGGTGKEEQDRHPKIGNGVLIGAGAKVLGNISIGHCSRIAAGSVVLESVPPCKTVAGIPARVVGEAGCDQPSVLMDHMLGPQGDINM

SEQ ID NO: 8050 - DNA, 807 bp, Roseovarius nubinhibens ISM
  CDS (1)..(807): transl_table=11
atggccaaagcacatgcaaaactctcggaactcgacccggtctggaagcagatcaccgaggaagccaaggacacgatcgcccaggagccgctcatgggcgggctggttcatagttcgatcctgcaccacaaaaccatcgaatcggcgctcgcctatcggatctctctgaaactcgcctcgagcgagatgcccgagcagatcctgcgcgaaatctgtgattgggcgctggccgcagatcccaatatttcgctggcctcgcgcgccgatatcgtcgccgtgaacgaccgtgacccggcctgtgaccggttcatcctgccgatgcttttcttcaaggggtttcaggcggtgcaggcgcatcgcgtggcgcattggctctggcataacgaacgcaaggatatggcgcggttcttccagatgcgctgttccgaggtgtttggcatcgacattcaccccgccgcccggatgggcaagggcatcatgatcgatcatgcgcattccatcgtgatcggggaaaccgccgtggtcggcgacaatgtctcgatgctgcattctgtgacgctcggcggcaccggcaaggaagaagaagaccgccatcccaagatcggcgacggtgttctgatcggcgcgggggccaaggttctcggcaatatcaaggttggccattgctcgcgcatcgcggcgggctcggtcgtgctatccgaagtgccgccctgcaagacggtggcgggtgttccggccaagatcgtcggcgaagcgggctgtgatcagccctcggtggcgatggatcagctgctcggcgtgcgctaa

SEQ ID NO: 8051 - protein, 268 aa, Roseovarius nubinhibens ISM
MAKAHAKLSELDPVWKQITEEAKDTIAQEPLMGGLVHSSILHHKTIESALAYRISLKLASSEMPEQILREICDWALAADPNISLASRADIVAVNDRDPACDRFILPMLFFKGFQAVQAHRVAHWLWHNERKDMARFFQMRCSEVFGIDIHPAARMGKGIMIDHAHSIVIGETAVVGDNVSMLHSVTLGGTGKEEEDRHPKIGDGVLIGAGAKVLGNIKVGHCSRIAAGSVVLSEVPPCKTVAGVPAKIVGEAGCDQPSVAMDQLLGVR

SEQ ID NO: 8052 - DNA, 804 bp, Oceanicola batsensis HTCC2597
  CDS (1)..(804): transl_table=11
atggcccatacgcaaccctcggtcaccgcggtcgaccccgtctgggatcgcatgacgcaggaagccgaagacgccatctcggaggaaccgctcctgggcgggcagatccattccgccctgctgcatcatccgtcgatcgagaacgcgctggcctatcgcatcgcgatgaagctgaccaattccgagatgtccgagcagcttttgcgggagatctgcgacgaggcctatcgcgcggatcccgatctggcggcctcggcccgggcggatatcgtggcgacctacgaccgcgacccggcctgtcaccggttcatccagccgttgctgtatttcaagggcttccaggcggtgcaggcctatcgcgtggcgcattggctgtggcgggagggccggcaggacctggcctatttcttccagatgcgctgttccgaggtctacgggatcgacatccacccggcggcccggatcgggcaggggatcatgatcgaccacgcccattccatcgtcatcggcgagacggcggtggtcggcaacaacgtgtcgatgctgcattcggtgacactcggcgggaccggcaaggaagaggaggaccggcaccccaagatcggcgacggagtcctgatcggtgcgggggccaaggtgctgggcaacatccgcatcggccactgttcgcggatcgcggcgggatcggtcgttctgcacgacgtggactcctgcaagacggtggccggcgttcccgcgaaggtggtgggcgaggcgggctgcgaccagccctcgctgacgatggatcacctgttcggggggtga

SEQ ID NO: 8053 - protein, 267 aa, Oceanicola batsensis HTCC2597
MAHTQPSVTAVDPVWDRMTQEAEDAISEEPLLGGQIHSALLHHPSIENALAYRIAMKLTNSEMSEQLLREICDEAYRADPDLAASARADIVATYDRDPACHRFIQPLLYFKGFQAVQAYRVAHWLWREGRQDLAYFFQMRCSEVYGIDIHPAARIGQGIMIDHAHSIVIGETAVVGNNVSMLHSVTLGGTGKEEEDRHPKIGDGVLIGAGAKVLGNIRIGHCSRIAAGSVVLHDVDSCKTVAGVPAKVVGEAGCDQPSLTMDHLFGG

SEQ ID NO: 8054 - DNA, 720 bp, Erythrobacter sp. NAP1
  CDS (1)..(720): transl_table=11
atgttcgacaagctcaaggcttatctggactcggtccaggcgcgcgatccagctcctcggtcgcggtgggaaatccttttgtatccgggggtttgggcgcttggcttccaccgggttgcgcattggctcttcgatgcgaagctgtttttcctcgcccggttcgtcaatcatctcagccgcctgctgaccgcgatcgatatccatccgggcgccaggatcgggaagaacttcttcatcgatcacggcttcaccgtcatcggcgaaactgcagagatcggcgacaacgtcacgatctatcagtgcgtgacgttgggcgggaccaatccgacaaatggaaagggcggcaagcgccacccgaccattcaggacaacgtgatcatcggctcaggcgcgcaggtcattggccccatcaccgtgggcgagcgtgcacgcatcggtgccaacgctgtggtgacagaggaagtgcctgagggcgcgacgatggtcggtttcaaggcgcgctcgacactcgttcctgccgaagagtggatcaaggacttcattccctacggtacgccttgcgaggacgcagaaggcaaccgcgtcgattgcattgaaaagctcgaaagcgaactgatcgcaatgaaagctgagatcgccgcattgaaggcagatcgccaagtcgatgaacctgttcagggcgatctcgacctcaccaagaaaagcgggaccggtgcctga

SEQ ID NO: 8055 - protein, 239 aa, Erythrobacter sp. NAP1
MFDKLKAYLDSVQARDPAPRSRWEILLYPGVWALGFHRVAHWLFDAKLFFLARFVNHLSRLLTAIDIHPGARIGKNFFIDHGFTVIGETAEIGDNVTIYQCVTLGGTNPTNGKGGKRHPTIQDNVIIGSGAQVIGPITVGERARIGANAVVTEEVPEGATMVGFKARSTLVPAEEWIKDFIPYGTPCEDAEGNRVDCIEKLESELIAMKAEIAALKADRQVDEPVQGDLDLTKKSGTGA

SEQ ID NO: 8056 - DNA, 756 bp, Synechococcus sp. RS9917
  CDS (1)..(756): transl_table=11
atgttgaaagcgatccgcgccgacctggcgattatccgcgagcgggatccggccgcccgcggccccctggagatcctgctctgctacccggggttccaggcggtgaccctgcaccggatcagccatcggctctggcgctcacgcctgccactgaaactgccggctcggctgctcagtcagctcgggcgcagcctcacgggggtggaaatccatcccggtgcccgcatcggcagcggcgtgttcatcgaccacggcatgggggtggtgatcggtgaaaccagcgaaatcggcgaccgctgcctgctgtatcaaggcgtcaccctggggggcacgggcaaggagcacggcaaacgacaccccactctggccagtgatgtggtggtgggggcgggcgccaaggtgcttggggcgatccaggtgggcagcaacacgcgcatcggtgccggctcggtggtggtgcgcgatgtggaagccgactgcacggtggtgggcatccccggccgggtgatccaccagagcggcgtgcgcatcaatcccctcgcccactccgccttaccggatgcggaagcgaacgtgatccgcaacctgatggagcggatcgaccagctcgaaagtcaggtgggcacgctgcagacctgcctcaaagcggtggcggcggggagaccattgagcgagatctgccagggcgattcccagaacctcaaagaccgggagattctcgagttcctgggggataaccccggtagcgcaggctga

SEQ ID NO: 8057 - protein, 251 aa, Synechococcus sp. RS9917
MLKAIRADLAIIRERDPAARGPLEILLCYPGFQAVTLHRISHRLWRSRLPLKLPARLLSQLGRSLTGVEIHPGARIGSGVFIDHGMGVVIGETSEIGDRCLLYQGVTLGGTGKEHGKRHPTLASDVVVGAGAKVLGAIQVGSNTRIGAGSVVVRDVEADCTVVGIPGRVIHQSGVRINPLAHSALPDAEANVIRNLMERIDQLESQVGTLQTCLKAVAAGRPLSEICQGDSQNLKDREILEFLGDNPGSAG

SEQ ID NO: 8058 - DNA, 762 bp, Synechococcus sp. WH 5701
  CDS (1)..(762): transl_table=11
atgatcaggcgaatccttaaacctattctcgcggatctgcgcatcatccgggagcgagacccggcggctcgcggcaccctcgagatcctgctctgctacccgggcttccaggccctggtgctgcaccgcctcagccaccgcctctggaccctgaacgtgccgctgctgccccggctgtgctcgcaggttggtcgcctgttcaccggcattgagatccatccgggcgccacaatcggccacggcgtgttcatcgaccacggcatgggggtggtgatcggtgaaaccgccgagatcggcgatcgctgcctgctctttcagggggtcaccctgggcggcaccggcaaggaacacggcaagcgccacccaactctggcggagaacgtggtggtgggcgctggcgccaaggtgctcggcgcgatcacggtgggcaccaacacccgcatcggcgctggctcggtggtgctgcgcgatgtgggccccgacagcacggtcgtgggggttcccggtcgcgtcattcaccagtcgggtgtgcgcatcgatcccctcgcccactcccagctgccggatgccgaagccaaggtgatccgcaacctgatggagcgcatcgacaccctcgagagcgaactcagccggctgcagacctgcctgcgcgaggtggcggctggacggcccctgcaggaagtctgcggcggccgcgcccagagcctgaaggaccgggaaatcctggagttcctgggtgaccgtcccagcgggggcacctga

SEQ ID NO: 8059 - protein, 253 aa, Synechococcus sp. WH 5701
MIRRILKPILADLRIIRERDPAARGTLEILLCYPGFQALVLHRLSHRLWTLNVPLLPRLCSQVGRLFTGIEIHPGATIGHGVFIDHGMGVVIGETAEIGDRCLLFQGVTLGGTGKEHGKRHPTLAENVVVGAGAKVLGAITVGTNTRIGAGSVVLRDVGPDSTVVGVPGRVIHQSGVRIDPLAHSQLPDAEAKVIRNLMERIDTLESELSRLQTCLREVAAGRPLQEVCGGRAQSLKDREILEFLGDRPSGGT

SEQ ID NO: 8060 - DNA, 762 bp, Synechococcus sp. WH 7805
  CDS (1)..(762): transl_table=11
atgttgaaccacatccgcgccgacctggcgatcattcgtgaacgggatccagcagcccgtggccccctggagatcctcctctgctatccaggctttcaagccctgagcttgcaccggttaagccacaggctctggcgctccaagctgcccctgaaactggcggcccggctgctcagccaaatgggacgcaatctcaccggtgtggagatccatccgggcgccagaattggccatggcgtgttcatcgaccacggcatgggcgtggtgattggcgagactgccgaagtgggtgatcgctgcctgctctaccagggggtgaccctgggtggaactggcaaggagcacggcaaacgtcatcccactcttgccaccaacgtggttgtgggggcaggcgccaaagttttgggggcaatctcagtcggccccaacaccagaatcggcgctgggtccgtcgttgtccgcgacgtggaggccgactgcaccgttgtgggagttccaggaagggtcgtccatcagagtggcgtaaggatcaatccattggcccactccgcccttccggatgccgaagccaatgtgattcgcaacctgatggagcgcattgaccaactggaaggacaggtacgcaacttgcaagaccatctccgagccatcgccacgatcaagggagagccgatcattgacaagcgatgcggcgaggctcagagcctcaaagatcgagaaattctcgaattcattggcgaccaatcaaattcaacttattga

SEQ ID NO: 8061 - protein, 253 aa, Synechococcus sp. WH 7805
MLNHIRADLAIIRERDPAARGPLEILLCYPGFQALSLHRLSHRLWRSKLPLKLAARLLSQMGRNLTGVEIHPGARIGHGVFIDHGMGVVIGETAEVGDRCLLYQGVTLGGTGKEHGKRHPTLATNVVVGAGAKVLGAISVGPNTRIGAGSVVVRDVEADCTVVGVPGRVVHQSGVRINPLAHSALPDAEANVIRNLMERIDQLEGQVRNLQDHLRAIATIKGEPIIDKRCGEAQSLKDREILEFIGDQSNSTY

SEQ ID NO: 8062 - DNA, 825 bp, Pseudoalteromonas tunicata D2
  CDS (1)..(825): transl_table=11
atgtttgccagaatcaaagaagatgttcacagtgtatttgcgcgagatcctgcagcgcgaaatttttgggaagttttttttaactctcctgggttgcatgctctatggtgttatcgacttaatcataagctctggcaagcaggttggttttttttagcccgaaccttttctacggtagcgcgctggtttactggtattgaaattcatcctgccgcaacaattggccggcgatgttttattgatcatggtatgggcgtggtgattggtgaaacggctgaaattggtgatgatgtaacgctttaccacggtgtaacattaggtggcaccagttggcagacgggcaagcgccatcccacattagagcaaggggtggttgttggtgctggtgcacagattttaggaccaatcacaattggcgccggtgctaaaataggttctaactctgtggtagttaaacatgtgcccagtcacgcgacagtggttggcatccctgggcgagttgtaaccgcaaaagcaccggaacttgcagccgattcagccaagcagcaacgagcggccatagccgaaaagtacggctttgatgcttatgccgtgtcttatgataatccagatccggtagctaattcgattggtaaaatgctcgatcatattcatttactcgatgcaaaaattaatgaattaagttgtgcgctcaataagttgggtggtgatgtctgtgaacagcaattacctgagctcaatctagatgatcaagacttttgtaaagcagaacaattagcgaaacaaaagcgccaacagcatgatgactttgatcctaagatataa

SEQ ID NO: 8063 - protein, 274 aa, Pseudoalteromonas tunicata D2
MFARIKEDVHSVFARDPAARNFWEVFFNSPGLHALWCYRLNHKLWQAGWFFLARTFSTVARWFTGIEIHPAATIGRRCFIDHGMGVVIGETAEIGDDVTLYHGVTLGGTSWQTGKRHPTLEQGVVVGAGAQILGPITIGAGAKIGSNSVVVKHVPSHATVVGIPGRVVTAKAPELAADSAKQQRAAIAEKYGFDAYAVSYDNPDPVANSIGKMLDHIHLLDAKINELSCALNKLGGDVCEQQLPELNLDDQDFCKAEQLAKQKRQQHDDFDPKI

SEQ ID NO: 8064 - DNA, 816 bp, Pseudoalteromonas tunicata D2
  CDS (1)..(816): transl_table=11
atggtattgatgcgacatcaaatttggcagcaactaaaagtagaagcgactgagctagtaaaaaaagaacctttactcgcaagtcacgtttattcatgtattttgaatcatgaatgtttaggatctgcgcttagttttattgtcgctaataagctctcggatgcggtggtttcaccttttacttttcgtgaattatttgatcaggcttttgttgattgtgaccgcatgcttacccatgtttcacacgatattaaagcagtaaaagaccgcgatcctgctgctgatagttacttaagtattttgttaaatttaaagggctttcaagcaatccaagttcaccgacttgctcattgtttatggcgccaagaccgtaaagagcttgctcgttttatccaatcacgtaattcagaagtgtttggtgttgacattcatccagcctgtaaaatcggccatggcattatgtttgaccatgcaacaggcattgttattggtgaaacagcagtgattgaagataatgtatcgattctacaaggtgtaaccttaggtggtacaggcaatgagcaaggtgatcgtcatcctaaaattcgcgaaggcgtgatgataggtgctggcgccaaggttttaggtaatatagaagttggccaaggcgctcgaataggtgcgggctctgttgttttaagcgctgttgcaccccataccacggttgtaggtgtgcctgcaaaagttgtgggcaggccctgtaatcgtccagctgaaaccatggatcaaaatgtacttgagcaatccgatgactctttgaccagcgcactgctttaa

SEQ ID NO: 8065 - protein, 271 aa, Pseudoalteromonas tunicata D2
MVLMRHQIWQQLKVEATELVKKEPLLASHVYSCILNHECLGSALSFIVANKLSDAVVSPFTFRELFDQAFVDCDRMLTHVSHDIKAVKDRDPAADSYLSILLNLKGFQAIQVHRLAHCLWRQDRKELARFIQSRNSEVFGVDIHPACKIGHGIMFDHATGIVIGETAVIEDNVSILQGVTLGGTGNEQGDRHPKIREGVMIGAGAKVLGNIEVGQGARIGAGSVVLSAVAPHTTVVGVPAKVVGRPCNRPAETMDQNVLEQSDDSLTSALL

SEQ ID NO: 8066 - DNA, 822 bp, Photobacterium sp. SKA34
  CDS (1)..(822): transl_table=11
atgaagcaatgtcaacaacaccagctttggccagcgatcaagcaggaagcacgagagcagtcagagcatgagcaaatgctcgcgagcttttatcatgccacgattattaagcatgatgaccttgctgctgcattgagttatatacttgcaaataaattggcaacaccatcgatgccagcgatggctgttcgtgaggtcatcgaagaagcgtatgctagcgattgttcgatagttgaatcggcagcacgtgatatttgtgctgttgttgaacgtgatcctgctattaatatgtattctattccattactttatctcaaaggttgtcacgctcttcaaggatatcgcgtagctaactggttatggaaacaagatcgaaaagccttagcggtttatctacaaaaccaaatctctgtagcttgccaagtcgatgtgcatccagcggcaaaaattggtcaagggatcatgtttgatcacgcgacgggtattgtgattggtgaaaccgcagtcattgaaaatgatgtctcaatccttcaggacgtcacattaggtggtacggggaaagagagcggcgatcgtcatccaaagatccgtgaaggggtgatgataggtgctggcgctaaagtgttaggcaatatcgaagttggtgaaggggcgaaaattggctcttgttcggtggtgttaaatcatgtgcctccccatacaactgttgccggtattcctgctaaagttgttgggcgaccaaattcagataaaccatcgatggatatggatcagcaatttaatggtaactcgcaaacgtttattgaaggtgatggtatttag

SEQ ID NO: 8067 - protein, 273 aa, Photobacterium sp. SKA34
MKQCQQHQLWPAIKQEAREQSEHEQMLASFYHATIIKHDDLAAALSYILANKLATPSMPAMAVREVIEEAYASDCSIVESAARDICAVVERDPAINMYSIPLLYLKGCHALQGYRVANWLWKQDRKALAVYLQNQISVACQVDVHPAAKIGQGIMFDHATGIVIGETAVIENDVSILQDVTLGGTGKESGDRHPKIREGVMIGAGAKVLGNIEVGEGAKIGSCSVVLNHVPPHTTVAGIPAKVVGRPNSDKPSMDMDQQFNGNSQTFIEGDGI

SEQ ID NO: 8068 - DNA, 807 bp, Oceanospirillum sp. MED92
  CDS (1)..(807): transl_table=11
atgagccagaatccagaatgcccaacctggctttgggatgaaatttctgctgaagcagagcgagaagtgatagaggagcctgtactggctggcttctaccatgcgaatattcttggtcatcagagcttatgttcggcattagcttatctgctaagtcgcaagctttatgatgatgctgtgcctgcggtaacttttcgattagtgatcgaagaagtattccgtgaagcacctgagatcctgcaggcggtctgtgcagatattgcagccgttcgcaaccgtgatccggcgatcgataaatactcgacggtacttctctacctgaaaggcttccatgcgatacaggcgtatcgtgtggctcatcatatgtggaatcagggccgtaagagcatggcgctctatatccagagccgggttagctgtgttttgcaggttgatattcatcctgcggcgaagatcggtcagggggtaatgttcgaccacgcgacaggtatcgttgtaggtgagaccagtgtgattgaaaatgacgtttctattctgcagtcggtaacgctcggtggtaccggtaaagagtgcggtgatcgtcatccaaaaatccgcgaaggtgttatgatcgcagcgggtgctaagattttcggcaatattgagatcggtagcggcgctaaagttggtggtggcagtgttgtcttagacggtgttccagcacatacaacggtggtaggtgtgcctgcgagagcggttggtcatcctcagtgcgataagcctgcactggatatggatcagaatattctgcacgacaaagaaaagtaa

SEQ ID NO: 8069 - protein, 268 aa, Oceanospirillum sp. MED92
MSQNPECPTWLWDEISAEAEREVIEEPVLAGFYHANILGHQSLCSALAYLLSRKLYDDAVPAVTFRLVIEEVFREAPEILQAVCADIAAVRNRDPAIDKYSTVLLYLKGFHAIQAYRVAHHMWNQGRKSMALYIQSRVSCVLQVDIHPAAKIGQGVMFDHATGIVVGETSVIENDVSILQSVTLGGTGKECGDRHPKIREGVMIAAGAKIFGNIEIGSGAKVGGGSVVLDGVPAHTTVVGVPARAVGHPQCDKPALDMDQNILHDKEK

SEQ ID NO: 8070 - DNA, 1029 bp, delta proteobacterium MLMS-1
  CDS (1)..(1029): transl_table=11
atgccccgcaaaaataaactgcccatgcaccccgacttttgcgaccaggaacagtgcgccaccgaaccctgccccggcaaggagccggatagcggcctcggccaccgggccaggctgccggaggtggtggagcggattgtcgccacctgccaggaccgcagttgctttgagcatgtcgaggccgagcctttgccttcgcggcggcgggccatcgccatcctcgattcctgccgggagattatcttccccggctacttcggccaccaggggatcgaccgggtcaacctggaataccggatcggcctggaggtttccgaactgtttgaccggctggccaccgagatcgccaacgccatccgccatgaatgcacccgccacggtcacacctgccagcactgcgacgaggccggccaggagaaggccctgcactttctgcagcagttgccgcaattgcgggccgtgctggccagcgacgtgcaggccgcctaccagggcgatccggcggcggccggctatgacgagatcatcttcagctaccccggcctgcacgccatcaccatttaccgcatcgcccacgccctgctgcggctggaggtgccggtgctgccccggatcatgaccgagcacgcccacagcatcaccggcattgatatccatcccggagccagcatcgaccaggcctttttcatcgaccacggtaccggggtggtcatcggccagaccgcggtgctgggcaagcgggtcaagatctaccagggggtcaccctgggggccctggcctttcgccgcgacgagcaaggcggtttgcagcgcgatatcaagcgccaccccaccctggaagacgacgtcaccgtttacgccggctccaccatcctggggggagagacggtgatcggcgcccgctcggtgatcggcggcaatatctggctgacccattcggtcccgccggacaccaaggtggtgctcaacccgccggagctggtctacaaaacccagaaaaacgggcagcagccggccgggggcaaataa

SEQ ID NO: 8071 - protein, 342 aa, delta proteobacterium MLMS-1
MPRKNKLPMHPDFCDQEQCATEPCPGKEPDSGLGHRARLPEVVERIVATCQDRSCFEHVEAEPLPSRRRAIAILDSCREIIFPGYFGHQGIDRVNLEYRIGLEVSELFDRLATEIANAIRHECTRHGHTCQHCDEAGQEKALHFLQQLPQLRAVLASDVQAAYQGDPAAAGYDEIIFSYPGLHAITIYRIAHALLRLEVPVLPRIMTEHAHSITGIDIHPGASIDQAFFIDHGTGVVIGQTAVLGKRVKIYQGVTLGALAFRRDEQGGLQRDIKRHPTLEDDVTVYAGSTILGGETVIGARSVIGGNIWLTHSVPPDTKVVLNPPELVYKTQKNGQQPAGGK

SEQ ID NO: 8072 - DNA, 1029 bp, delta proteobacterium MLMS-1
  CDS (1)..(1029): transl_table=11
atgccccgcaaaaataaactgcccatgcaccccgacttttgcgaccaggaacagtgcgccaccgaaccctgccccggcaaggagccggatagcggcctcggccaccgggccaggctgccggaggtggtggagcggattgtcgccacctgccaggaccgcagctgctttgagcatgtcgaggccgagcctttgccttcgcggcggcgggccatcgccatcctcgattcctgccgggagattatcttccccggctacttcggccaccaggggatcgaccgggtcaacctggaataccggatcggcctggaggtttccgaactgtttgaccgactggccaccgagatcgccaacgccatccgccatgaatgcacccgccacggtcacacctgccagcactgcgacgaggccggccaggagaaggccctgcactttctgcagcagttgccgcaattgcgggccgtgctggccagcgacgtgcaggccgcctaccagggcgatccggcggcggccggctatgacgagatcatcttcagctaccccggcctgcacgccatcaccatttaccgcatcgcccacgccctgctgcggctggaggtgccggtgctgccccggatcatgaccgagcacgcccacagcatcaccggcattgatatccatcccggagccagcatcgaccaggcctttttcatcgaccacggtaccggggtggtcatcggccagaccgcggtgctgggcaagcgggtcaagatctaccagggggtcaccctgggggccctggcctttcgccgcgatgagcaaggcggtttgcagcgcgatatcaagcgccaccccaccctggaggatgacgtcaccgtctatgccggctccaccatcctggggggggagacggtgatcggcgcccgctcggtgatcggcggcaatatctggctgacccattcggtcccaccggacaccaaggtggtgctcaacccgccggagctggtctacaaaccccagaaaaacgggcagcagccggccggaggcaaataa

SEQ ID NO: 8073 - protein, 342 aa, delta proteobacterium MLMS-1
MPRKNKLPMHPDFCDQEQCATEPCPGKEPDSGLGHRARLPEVVERIVATCQDRSCFEHVEAEPLPSRRRAIAILDSCREIIFPGYFGHQGIDRVNLEYRIGLEVSELFDRLATEIANAIRHECTRHGHTCQHCDEAGQEKALHFLQQLPQLRAVLASDVQAAYQGDPAAAGYDEIIFSYPGLHAITIYRIAHALLRLEVPVLPRIMTEHAHSITGIDIHPGASIDQAFFIDHGTGVVIGQTAVLGKRVKIYQGVTLGALAFRRDEQGGLQRDIKRHPTLEDDVTVYAGSTILGGETVIGARSVIGGNIWLTHSVPPDTKVVLNPPELVYKPQKNGQQPAGGK

SEQ ID NO: 8074 - DNA, 771 bp, Oceanobacter sp. RED65
  CDS (1)..(771): transl_table=11
atgtttaccaccatacgcgaagacataaaatgcgtttttgatcgggaccctgctgcccgtaatacatttgaagtgctgacgacctatccagggttgcacgcgctaatgcattaccgctttgctcactggtgttggaatcacggtctgaaataccctgcacgatttgtcagcttcatgagccgctggtttacgggaattgaaatccacccaggcgctaaaatcggtaagggtttttttattgatcacggcatgggtgtggtgatcggtgaaacggctgagattggtgataacgtcacgctttatcatggcgtcacccttggtggcacgtcttggaaagcgggtaaacgtcacccaactctaaaggatggtgttgtcatcggtgcaggagctaaggtgctagggccagtagaaataggcgaaaacgcacgggttggcagcaatgctgtagtaaccaaagcggttcctgacggagcaacggcggtcggcattccgggtcgcattgttgttaaaaaagaaaaagcatctgatgaacaggatcgtcgtcgtcaagccatggcggataaaattggctttgatgcctacggtatgacagatgaaatgccagatccaattgctcgctcaatccataatcttttagatcacatgcatgctgttgatgcaaagattgatcgcatgagtagcgccctaggagatcttggtcataaagaatgcacaggcgaattgcctaagttgcggaatgcgctggatgatgaagcaaataccaaatcttaa

SEQ ID NO: 8075 - protein, 256 aa, Oceanobacter sp. RED65
MFTTIREDIKCVFDRDPAARNTFEVLTTYPGLHALMHYRFAHWCWNHGLKYPARFVSFMSRWFTGIEIHPGAKIGKGFFIDHGMGVVIGETAEIGDNVTLYHGVTLGGTSWKAGKRHPTLKDGVVIGAGAKVLGPVEIGENARVGSNAVVTKAVPDGATAVGIPGRIVVKKEKASDEQDRRRQAMADKIGFDAYGMTDEMPDPIARSIHNLLDHMHAVDAKIDRMSSALGDLGHKECTGELPKLRNALDDEANTKS

SEQ ID NO: 8076 - DNA, 669 bp, Desulfitobacterium hafniense DCB-2
  CDS (1)..(669): transl_table=11
atgtttggccaaattaagcaagacattaaagtgatttttgaaagagatccggcggctaaaacgatagttgaggttatcctgtgctatccgggtcttcatgcgttgatcgcccatcgtctggcacactgtctgtataaaaagaatatggttttaatccctcgcttaatctcccagacctcccgtttttttacggggatagaaattcatcccggtgcgaaaatcggccaggggctctttattgatcacgggatgggagtggtcatcggggagacggccgaagtgggggataatgttaccatctaccaaggggtcactctgggcggaacaggtaaggaaaaagggaaaagacaccctactgttgggaataatgtttttatcggttcgggagctaaaatattaggttccattaaaattggggataatgttaaaatcggggcaggatctgtggtcacgaagcctgttcccagcaataccacggtggtgggtgttcctggaaaggttgtctcacgccacgggatgcccttaaaggaattgcatgtggttacgaaatccgtatgtaataaagagatccgggcagaagaaatgccggatcctgttcaagaaacattgcaaatcctcatggaacggattaattatctggagaaaaaactaggggaaaaggagagctga

SEQ ID NO: 8077 - protein, 222 aa, Desulfitobacterium hafniense DCB-2
MFGQIKQDIKVIFERDPAAKTIVEVILCYPGLHALIAHRLAHCLYKKNMVLIPRLISQTSRFFTGIEIHPGAKIGQGLFIDHGMGVVIGETAEVGDNVTIYQGVTLGGTGKEKGKRHPTVGNNVFIGSGAKILGSIKIGDNVKIGAGSVVTKPVPSNTTVVGVPGKVVSRHGMPLKELHVVTKSVCNKEIRAEEMPDPVQETLQILMERINYLEKKLGEKES

SEQ ID NO: 8078 - DNA, 738 bp, Synechococcus sp. RS9916
  CDS (1)..(738): transl_table=11
atgttcaaacagatccgagccgacctggccgttatccgtgaacgggatccagctgcccggggtgccctggaaatcctgctctgctacccaggctttcaagccatcacagcgcaccgcctcagtcaccgcctgtggcggtcacgcctccccttaaaactgccggcccgcctgctgagccagttgagccgtggcctgaccggcatcgagattcaccccggcgcccgcatcggcaacggtgtcttcatcgaccacggcatgggcgtggtgatcggtgaaaccgccgaagtgggggaccattgcctgctgtatcagggcgtcaccctggggggcaccggcaaagaaagcggtaaacgccaccccaccctggaaaacaatgtggtggtgggtgcgggcgcgaaggtgctgggcgccctcaaaatcggcactaacacccgcatcggcgctgggtcagtggtggtgcgcaacgtggaggccaactgcacggtggtgggcattcccgggcgagtcatccaccaaagcggtgtgcgcatcaatcccctggcccactcggccctgccggatgccgaagccaacgtgatccgcaatctgatggaacggatcgaccaactggagaaccaagtcaccaaccttcaggccacgctgaaagccgtggccagtgaccttccgatcaaggaagtgcgatcaggtcaggcccagaacctcaaggaccgggaaatccttgagtttctgggcgaatga

SEQ ID NO: 8079 - protein, 245 aa, Synechococcus sp. RS9916
MFKQIRADLAVIRERDPAARGALEILLCYPGFQAITAHRLSHRLWRSRLPLKLPARLLSQLSRGLTGIEIHPGARIGNGVFIDHGMGVVIGETAEVGDHCLLYQGVTLGGTGKESGKRHPTLENNVVVGAGAKVLGALKIGTNTRIGAGSVVVRNVEANCTVVGIPGRVIHQSGVRINPLAHSALPDAEANVIRNLMERIDQLENQVTNLQATLKAVASDLPIKEVRSGQAQNLKDREILEFLGE

SEQ ID NO: 8080 - DNA, 822 bp, Vibrio sp. Ex25
  CDS (1)..(822): transl_table=11
atgaaacactgcgaaaaacaaaaagtctggaacagaattgtctcagaagcccgcgaaatgtcagagcaagagccaatgctggccagcttttaccatgccaccatcatcaagcatgaaagtttctgtgccgcgctcagctacattttggcaaacaagttaaacacggcatcgatgccagcaatggcagtacgtgaagtggtagaagaagcgttctctgccgacccaaccattaccgattgtgccgcttgtgacatttgtgccacggttaatcgcgacccagcagtttcgatgtactctatgccgctgctgtacttaaagggctaccacgctctgcaaggctaccgcgtggcaaactggctatggaaacaagggcgccatgcactggcaacctacctacaaaaccaaatttcggttgcgtgtcaggtagacattcacccggcagcacgcattggtagcggcatcatgctcgaccacgcaacggggatcgtcatcggtgaaactgcggttatcgataatgacgtctcaattctacaagacgttaccttaggcggtacgggtaaagagtgcggcgatcgtcacccgaaaatccgtgaaggtgtgatgattggtgcaggtgcaaaaattcttggcaatatcgaagtgggcgaaggcgcgaaaatcggctcttgctctgtggtattgcaagcagtgccaccacacacaaccgtggcgggggttcctgcgaaaatcgtcggtcgtccaaaaacggacaaaccttctctcgatatggatcaaggctttaatggtaaatcacaaagctttatccatggagatggtatttaa

SEQ ID NO: 8081 - protein, 273 aa, Vibrio sp. Ex25
MKHCEKQKVWNRIVSEAREMSEQEPMLASFYHATIIKHESFCAALSYILANKLNTASMPAMAVREVVEEAFSADPTITDCAACDICATVNRDPAVSMYSMPLLYLKGYHALQGYRVANWLWKQGRHALATYLQNQISVACQVDIHPAARIGSGIMLDHATGIVIGETAVIDNDVSILQDVTLGGTGKECGDRHPKIREGVMIGAGAKILGNIEVGEGAKIGSCSVVLQAVPPHTTVAGVPAKIVGRPKTDKPSLDMDQGFNGKSQSFIHGDGI

SEQ ID NO: 8082 - DNA, 819 bp, Alteromonadales bacterium TW-7
  CDS (1)..(819)
atgcgtcatgaaatttggcaacagcttcgaagtgaagcaaatgaagtcgtcactcgcgaaccacttttagcaagtcatgtgtattcatgtattttgaaccatgagtgtttaggttcggcgttaagctttattgttgctaacaaattggccgatgctgttgtatctgcatttactattcgtgaattattcgatcaatcatttgtaaaatgcgatcgcatgctgtcttttgtcgcagaagacattaaagctgtaaaagatagagacccagccgcagaaacctacctgactgttattttaaatttaaaggggtttcatgctattcaggctcatcgtttagctaactgcttgtggcaacaaaaccgtaaagaactggcgcgttttattcaaagccgtacttctgaagtgtttggtgtagatattcaccctgcttgtcaggttggtaaaggcataatgtttgaccacgcaacgggtattgttattggtgaaacggcagtcattgaagataatgtatcgatactgcaatcggttacgcttggcggtacaggtaatgagcaaggtgatcgtcatcctaaaatcagagcgggtgtgttaattggcgcaggtgcaaaagtgctgggtaatattgaagtgggtgagggcgcacgtattggtgcagggtcggtggtattaactgctgtgccacctcatacaacggccgttggcgtaccggccaaaattattggcagacctgaatgcccgtgtcctgcgcaaagtatgaaccaaaactttttagctacaccagagccagaaaacgaatcgcataccagcgctatgctgtga

SEQ ID NO: 8083 - protein, 272 aa, Alteromonadales bacterium TW-7
MRHEIWQQLRSEANEVVTREPLLASHVYSCILNHECLGSALSFIVANKLADAVVSAFTIRELFDQSFVKCDRMLSFVAEDIKAVKDRDPAAETYLTVILNLKGFHAIQAHRLANCLWQQNRKELARFIQSRTSEVFGVDIHPACQVGKGIMFDHATGIVIGETAVIEDNVSILQSVTLGGTGNEQGDRHPKIRAGVLIGAGAKVLGNIEVGEGARIGAGSVVLTAVPPHTTAVGVPAKIIGRPECPCPAQSMNQNFLATPEPENESHTSAML

SEQ ID NO: 8084 - DNA, 816 bp, marine gamma proteobacterium HTCC2143
  CDS (1)..(816): transl_table=11
atggcaacgcaacctattgcgattagccctgaaaatgatgccatatggcaaagtattcagacagaaacccaagctgccattaataaagagcctgttttggcgagttttttgcactctaccatcctcaatcataagaccctggaacgtgcccttagctttcatctggctaataaactggacagcccaacagtatcagcactgttggttcgggaagtcattgaggatgctctggcgtctgattcaaccattgccaaagccgttcgctgtgatatccgcgcggtcaaagagcgtgattctgcctgtagcttatactctgtgccttttctctattttaaaggctttcatgcgctgcaggcctaccgtgttgcgcattggctgtggaatcagggacgggaagatttagccttatttttccagaactgtatttctaccgaatttggcgtagacattcaccccgcggcgaagataggacacggtattctgatcgatcatgcaacgggtgtggtgatcggagaaactgcaaccgttggcaacaatgtgtcgctcatgcactcggtaacattgggtggcacgggtaaagaaggcggagaccgtcatccaaaagtgggcgacggcgtattgatcagtgccggcgccaaaattcttggtaacatccgcattggcagtggcgctaaagtgggatccggtagtgtcgtattacaagatgtgcccgctcatactaccgttgctggcgtacccgcaaaggtgattggcaaaccaggcagtgatcaaccggcactggatatgaatcacggcattaactgtgatatgggctag

SEQ ID NO: 8085 - protein, 271 aa, marine gamma proteobacterium HTCC2143
MATQPIAISPENDAIWQSIQTETQAAINKEPVLASFLHSTILNHKTLERALSFHLANKLDSPTVSALLVREVIEDALASDSTIAKAVRCDIRAVKERDSACSLYSVPFLYFKGFHALQAYRVAHWLWNQGREDLALFFQNCISTEFGVDIHPAAKIGHGILIDHATGVVIGETATVGNNVSLMHSVTLGGTGKEGGDRHPKVGDGVLISAGAKILGNIRIGSGAKVGSGSVVLQDVPAHTTVAGVPAKVIGKPGSDQPALDMNHGINCDMG

SEQ ID NO: 8086 - DNA, 837 bp, marine gamma proteobacterium HTCC2080
  CDS (1)..(837): transl_table=11
atggtgaccgttatgacggcagttcattcagtaccaataaaaaaactacagggcggtgaccctatctgggagcaaatgcgcgcagagaccgagcgcgctgccagccaagaaccggtcttggtgagctttctgcatgcaaccattttgcatcatgacgaactggaatgcgccctaagctttcacctggccaaccagctcgatagcccaacagttccggccatgatgcttcgagaaatcatgctggcggcctttagcagtgacgccaccctgcgcagcgctatacgtgacgatttacaggcggttcttgatcgcgactcggcctgtcaggaatatcatctgcctttcctctatttcaaaggttttcaagccttacaaacccaccgcgttgcccattggctttggcaggaaaatcgacattcgctggctctatttctacaaagccaggtatcacaaaagtttggcatagacattcatcctgcagcacgttttggtcatggcatcatgctcgatcacgccactggcttagtgattggtgaaacggccgtagtaggcaaccacgtctcgatacttcagtcggtcactctggggggtactggaaaacaagatggcgaccgccacccaaaaattggcgatggcgtcctcatttcagccggtgccaaaattttgggcaatattatcgttggggaaggtgccaaggtcggcgctggttccgtagtgctgcatgacgtgccatcccacacaactgtggcaggagtacctgcaaaagtcgtgggcgtccccgactcggagacacccgcgctagatatggatcatgcgcttcctgaatcggactggtga

SEQ ID NO: 8087 - protein, 278 aa, marine gamma proteobacterium HTCC2080
MVTVMTAVHSVPIKKLQGGDPIWEQMRAETERAASQEPVLVSFLHATILHHDELECALSFHLANQLDSPTVPAMMLREIMLAAFSSDATLRSAIRDDLQAVLDRDSACQEYHLPFLYFKGFQALQTHRVAHWLWQENRHSLALFLQSQVSQKFGIDIHPAARFGHGIMLDHATGLVIGETAVVGNHVSILQSVTLGGTGKQDGDRHPKIGDGVLISAGAKILGNIIVGEGAKVGAGSVVLHDVPSHTTVAGVPAKVVGVPDSETPALDMDHALPESDW

SEQ ID NO: 8088 - DNA, 786 bp, Pseudomonas putida GB-1
  CDS (1)..(786): transl_table=11
atgttcgaacgcctgcgtgaagatattcaaagcgtattccaccgtgacccggctgcgcgcaatgccttcgaggtgctcacctgctaccccggcatgcacgccatctggctgcaccgcctgggcaacgccctgtggaagcgtgatttcaaatggctggcccgcctggtgtcgaactttggccgttggctgaccggcatcgagatccatcccggcgccaccatcggtcggcgctttttcattgaccacggcatgggcatcgtcattggcgaaaccgccgaaattggcgatgacgtcaccctttaccagggtgtgacgctgggcggtaccagctggaataaaggcaagcgccaccccaccctggaaaacggtgtggtggtaggggcgggggccaaggtgctggggccgttcaccgtcggtgccggggccaagatcggctccaacgccgtggtgaccaaggcggtgccggccggggccacggcggtgggtattcccgggcgaatcatcgtcaagagcgaagacaccgaagtcgaggccaagcgcaaggccatggccgagaagatcggcttcgatgcctacggtgtcagcggcgacatgcccgacccggtggcgcgtgccatcggccagatgctcgaccatctgcaggcggtcgacgagcggttggagggtatgtgcggtgccctgaccaagatgggcagtgactactgtgccaaggaactgccggccttgccggaggatgacttcaccgaagccgccctggtggccaagcgcgacactcagtcgcattga

SEQ ID NO: 8089 - protein, 261 aa, Pseudomonas putida GB-1
MFERLREDIQSVFHRDPAARNAFEVLTCYPGMHAIWLHRLGNALWKRDFKWLARLVSNFGRWLTGIEIHPGATIGRRFFIDHGMGIVIGETAEIGDDVTLYQGVTLGGTSWNKGKRHPTLENGVVVGAGAKVLGPFTVGAGAKIGSNAVVTKAVPAGATAVGIPGRIIVKSEDTEVEAKRKAMAEKIGFDAYGVSGDMPDPVARAIGQMLDHLQAVDERLEGMCGALTKMGSDYCAKELPALPEDDFTEAALVAKRDTQSH

SEQ ID NO: 8090 - DNA, 933 bp, Pseudomonas putida GB-1
  CDS (1)..(933): transl_table=11
atgagcgaacaaccttcatccgcgcactggcagttgcagaacatcgttactggcctgcgcggcgcccgtgagcaatggcgcacccgcaatggccgcagcattggtgagcagggcgggcgcgaactgccatcgcgcgaggcgatgcggcagattctggagcaactgtgcggtgcgttgttccccatgcgccttgggcctgtggacctgcgcgaagaaagcgaagacttctacgtcggccatactctggatgccgcactgaccgccttgctggcccaggcgcgtctggagttgcgctatgccgctcgccaaagcaaggctgagctggcaggtgtagacgctcacgcgctaagcctgatccagggcttcgcggctgcgttgccggagctgcgcgtactgctcgacaccgatgtgctggccgcctaccacggcgacccggcggcgcgcagcgtcgatgaagtactgctgtgctacccaggtatcctggcgatcatccaccaccgcctggcgcaccacctttaccaggccggcttgccgctgctggcgaggatcagttcggagctggcgcattcggccacgggtatcgacattcacccaggggcgcaaatcggcccgagcttcttcatcgaccacggcaccggcgtggtgattggcgaaactgcgatcatcggcgagcgcgtgcgcatctaccaggcggttaccctgggcgccaagcgcttcccaagcgatgagtcggggaccctgcacaaaggcctgccgcgccaccccatcgtcgaggacgatgtggtgatctatgccggggccacggtgctggggcgcattaccatcggcaaaggctcgaccattggcggcaatgtgtggctgacccgcagtgtgccggctgaaagcaacatcacccaggccaacttgcagctggattgccaggacaagaactga

SEQ ID NO: 8091 - protein, 310 aa, Pseudomonas putida GB-1
MSEQPSSAHWQLQNIVTGLRGAREQWRTRNGRSIGEQGGRELPSREAMRQILEQLCGALFPMRLGPVDLREESEDFYVGHTLDAALTALLAQARLELRYAARQSKAELAGVDAHALSLIQGFAAALPELRVLLDTDVLAAYHGDPAARSVDEVLLCYPGILAIIHHRLAHHLYQAGLPLLARISSELAHSATGIDIHPGAQIGPSFFIDHGTGVVIGETAIIGERVRIYQAVTLGAKRFPSDESGTLHKGLPRHPIVEDDVVIYAGATVLGRITIGKGSTIGGNVWLTRSVPAESNITQANLQLDCQDKN

SEQ ID NO: 8092 - DNA, 840 bp, Pseudomonas putida GB-1
  CDS (1)..(840): transl_table=11
atgcttgtcgactgttcgtttgcaaatggccagtacatgccactatccccttgtcggaactttcggctgccagcaaaggcagcacttttagcgtctgtgcacaccagacaactggatatcaagcccatgcatactatggacatgcaatcagccgtgattgccaggctccctgtgcctgatgaactggcgtcattcaaagttgtaaaaaaccttgtgacctcggcgttgttggagtgctgttcaatcgacgagttcgaggcgctgaaagaaacattggttattgaaagtgtttctgaacaggcccatgccgacttgcaggcctttgcccagaaagatccggcggctggccgtgacctggtattcattgcaaaaacctacacctcttactcggcggttttgcactatcgacttgcccattggatttaccgtaatacggcctccacctacggcgccggcggccaatgcctggctgccatgatctccaggcgcggaaagatgctctcgggggcggagatccatttccgcagccgcatcggtgcgcgtttcatcatcgatcacggcatgggcaccgtcattggtgagacctcgaccattggtgacgattgctacgtgctcggcggcgtcaccctgggcgcccgaggcatcagtgacaacccttccagcgcccggcacccgacccttggcaaccgggtacagatcggcgctttcgccagtgtgctgggtgctatccacgtcggcgacggcgcgtttatcgggccgggttgcattattaccaaagatgtccccgccgctgctcgggtacagataaaaacatcattgcaggtggtacttgaaccatga

SEQ ID NO: 8093 - protein, 279 aa, Pseudomonas putida GB-1
MLVDCSFANGQYMPLSPCRNFRLPAKAALLASVHTRQLDIKPMHTMDMQSAVIARLPVPDELASFKVVKNLVTSALLECCSIDEFEALKETLVIESVSEQAHADLQAFAQKDPAAGRDLVFIAKTYTSYSAVLHYRLAHWIYRNTASTYGAGGQCLAAMISRRGKMLSGAEIHFRSRIGARFIIDHGMGTVIGETSTIGDDCYVLGGVTLGARGISDNPSSARHPTLGNRVQIGAFASVLGAIHVGDGAFIGPGCIITKDVPAAARVQIKTSLQVVLEP

SEQ ID NO: 8094 - DNA, 942 bp, Marinobacter sp. ELB17
  CDS (1)..(942): transl_table=11
atgtttagacatttaagagaagatatcgccagcgtgttccgccgcgatcccgctgcgcgtaatacctttgaagttctgaccaactatcctggcctgcacgcacttttactgcatcgggtggcacactggttatggggggtgggcctgaagtggctggcccgtaccctttctacgcttacgcgttggtttacgggtatcgagattcatcccggtgccaccattggtcggcgctttttcatcgaccacggtatgggtgtggttattggtgaaaccacggtcattggtgacgatgttacgctgtatcaaggcgttaccctgggcggcaccagttggaataagggcaagcgccatccgaccattggtgacggggtggtcgtaggcgccggagccaaaatattggggccctttgaagtaggcgccggtgccaaagtgggttccaactccgtggtcacaaaagcggtgccagctggcgcaaccgttgttggcataccgggccgcgtgattgaaaaagacaaagacgagcgaagctcgcggcgccgggaaatggaagagcgcatgggctttgatgcctatggcgttaccgaagaaatgccagaccctctggcgcgggcaatgcgttcgctgctcgatcacatgcacgcggtagacgatcgtatggaaataatgtgcaaagccttgcgcaaggtaagcgccgactatccgaacggagacttgccggtgttgtcagaggacgattttgattgcttacgcgatacagacagtgatgccgcgcgcaaaaaaacccgcgaagacgcaaaagtggttgcagcggcggcggtcgagccgagcaccaaagcgagtagtataatcagtgcgcacgagagcgctaaaaagagtgccgaagagagtgccgaagagggcaccaaaaagaatgcaagcgagcccaccaaggatagccgctga

SEQ ID NO: 8095 - protein, 313 aa, Marinobacter sp. ELB17
MFRHLREDIASVFRRDPAARNTFEVLTNYPGLHALLLHRVAHWLWGVGLKWLARTLSTLTRWFTGIEIHPGATIGRRFFIDHGMGVVIGETTVIGDDVTLYQGVTLGGTSWNKGKRHPTIGDGVVVGAGAKILGPFEVGAGAKVGSNSVVTKAVPAGATVVGIPGRVIEKDKDERSSRRREMEERMGFDAYGVTEEMPDPLARAMRSLLDHMHAVDDRMEIMCKALRKVSADYPNGDLPVLSEDDFDCLRDTDSDAARKKTREDAKVVAAAAVEPSTKASSIISAHESAKKSAEESAEEGTKKNASEPTKDSR

SEQ ID NO: 8096 - DNA, 690 bp, Erythrobacter sp. SD-21
  CDS (1)..(690): transl_table=11
atgttcgaacggctgatcgcctatctggactcgatcaaggcgcgcgatcccgcgccgcgtacccgctgggaagtgctgctctaccccggtgtctgggcgctcgcctatcatcgccttgcccactggctgttcgaggccgacctgttcttcctcgcccggctggtgaaccactggagccggatggtgacgggtatcgacattcatcctggtgccacgatcggccgaaaattcttcatcgatcacggcttcaccgtcatcggcgaaaccgcgcagatcggcgacaatgtcaccatctaccagaacgtgaccttgggcggcacgaatccgaccaacggcaagggtggcaagcgccacccgacgatctcggacgatgtcatcatcggttcgggcgctcaggtgatcgggccaattaccgtgggcaagcgggcacggatcggggccaacgccctggtgctggacgaagtgccggaaggcgcgaccatggttgccctcaaggcacgcagccacctgatcgcggcggaagaatggaagaaggacttcgtcccttacggcacgccttgcgacgatccttgcgctccgagccgtgactgcatcgaaaagctggagaacgagctcaaggccctccgcagcgaaatcgagaccctgcgcggcgagagccagccgcggcagcgaagcggtaccgacgactga

SEQ ID NO: 8097 - protein, 229 aa, Erythrobacter sp. SD-21
MFERLIAYLDSIKARDPAPRTRWEVLLYPGVWALAYHRLAHWLFEADLFFLARLVNHWSRMVTGIDIHPGATIGRKFFIDHGFTVIGETAQIGDNVTIYQNVTLGGTNPTNGKGGKRHPTISDDVIIGSGAQVIGPITVGKRARIGANALVLDEVPEGATMVALKARSHLIAAEEWKKDFVPYGTPCDDPCAPSRDCIEKLENELKALRSEIETLRGESQPRQRSGTDD

SEQ ID NO: 8098 - DNA, 780 bp, Moritella sp. PE36
  CDS (1)..(780): transl_table=11
atggaagataaactttcaatgtcttggcttaaaattagaggtgaggctaaattattagttgaacaggaacctatgctcgcgagctttttccattcaacaatactaaatcacgatagtttaaaatgctcattgagttttcaattagcaaataagctcggtagcgcgacaatgcctgctattttattacgtgaagtgattgaagaagcattaaaagctgaaccggatattttacatgcggttgctgctgatttatgtgcagtacaggaacgagatccggcggtagaatatttctcgacaccgctcttatatctgaaaggatttttggccttgcagtcgtatcgaattgcgcactggctctggaatcaaaagcgtgaagcattagcgatttatttacaaaaccaaatatcagtggtgtttgctgttgatattcatccagctgctcgaataggcaaaggtattatgcttgatcacgcaaccggtattgtgattggcgaaacggcaattatagaagatgatgtgtcaattttacaaagtgtcacgcttggtggtaccggtaaagaaagtggcgatcgtcatccgaaaattagagccggagtgatgattggtgctggcgcgaaagtgctgggtaatattgaagtcggcagaggggctaaagtcggtgctggtagtgtggtactagagtcggtaccggaacacacgacagtcgcaggtgtccccgctaaagttgttggtaaaccggattctgatatgccttcattagcgatgaatcaaacaatttga

SEQ ID NO: 8099 - protein, 259 aa, Moritella sp. PE36
MEDKLSMSWLKIRGEAKLLVEQEPMLASFFHSTILNHDSLKCSLSFQLANKLGSATMPAILLREVIEEALKAEPDILHAVAADLCAVQERDPAVEYFSTPLLYLKGFLALQSYRIAHWLWNQKREALAIYLQNQISVVFAVDIHPAARIGKGIMLDHATGIVIGETAIIEDDVSILQSVTLGGTGKESGDRHPKIRAGVMIGAGAKVLGNIEVGRGAKVGAGSVVLESVPEHTTVAGVPAKVVGKPDSDMPSLAMNQTI

SEQ ID NO: 8100 - DNA, 1101 bp, Opitutaceae bacterium TAV2
  CDS (1)..(1101): transl_table=11
atgcccggcggatggtggcccgaccaaaggccggacggcgaagcaggcggcaggaagccttttcagtcaccgtgccgcagaatcagctttaacccgggccgctcccagccgacagtgcacaccgtccgcaccgcatcggaattgcgcggaaatcagctcatcatgacgctcgacgacatcacactggcgctcctcgcctcctacgaatccaacggaggcatcaatcacctcgacggggtcaatctgccctccgaagagtccgtcaaccgcctcgccgtcgattgcatgcacctgctgtttcccggctacttcgaccagacgggcatcagccgcaaggacatcgccgcgcacaccgccgcgcgcgtccgcgccctgcacgaccgcttccgcgccgagatagaaaaaagcctgcgctttgccgagtacgaggacccggtcggccacgccgaacacgtgaccatgcgcctgctcgggggcctgcccggactgcgcgacattgtgcagaccgatgtgcaggccgcctacaatggcgaccccgccgcccgcagtcttgaggagatcatcctcgcctacccgtgcgtgctcgtgatctcgctgcaacgcatcgcgcacctcctctacaacctcgccgtgcccatcctgccgcgcatgattacggaatacgcgcacgaaaaaaccggcaccgacatccatcctggcgcgcgcatcggcagccactttttcatcgaccactgcaccggcgtcgtcatcggcgagacggccatcatcggcagccacgtcaagatctaccaaggcgtgacgctcggcgcgaaatccttcgaagtggacaaccacggcaacccgatcaagggcgtgaaacgtcatcccaacatcggcgaccacgtgacgatctactcgcacgccacgattctcggaggcgacacgaccatcggcgagcacaccatcgtcggtgccaacgtgtggctgctcgaatcgatccccgctcactgcattgcctactacaaaggcgaaaacctcgtggtccgttcccgtcgcaaacaggagaaggccgtcgaaacccgcaaccaagacgaattgcaggcttggaactggtcgatttag

SEQ ID NO: 8101 - protein, 366 aa, Opitutaceae bacterium TAV2
MPGGWWPDQRPDGEAGGRKPFQSPCRRISFNPGRSQPTVHTVRTASELRGNQLIMTLDDITLALLASYESNGGINHLDGVNLPSEESVNRLAVDCMHLLFPGYFDQTGISRKDIAAHTAARVRALHDRFRAEIEKSLRFAEYEDPVGHAEHVTMRLLGGLPGLRDIVQTDVQAAYNGDPAARSLEEIILAYPCVLVISLQRIAHLLYNLAVPILPRMITEYAHEKTGTDIHPGARIGSHFFIDHCTGVVIGETAIIGSHVKIYQGVTLGAKSFEVDNHGNPIKGVKRHPNIGDHVTIYSHATILGGDTTIGEHTIVGANVWLLESIPAHCIAYYKGENLVVRSRRKQEKAVETRNQDELQAWNWSI

SEQ ID NO: 8102 - DNA, 819 bp, Rhodobacter capsulatus
  CDS (1)..(819): transl_table=11
atgtccaaaacccgtgcgaaggtcgctgccatcgatccggtgtggatgcggatctgtgaggaggcgcatgatgccgtggggcaggaaccgcttctgggcgccttgatccatgccgggcttttgcatcatgcgacgatggaaaaggcgctggcctatcggttttcgctcaaactcgcctcgggcgagatgagcgagcagttgctgcgcgagattgcggatgacgcttatgggtcggaccccgatctggggcaggcggcgcgggcggatctggtggcggttttcgatcgtgacccggcctgccaccggttcttgcagccgatcctgttcttcaagggctatcaggcgctgcaaagctatcgcgtcgcgcattggctgtggcggcaggggcgcaaggacatggcctatttcgtgcagatgcgcacctcggaggcgttcggggtcgacattcacccggcggcgcggatcgggcgcggggtgatgatcgaccacgcccattcgatcgtgatcggggaaacggcggtggtgggcgacaatgtctcgatgctgcattcggtgacactgggcggcaccggcaaggaagaacaggaccgccatccgaagatcggcaatggcgtcttgatcggggccggggcgaaggtgctgggcaatattcacgtcggcgacaattcgcggatcgcggcggggtccgtggtgctggccgatgtgccgcgctgcaagaccgtggccggggtgcccgcgaagatcgtgggcgaggcgggctgtgcgcagccctcggtcaacatggatcagcagttgcgcggctgcgactgcgagggctga

SEQ ID NO: 8103 - protein, 272 aa, Rhodobacter capsulatus
MSKTRAKVAAIDPVWMRICEEAHDAVGQEPLLGALIHAGLLHHATMEKALAYRFSLKLASGEMSEQLLREIADDAYGSDPDLGQAARADLVAVFDRDPACHRFLQPILFFKGYQALQSYRVAHWLWRQGRKDMAYFVQMRTSEAFGVDIHPAARIGRGVMIDHAHSIVIGETAVVGDNVSMLHSVTLGGTGKEEQDRHPKIGNGVLIGAGAKVLGNIHVGDNSRIAAGSVVLADVPRCKTVAGVPAKIVGEAGCAQPSVNMDQQLRGCDCEG

SEQ ID NO: 8104 - DNA, 711 bp, Cyanothece
  CDS (1)..(711): transl_table=11
atgtttggatcactccctgtcagagagcgtcgtggaagtccgtcagaaagctctatttctgaaccgcgcacttctcgacctaacctattaagctttttgcggaaggattttcaaatcatttttgaaagagatcccgcagcccgtaattggttagaagtggtgtgttgctatccaggtttacacgctttggcgatccatcgtctttcccacgaattatggcatcgcaatttgcctttttttccccgttttctctctcatattgcccgttttcttacgggaatcgaaattcatccaggggcgactcttggccaaggggtgtttatcgatcatggtatgggggtggtcattggggaaacagcgattattggtgattattgcctcatttaccaaaatgtcaccctaggggggacgggtaaagaaagtggtaaacgccatcccactctaggcacttcagtcattgtgggagccggggcaaaagtattaggcaacatcgaaattggcaatcatgtccgtattggagccggatcaatcgtcttaagcgatgttccccatgattgcacggtagtaggcgttcctggtcgtattatctcccgtagtggtcggggttgtcctttagaacacggcaaattacccgatgttgagggccaagtcattcggagtttactagaccgaattgaagaattggaacaaaagatacaaaaactaccttga

SEQ ID NO: 8105 - protein, 236 aa, Cyanothece
MFGSLPVRERRGSPSESSISEPRTSRPNLLSFLRKDFQIIFERDPAARNWLEVVCCYPGLHALAIHRLSHELWHRNLPFFPRFLSHIARFLTGIEIHPGATLGQGVFIDHGMGVVIGETAIIGDYCLIYQNVTLGGTGKESGKRHPTLGTSVIVGAGAKVLGNIEIGNHVRIGAGSIVLSDVPHDCTVVGVPGRIISRSGRGCPLEHGKLPDVEGQVIRSLLDRIEELEQKIQKLP

SEQ ID NO: 8106 - DNA, 711 bp, Gloeothece sp
  CDS (1)..(711): transl_table=11
atgtttggatcactccctgtcagagagcgtcgtggaagtccgtcagaagcctccatttctgaaccgcgcacttctcggcctaacctgtttcaatctctgcggcaagactttcaaatcattttcgaaagggaccccgcagcccgtaattggttagaagtggtgtgttgctatccaggattacacgctttagcgatccaccgaatttcccacaagctatggcatcataatatcccgtttattcctcggtttctctcccatattgcccgattattcacagggattgaaattcatcctggtgccgctattggccaaggagtgtttattgatcacggaatgggtgtggtcattggagaaaccgcaattgtgggtgattattgcctaatttaccagaatgtcacccttggtggaactggcaaagaaacaggcaaacgtcatcccaccgtaggaaatcatgtcattgtgggggccggtgcgaaggttttagggaacctcgacattgggaatcatgtacggattggtgccggttccattgtgttgcgtagcgtccctagtgattgcacagtggtaggagtccctggtcgaattatctcccgcagcggtcggggttgtccattagaacatggcaaattacccgatgttgagggccaaatcattcggacactattagaccgaattgaagaattggaacaaaagatacaaaaactacattga

SEQ ID NO: 8107 - protein, 236 aa, Gloeothece sp
MFGSLPVRERRGSPSEASISEPRTSRPNLFQSLRQDFQIIFERDPAARNWLEVVCCYPGLHALAIHRISHKLWHHNIPFIPRFLSHIARLFTGIEIHPGAAIGQGVFIDHGMGVVIGETAIVGDYCLIYQNVTLGGTGKETGKRHPTVGNHVIVGAGAKVLGNLDIGNHVRIGAGSIVLRSVPSDCTVVGVPGRIISRSGRGCPLEHGKLPDVEGQIIRTLLDRIEELEQKIQKLH

SEQ ID NO: 8108 - DNA, 954 bp, Oryza sativa subsp
  CDS (1)..(954)
atggcagcctgcgtcgacaagtggccgccggcggcgtacctgtgccgcctgccggagaagttctactgcgtcttgccggactgcaccgctacggaccgtccggtggtcaccgcatcggcggcgccggcgccggcgccggccgctagcgggagcagcggcgactacgtgtgggacgtgctgcgcgccgaggcgcaggacgacgcggacgacgagccgctcctccgcaagttctaccacgacctcgtcctgtcgcggccgtcgctggagtccgcgctcgcctcgctgctggcgaccaagctctgcatccccggcgcgctgccgcaggaccagctccgggacctcctcgccggcgcgctcgccgcgcacccggaggccgggcgcgccgcgcgcgccgacctcgtcgcggcgcgcgaccgcgacccggcctgcgccaagatggtccactgcttcctctactacaagggcttcctggcactgcaggcccaccgcgcggcgcacgcgctctggtccgacaaccgcagggcgccggctctcctcctccagagccgcgcctccgaggtgttcggcgtcgacatccaccccggtgcgcgcattggctgcggcatcctgctcgaccacgccacgggcgtcgtcatcggcgagacggccgtcgtcggctacgacgtgtccatcctgcacggggtgacgctgggcggcacggggaaggagtccggcgaccggcaccccaaggtcggggacggtgtgctgatcggcgccggggcgagcgtgctcggcaatgtgcacattggcgacggagcgaagatcggagccggcgcagtcgtgctacgggacgtggcggacggaaccacggccgtcgggaacccagcgaagccgatcatcggcaagaaggcggcgccgctacggcggccggaagagcttcccggggtaaccatggagcagagatggtcggattga

SEQ ID NO: 8109 - protein, 317 aa, Oryza sativa subsp
MAACVDKWPPAAYLCRLPEKFYCVLPDCTATDRPVVTASAAPAPAPAASGSSGDYVWDVLRAEAQDDADDEPLLRKFYHDLVLSRPSLESALASLLATKLCIPGALPQDQLRDLLAGALAAHPEAGRAARADLVAARDRDPACAKMVHCFLYYKGFLALQAHRAAHALWSDNRRAPALLLQSRASEVFGVDIHPGARIGCGILLDHATGVVIGETAVVGYDVSILHGVTLGGTGKESGDRHPKVGDGVLIGAGASVLGNVHIGDGAKIGAGAVVLRDVADGTTAVGNPAKPIIGKKAAPLRRPEELPGVTMEQRWSD

SEQ ID NO: 8110 - DNA, 945 bp, Oryza sativa subsp
  CDS (1)..(945)
atgccggccggccagccgcacgcgcacgagcccgacggcggcggcgcgagccaccgccggccccagtcgccgccgtcgctccccgcggaggtggtcccggcgttcgcgccgccggagtcggaggacgaggagtcctgggtctggtcccagatcaaggccgaggcgcgccgcgacgccgacgccgagccggcgctcgcgtccttcctctacgccagcgtggctcttcccacccctccctcccgcgctccatctccttccacctcgccaacaagctctgctcctccaccctcctctccacgctcctctacgacctcttcctggcttccttcaccgcgcacccctccctccgcgcgcgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgtcacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttga

SEQ ID NO: 8111 - protein, 314 aa, Oryza sativa subsp
MPAGQPHAHEPDGGGASHRRPQSPPSLPAEVVPAFAPPESEDEESWVWSQIKAEARRDADAEPALASFLYASVALPTPPSRAPSPSTSPTSSAPPPSSPRSSTTSSWLPSPRTPPSARVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 8112 - DNA, 813 bp, Oryza sativa subsp
  CDS (1)..(813)
atgccggccggccagccgcacgcgcacgagcccgacggctgcggcgcgagccaccgccggccccagtcgccgccgtcgctccccgcggaggtggtcccggcgttcgcgccgccggagtcggaggacgaggagtcctggctctgctcctccaccctcctctccacgctcctctacgacctcttcctggcttccttcaccgcgcacccctccctccgcgccgccgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttga

SEQ ID NO: 8113 - protein, 270 aa, Oryza sativa subsp
MPAGQPHAHEPDGCGASHRRPQSPPSLPAEVVPAFAPPESEDEESWLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 8114 - DNA, 747 bp, Magnetospirillum gryphiswaldense
  CDS (1)..(747): transl_table=11
ttgccggccatggttttcaagtctcttcgcgaagatatcgcatcgattcgcagccgcgacccggcggcgcattcgtggatcgaggtggttctgtgctatccgggtctgcacgctttgcttatttatcgcctggcgcattggtgctggggtgtgggtctgaagctgctggggcgggttctttcccacatcggtaaggtttttaccggcatcgaaattcatcccggcgccaccattggccggcgcttgttcatcgaccacggcaccggggtggtgatcggcgaaaccgccatcatcggcgatgacgtcaccctttatcacggggtcaccctgggggggacctcgctgcacaagggcaaacgccatccgaccttggaagacgacgtcatcgtcggttccggcgctcaggtgctggggccgatcaccgtgggcaagggtgcacgcatcggcgccaatgccgtggtgctgaccgaggtgccgcccggcgtcaccatggtcggcatccccgcccgcgcggtcctgcgcaagccgaaggagggcgagcccaccttctgcgcctatggcctggatgacgagaacctgcccgatccggtggctcgggccatcgacaacctgcgcgctcaggtcaacaccctggtcgagcgagtgcaggaactggaagcggagcgcgcggaggaaagccacccccgtcacccccacaacgtggtggtgctgggcgaggacgagcgtaaccacgcggcgtcccaataa

SEQ ID NO: 8115 - protein, 248 aa, Magnetospirillum gryphiswaldense
MPAMVFKSLREDIASIRSRDPAAHSWIEVVLCYPGLHALLIYRLAHWCWGVGLKLLGRVLSHIGKVFTGIEIHPGATIGRRLFIDHGTGVVIGETAIIGDDVTLYHGVTLGGTSLHKGKRHPTLEDDVIVGSGAQVLGPITVGKGARIGANAVVLTEVPPGVTMVGIPARAVLRKPKEGEPTFCAYGLDDENLPDPVARAIDNLRAQVNTLVERVQELEAERAEESHPRHPHNVVVLGEDERNHAASQ

SEQ ID NO: 8116 - DNA, 735 bp, Vitis vinifera
  CDS (1)..(735)
atgagcttaattctgtctcataaatcattggaaagtgccctagccaatcatctttcgatcaaattgagcaattcgagtcttcccagcagtacactctatgatctctttatgggtgtgttggttgaagatggggaaatcatgggagctgttaaagatgatttgagggcagtcaaggagagagacccagcttgcataagctacgtgcagtgtctggtgaatttcaaaggctttttggcatgccaagctcatagagtggcacataggctgtggtcgcaagggagaaaaattctggcattggtaattcagaatagagtgtctgaagcttttgccgtggatatccatcctggggctaagattggaagaggaatattgcttgatcacgcgactggagtcgtcataggggagacagcggtgattggagatgatgtgtcgattttgcataatgtgaccttaggagggactgggaaggtgtctggtgataggcatccgaagcttggcgatggggtgctgattggtgctgggacttgtattttgggaaatgttagaattggggatggggccaaggttggtgctggttcagtggtgttaaaggaagtgcctccgaaaactactgcagttgggaaccccgcaaggttggttggagggaaggagaatccaattaagcttgataagattcccagtttcaccatggaccagacttctcatatctctgagtggtctgattatgttatttaa

SEQ ID NO: 8117 - protein, 244 aa, Vitis vinifera
MSLILSHKSLESALANHLSIKLSNSSLPSSTLYDLFMGVLVEDGEIMGAVKDDLRAVKERDPACISYVQCLVNFKGFLACQAHRVAHRLWSQGRKILALVIQNRVSEAFAVDIHPGAKIGRGILLDHATGVVIGETAVIGDDVSILHNVTLGGTGKVSGDRHPKLGDGVLIGAGTCILGNVRIGDGAKVGAGSVVLKEVPPKTTAVGNPARLVGGKENPIKLDKIPSFTMDQTSHISEWSDYVI

SEQ ID NO: 8118 - DNA, 873 bp, Vitis vinifera
  CDS (1)..(873)
  misc_feature (16)..(16): m is a or c
  misc_feature (55)..(55): s is g or c
atgcctgctggagaamttcggcacccttcgatactgccggccactgagtctggasaagacgaggcctggctttggactcagatcaaagccgaagcgcgtcgagacgctgagtcggaacccgcactcgcgagttacctctactcaacgattctctctcactcgtccctcgaacgctctctctcatttcacctcggcaacaagctctgctcctcgactctgctctctactctcctctacgatctattcctggacaccttctccaaagatgcggagctgcgatccgccaccgtcgccgatctacgcgccaatcatatgcgtgacccggcctgcgtgtcgttctcgcattgtctcctgaattacaagggttttctggcttgccaggctcacagagtggctcacaggctctggactcagatgaggcggccgctcgcgctcgcgcttcagtcgcggattgctgacgtgttcgcggtggatatccacccggcggcgaggattgggaaggggattctgtttgatcacgccaccggagtggtggtcggagagacggcggtgatcggtaacaatgtatcgattctgcatcacgtgacgctcggcggcacgggcaaggccggcggtgaccgccatccaaaaatcggagatggagttctgattggagcgggagcaacgattctggggaacataaagatcggggagggagcgaagataggagcggggtcggtggtgctgatcgatgtgccggcgaggacaacggcggttgggaatccggcgaggctagtgggagggaaagagaagcctgcgaggcatgaggacgtgcctggtgaatcgatggatcatacatcgttcatttctgagtggtcagattatatcatctga

SEQ ID NO: 8119 - protein, 290 aa, Vitis vinifera
  misc_feature (6)..(6): The Xaa at location 6 stands for Ile, or Leu.
MPAGEXRHPSILPATESGZDEAWLWTQIKAEARRDAESEPALASYLYSTILSHSSLERSLSFHLGNKLCSSTLLSTLLYDLFLDTFSKDAELRSATVADLRANHMRDPACVSFSHCLLNYKGFLACQAHRVAHRLWTQMRRPLALALQSRIADVFAVDIHPAARIGKGILFDHATGVVVGETAVIGNNVSILHHVTLGGTGKAGGDRHPKIGDGVLIGAGATILGNIKIGEGAKIGAGSVVLIDVPARTTAVGNPARLVGGKEKPARHEDVPGESMDHTSFISEWSDYII

SEQ ID NO: 8120 - DNA, 735 bp, uncultured bacterium
  CDS (1)..(735): transl_table=11
atgagtatcttcgcccgcatgaacgacgatatccgctcggtgatggagcgcgatcccgccgcgcgtacccggctggaggtcgtgctctgctatccgggcttgtgggcggtctggctgcatcgcatctccagcaagctatggggcggcggcctgcggcttcccgcgcgcatgatctcgcaggtgggacgattcctcaccggggtggatattcatcccggcgccaagctggggcgcaggctcttcatcgatcacgccaccggcgtggtgattggcgaaaccgccatcgtgggcgacgacgtgaccatgtaccagggagtcacgctgggtggcaccggcaagcaacacggaaagcgccacccaaccatctgcgaccgcgtcttcatcggcaacaacgccaacgtgcttggcaatatcacggtgggcgagaactcgcgggtcggggcgggctcagtggtgctcaacgatgtgccgccgaattccaccgtggtcggcgtccccgctcacattgtctacagcaatggccagcgcgtgctgatcaccgatccgcacgagatcaaggatccgctctccgatgcgctgatcgctctctccgcccgcgtggaagagttggaagagcggctgggcgcgcacgagcgctggatgcctccctttgccgaggaagaggcggaacgcaccgcctatcgcgccgaactcgaccaggcgcgcgtctacgtttcgatgggcgaagggatttga

SEQ ID NO: 8121 - protein, 244 aa, uncultured bacterium
MSIFARMNDDIRSVMERDPAARTRLEVVLCYPGLWAVWLHRISSKLWGGGLRLPARMISQVGRFLTGVDIHPGAKLGRRLFIDHATGVVIGETAIVGDDVTMYQGVTLGGTGKQHGKRHPTICDRVFIGNNANVLGNITVGENSRVGAGSVVLNDVPPNSTVVGVPAHIVYSNGQRVLITDPHEIKDPLSDALIALSARVEELEERLGAHERWMPPFAEEEAERTAYRAELDQARVYVSMGEGI

SEQ ID NO: 8122 - DNA, 873 bp, Vitis vinifera
  CDS (1)..(873)
atgcctgctggagaacttcggcacccttcgatactgccggccactgagtctggagaagacgaggcctggctttggactcagatcaaagccgaagcgcgtcgagacgctgagtcggaacccgcactcgcgagttacctctactcaacgattctctctcactcgtcgctcgaacgctctctctcatttcacctcggcaacaagctctgctcctcgactctgctctctactctcctctacgatctattcctggacaccttctccaaagatgcggagctgcgatccgccaccgtcgccgatctacgcgccaatcatatgcgtgacccggcctgcgtgtcgttctcgcattgtctcctgaattacaagggttttctggcttgccaggctcacagagtggctcacaggctctggactcagatgaggcggccgctcgcgctcgcgcttcagtcgcggattgctgacgtgttcgcggtggatatccacccggcggcgaggattgggaaggggattctgtttgatcacgccaccggagtggtggtcggagagacggcggtgatcggtaacaatgtatcgattctgcatcacgtgacgctcggcggcacgggcaaggccggcggtgaccgccatccaaaaatcggagatggagttctgattggagcgggagcaacgattctggggaacataaagatcggggagggagcgaagataggagcggggtcggtggtgctgatcgatgtgccggcgaggacaacggcggttgggaatccggcgaggctagtgggagggaaagagaagcctgcgaggcatgaggacgtgcctggtgaatcgatggatcatacatcgttcatttctgagtggtcagattatatcatctga

SEQ ID NO: 8123 - protein, 290 aa, Vitis vinifera
MPAGELRHPSILPATESGEDEAWLWTQIKAEARRDAESEPALASYLYSTILSHSSLERSLSFHLGNKLCSSTLLSTLLYDLFLDTFSKDAELRSATVADLRANHMRDPACVSFSHCLLNYKGFLACQAHRVAHRLWTQMRRPLALALQSRIADVFAVDIHPAARIGKGILFDHATGVVVGETAVIGNNVSILHHVTLGGTGKAGGDRHPKIGDGVLIGAGATILGNIKIGEGAKIGAGSVVLIDVPARTTAVGNPARLVGGKEKPARHEDVPGESMDHTSFISEWSDYII

SEQ ID NO: 8124 - DNA, 915 bp, Vitis vinifera
  CDS (1)..(915)
atggctgcttgtattgacacttccagagcagagactgcccaaacgaaccaactttcttgcgagccaaacgggtcccaactcgatgatcatatgtacaagttcgcaaatttctgccgacccagtttctctgatcttaatggccgcaaaagaattcacacaagtacactgatttacgaagctaggtctgatgttgagcaagaacccatcttgtcaagctactattacagcttaattctgtctcataaatcattggaaagtgccctagccaatcatctttcgatcaaattgagcaattcgagtcttcccagcagtacactctatgatctctttatgggtgtgttggttgaagatggggaaatcatgggagctgttaaagatgatttgagggcagtcaaggagagagacccagcttgcataagctacgtgcagtgtctggtgaatttcaaaggctttttggcatgccaagctcatagagtggcacataggctgtggtcgcaagggagaaaaattctggcattggtaattcagaatagaattggaagaggaatattgcttgatcacgcgactggagtcgtcataggggagacagcggtgattggagatgatgtgtcgattttgcataatgtgaccttaggagggactgggaaggtgtctggtgataggcatccgaagcttggcgatggggtgctgattggtgctgggacttgtattttgggaaatgttagaattggggatggggccaaggttggtgctggttcagtggtgttaaaggaagtgcctccgaaaactactgcagttgggaaccccgcaaggttggttggagggaaggagaatccaattaagcttgataagattcccagtttcaccatggaccagacttctcatatctctgagtggtctgattatgttatttaa

SEQ ID NO: 8125 - protein, 304 aa, Vitis vinifera
MAACIDTSRAETAQTNQLSCEPNGSQLDDHMYKFANFCRPSFSDLNGRKRIHTSTLIYEARSDVEQEPILSSYYYSLILSHKSLESALANHLSIKLSNSSLPSSTLYDLFMGVLVEDGEIMGAVKDDLRAVKERDPACISYVQCLVNFKGFLACQAHRVAHRLWSQGRKILALVIQNRIGRGILLDHATGVVIGETAVIGDDVSILHNVTLGGTGKVSGDRHPKLGDGVLIGAGTCILGNVRIGDGAKVGAGSVVLKEVPPKTTAVGNPARLVGGKENPIKLDKIPSFTMDQTSHISEWSDYVI

SEQ ID NO: 8126 - DNA, 924 bp, Vitis vinifera
  CDS (1)..(924)
atggagtatcgaatggagaagttgtttcctgtttatgccatgggtctctccaaggccaacgtggggggagatgtttcgcttgaaattttggattctattgtgggtgacccgatctgggacgctgtgagggaggaggccaagttggaggcggagaaggagccaattctaagtagcttcttgtatgccagtattttgtcccatgactgtttagagcaagcattggcatttgttcttgcaaatcgacttcataacctgacactcttggcaacacaattgatggatataattggtaaggtgatactgaatgatagggatattcaacgtgcaattcgcctagatatgcaggcatttaaagatagagatccttcttgtttgtcgcattgctcggttttgttgtatcttaagggttatcattctctgcaatcatatcgagtagcacatgccttatggaaccatgggcgtaaagagttggcattagcattacaaagtcggatcagtgaggtttttggagttgacatccatccagctgcacaaattggagaggaaatacttctggatcatgcaacaggcgtggttataggtgaaactgctgttgtaggaaatagagtttcattaatgcagggagtaactttaggaggaagtggaaaagaaatcggtgatcgtcatccaaaagttgctcaaggtgccctaattggagctagtgcgactatacttgggaatataaaaataggtgaaggtgccatgatagctgctggttcccttgtattaaaagatgttccacctcatagcatggtggcaggaataccggcaaggttgattggacatgtacatgagcaagatccatctctaactatgaagcatggtacgtctaaatatcaacatgcacatcatgcatttttgcaaaatcatttcatccacatctaa

SEQ ID NO: 8127 - protein, 307 aa, Vitis vinifera
MEYRMEKLFPVYAMGLSKANVGGDVSLEILDSIVGDPIWDAVREEAKLEAEKEPILSSFLYASILSHDCLEQALAFVLANRLHNLTLLATQLMDIIGKVILNDRDIQRAIRLDMQAFKDRDPSCLSHCSVLLYLKGYHSLQSYRVAHALWNHGRKELALALQSRISEVFGVDIHPAAQIGEEILLDHATGVVIGETAVVGNRVSLMQGVTLGGSGKEIGDRHPKVAQGALIGASATILGNIKIGEGAMIAAGSLVLKDVPPHSMVAGIPARLIGHVHEQDPSLTMKHGTSKYQHAHHAFLQNHFIHI

SEQ ID NO: 8128 - DNA, 786 bp, Vitis vinifera
  CDS (1)..(786)
atgtttcaggcggagaaggagccaattctaagtagcttcttgtatgccagtattttgtcccatgactgtttagagcaagcattggcttttgttcttgcaaatcgacttcataacccgacactcttggcaacacaattgatggatataattggtaaggtgatactgaatgatagggatattcagcgtgcaatacgcctagatatgcaggcatttaaagaaagagatccttcttgtttgtcacattgctcggttttgttgtatcttaagggttatcattctctgcaatcatatcgagtagcacatgccttatggaaccatgggcgtaaagagttggcattagcatttcaaagtcggatcagtgaggtttttggagttgacatccatccagctgcacaaattggagaggaaatacttctggatcatgcaacaggcgttgttataggtgaaactgctgttgtaggaaatagagtttcattaatgcagggagtaactttaggaggaagtggaaaagaaatcggtgatcgtcatccaaaagttgctcaaggtgccctaattggagctagtgcgactatacttgggaatataaaaataggtgaaggtgccatgatagctgctggttcccttgtattaaaagatgttccacctcatagcatggtggcaggaataccagcaaggttgattggacatgttcatgagcaagatccatctctaaccatgaagcatgatgccaccaaagactactttgaacatgctatggatggacaatctactggtaagttttcttaa

SEQ ID NO: 8129 - protein, 261 aa, Vitis vinifera
MFQAEKEPILSSFLYASILSHDCLEQALAFVLANRLHNPTLLATQLMDIIGKVILNDRDIQRAIRLDMQAFKERDPSCLSHCSVLLYLKGYHSLQSYRVAHALWNHGRKELALAFQSRISEVFGVDIHPAAQIGEEILLDHATGVVIGETAVVGNRVSLMQGVTLGGSGKEIGDRHPKVAQGALIGASATILGNIKIGEGAMIAAGSLVLKDVPPHSMVAGIPARLIGHVHEQDPSLTMKHDATKDYFEHAMDGQSTGKFS

SEQ ID NO: 8130 - DNA, 756 bp, Azotobacter vinelandii
  CDS (1)..(756): transl_table=11
atgttcgaacgcatgcgagaagatatccggagcgttttccagcgcgatcctgccgcgcgcaatgccctcgaggtgctgatctgctatccggggctgcacgcgctgtggctgcatcgcctggcgcacgggctgtggtgctccgactggaagctgctggcgaggctggtttcgcatgtggggcgctggctgaccggcatcgagatccatccgggcgcgcggatcggccggcgcctgttcatcgaccacggcatgggcgtggtgatcggcgagaccgccgagatcggcgacgacgtcaccctctatcacggggtgaccctgggtggtaccagttggaacaagggcaagcgccacccgaccctggaggacggggtgatcgtcggcgccggggcgaagattctcggtcccttcaccgtcggcgccggcgccaagatcggctccaacgccgtggtgacgcgggcggtgccggccggcgccacggcggtggggattcccggacgcatcgtcgccaggccggacgacgaacaggaggccaggcgccgggcgatcgccgagaaatatggcttcgacgccatcgcgctcggccagaacacgccggacccggtggcgcaggccatcggccagttgctcgaccatctgcaggccgtcgacgagcggctcgagggcatgtgtcaggcgctccgggcgctgggcagcgattatcatgccaaggagctgccggcgcttcgcgaggaggatttcgccggccgtcaaggatga

SEQ ID NO: 8131 - protein, 251 aa, Azotobacter vinelandii
MFERMREDIRSVFQRDPAARNALEVLICYPGLHALWLHRLAHGLWCSDWKLLARLVSHVGRWLTGIEIHPGARIGRRLFIDHGMGVVIGETAEIGDDVTLYHGVTLGGTSWNKGKRHPTLEDGVIVGAGAKILGPFTVGAGAKIGSNAVVTRAVPAGATAVGIPGRIVARPDDEQEARRRAIAEKYGFDAIALGQNTPDPVAQAIGQLLDHLQAVDERLEGMCQALRALGSDYHAKELPALREEDFAGRQG

SEQ ID NO: 8132 - DNA, 738 bp, Synechococcus sp
  CDS (1)..(738): transl_table=11
atgtttggatccataccgcttagacacaaccatgctagcagtcgaggccgccccctagaagcctcgactactgctttatcggatacttcttttgagagtttaaccctttggggaaacctaaaacgggattttcagattatctttagacgcgatcccgccgcccgcaattggttagaagtcctctgttgctatccagggtttcacgctttggccttgcatcgcttctcccattggctctggagtcaccaagttcctttttttccgcgttttctttcgcatttagggcgattttttacgggaattgaaatccatccgggggcaaccattggccaaggggtctttattgaccacggaatgggggtcgttattggagaaacggcgattattggggataattgcctgatttaccaaaatgtcaccctagggggaaccgggaaagaaactggaaaacgccatccaactttggggaataatgtggtggtgggggccggggcgaaggttttgggaaatctgaacatcggggatcacgtccgtattggtgcaggttccattgtcctgcgagatgttcccagtgattgtacggtggtaggagtaccgggtcggattatttcgggtagtggtcggggttgtcccctcgaacacggaaaattgcccgatatcgaagctcaagtgatgcgcagcttactcgatcgcatcgagcaattggaacaaaagatacagaatttaccctcaccctag

SEQ ID NO: 8133 - protein, 245 aa, Synechococcus sp
MFGSIPLRHNHASSRGRPLEASTTALSDTSFESLTLWGNLKRDFQIIFRRDPAARNWLEVLCCYPGFHALALHRFSHWLWSHQVPFFPRFLSHLGRFFTGIEIHPGATIGQGVFIDHGMGVVIGETAIIGDNCLIYQNVTLGGTGKETGKRHPTLGNNVVVGAGAKVLGNLNIGDHVRIGAGSIVLRDVPSDCTVVGVPGRIISGSGRGCPLEHGKLPDIEAQVMRSLLDRIEQLEQKIQNLPSP

SEQ ID NO: 8134 - DNA, 1044 bp, Spinacia oleracea
  CDS (1)..(1044)
atgttggcggtttcatatgccattccgtcttgctgcattaacagattttatatccgagaattttcaagttctcttcaaccggccctccaccacccctggtacaagaagagattcgggtgctgctccaccaatcaggaaaattgcagtttaggttctcccacacatctccctagaatgccaggaggggatttgagtgttgcaccatcagtgggtcatttaacagcaaataacgaggcgtggttgtgggatcagataaagggtgaagcccgtcgtgatgctgattcagagcctgcacttgcctcttatctatactccacaatcctttcacactcctctctagaacggtcactctccttccacctaggaaacaagctgtgttcctccactttgctgtcaactcttctttatgatctcttccttaacatcttatcatctgattcttctctgcttgatgctgttgttgctgatttacgtgctgccagagtacgtgacccagcttgtgtatccttttctcactgccttctaaactacaaggggttcttagcatgtcaatcacaccgtgtggcccacaaactatggaatcaagatagacggcctcttgcacttgcacttcactccagaatatctgatgtatttgctgttgatatccaccctgctgctagaattgggaaggggatactctttgatcatgctactggtgttgttattggagagacagcaataattggtgacaactgttcgatattacatcacgtgacacttggtggaacaggaaaagctggaggtgaccgtcacccaaaagtcggtgatggagttttaataggtgctggggcaacaatcctgggtaatgttaggattggtgatggagcaaagataggtgcaggatcagtagtgctcattgatgttcctcctagaacaacagctgtgggtaatccagctagattaatcggtggcaaagagaaaccgtcacagaattcagatgttcctggagagtctatggatcacacttcatttatttcagagtggtccgattatatcatttaa

SEQ ID NO: 8135 - protein, 347 aa, Spinacia oleracea
MLAVSYAIPSCCINRFYIREFSSSLQPALHHPWYKKRFGCCSTNQENCSLGSPTHLPRMPGGDLSVAPSVGHLTANNEAWLWDQIKGEARRDADSEPALASYLYSTILSHSSLERSLSFHLGNKLCSSTLLSTLLYDLFLNILSSDSSLLDAVVADLRAARVRDPACVSFSHCLLNYKGFLACQSHRVAHKLWNQDRRPLALALHSRISDVFAVDIHPAARIGKGILFDHATGVVIGETAIIGDNCSILHHVTLGGTGKAGGDRHPKVGDGVLIGAGATILGNVRIGDGAKIGAGSVVLIDVPPRTTAVGNPARLIGGKEKPSQNSDVPGESMDHTSFISEWSDYII

SEQ ID NO: 8136 - DNA, 855 bp, Ostreococcus tauri
  CDS (1)..(855)
atgtcgcgcacgcgcatcgacctgagcaaggtggcgatggaacgcgcgacgtcgacgacgcgggcgtcgagcggggacgagatatgggcctcgctgcgacagggagggcaggagttggtggaaaaggagccgctcatgggggggttcgtgtacgcgacgattctgaaccagccgacgtttgagcgcgcgttggcgtttttggtggcgtctaaaatcgcgaacgcgacgatacttcagggacagtggaacgatttgatcatggaggcgctcaacgcgacgaatgaggaggggaatcgcgtgcagaacggaccggggacgggttcgatctcagaggcggcgagggaggatttgaaggctatcgtcgagcgggacccggcgtgtccttcgtacacgcacgcattctgcttcttcaaggggtttcagggcttacaggcccagcgcgtctctcactggctctggggtcatcaccgaaaagttttggcgtgcaagatgcagagcttggtctcggaggttttcaacatggatctgcacccagctgcaaagtttggaagaggaatcatgatagaccacggacacggggtcgtcgtcggcgagacggcggtcgtcgacgacggctgcacgctcctgcacggcgtcaccctcggtggcactggaaaggttaggggcgaccgccatcccaagctcggtaaacgagtcgtcgtgggttcgaacgcgagcgtgctcggaaacattaccgtcggacatgattgtaaaattggcgcgggcgcggcgctcatgcatgacttgccgccgaacaccaccgtggtcggccacaagggacgcgtcgtgacgaagaagacgatgtcaaagctctaa

SEQ ID NO: 8137 - protein, 284 aa, Ostreococcus tauri
MSRTRIDLSKVAMERATSTTRASSGDEIWASLRQGGQELVEKEPLMGGFVYATILNQPTFERALAFLVASKIANATILQGQWNDLIMEALNATNEEGNRVQNGPGTGSISEAAREDLKAIVERDPACPSYTHAFCFFKGFQGLQAQRVSHWLWGHHRKVLACKMQSLVSEVFNMDLHPAAKFGRGIMIDHGHGVVVGETAVVDDGCTLLHGVTLGGTGKVRGDRHPKLGKRVVVGSNASVLGNITVGHDCKIGAGAALMHDLPPNTTVVGHKGRVVTKKTMSKL

SEQ ID NO: 8138 - DNA, 1047 bp, Ostreococcus tauri
  CDS (1)..(1047)
atgttctccgcgcgatgcgcccgggcgggagcgaggacgagcgcgcgcgaggcggtgggggggcgacgaggatggattccgcgcgagggcgcggcggcgtggacgcgcgcgcgaacgaccggcgcgcgcgccgtgagcgatggacgcgagctcgacgacgcggcgaaggcgaagaaagagcgagagtacgcggtgaagtggacgggatcaccggcgggggacgaggacgggagggcggacgcggagcggacgcggagcggggacgacgcgagcgcgcgaggggagagctgtttgctcggagatggaatctggatgcgtctgcgcgaggaggcgaagagcgacatcgatggtgaaccggcgctggcgagttacctgtactccaccgtgctcgcgcacaggagcatcgaggacgtgttggctttcgtgttggcgaacaagctgcggaacaacgtcttgctcgattcgcaattgctcgagctcttcagttcgcagtacaaaaagtatcccgagctcggaaagatgtgccttgcggacatgcaggcggtgttcgagcgcgatcccgcgtgcgaccggtacctgtgcgtcgtgctcttcttcaaggggttccaagcgattcaggcgcacgcgtgcgcactcctgtggctaaggatcgcaaggcgctcagtttctgttgcagaatcgcatatccgaggtggaatgatgatggatcacgccacgggcgtcgtcatcggcgagacagccgtcgtgggcgaaaacgtctcgattctgcacggcgtcaccctcggcggtacggggacgaacaaaggcgatcgtcacccgaagatcggcgacggcgtcgtcatcggggctaacgtcaccattctgggtcccatacatgtcggaagcgacagtaaaattggcgccggttccgtcgtcttggacaacattcccgacggctccaccgccgtcggcatcccggccaaggttatcaatcgcagctcgccgcagcaatcccagccgtcgctttcgatggatcaaacgtcgtatatcaccgattacttcatctga

SEQ ID NO: 8139 - protein, 348 aa, Ostreococcus tauri
MFSARCARAGARTSAREAVGGRRGWIPREGAAAWTRARTTGARAVSDGRELDDAAKAKKEREYAVKWTGSPAGDEDGRADAERTRSGDDASARGESCLLGDGIWMRLREEAKSDIDGEPALASYLYSTVLAHRSIEDVLAFVLANKLRNNVLLDSQLLELFSSQYKKYPELGKMCLADMQAVFERDPACDRYLCVVLFFKGFQAIQAHACALLWLRIARRSVSVAESHIRGGMMMDHATGVVIGETAVVGENVSILHGVTLGGTGTNKGDRHPKIGDGVVIGANVTILGPIHVGSDSKIGAGSVVLDNIPDGSTAVGIPAKVINRSSPQQSQPSLSMDQTSYITDYFI

SEQ ID NO: 8140 - DNA, 918 bp, Musa balbisiana
  CDS (1)..(918)
atgccgacggagaagacgaaccagaacggcctcgccgcctcggccccggcggcagctgcgcggcacgcgatcccgacgtacccgccgccggagtcggagtcggaggagtcgtgggtgtgggcgcagattaaggcggaggcccaccgggacgcggagtcggagccggcgctggcgagcttcctctacgccacggtgctctcccacaactccctggccttctccctcgccttccacctcgccaacaaactctgctcctccactctcctctccaccctcctctacgacctcttcctccagtccttttcctccaagccctccctcatctccgctgttgtcgcggacctcctcgctgttcgccaccgcgaccccgcctgcgtctccttctcccactgcctcctcaactacaagggcttcctcgccgtccaggctcaccgcgtgtcccacctcctctggggccagcaccgccgccccctcgccctcgccctccagtcccgcatcgccgacgttttcgccgtcgacatccaccccgccgcccgtatcggcaagggcatcctcctcgaccacgccaccggcgtcgtcgtcggcgagaccgccgtgatcggcaacaacgtctccatcctccaccacgtcaccctcggtggcaccggcaaggccgtcggcgaccgccacccgaagatcggcgacggcgtcctcatcggagccggcgctaccatcctcggcaacatccggataggggagggggccaagatcggtgccgggtccgtcgtcctcatcgacgtgcccccgaggaccacggtcgtcgggaaccctgcccggctcgtcggggggaaggacaagcccgcgaggcacgacgatgtgccaagcgaatccatggatcacacttccttcatccaggagtggtccgactacatcatctga

SEQ ID NO: 8141 - protein, 305 aa, Musa balbisiana
MPTEKTNQNGLAASAPAAAARHAIPTYPPPESESEESWVWAQIKAEAHRDAESEPALASFLYATVLSHNSLAFSLAFHLANKLCSSTLLSTLLYDLFLQSFSSKPSLISAVVADLLAVRHRDPACVSFSHCLLNYKGFLAVQAHRVSHLLWGQHRRPLALALQSRIADVFAVDIHPAARIGKGILLDHATGVVVGETAVIGNNVSILHHVTLGGTGKAVGDRHPKIGDGVLIGAGATILGNIRIGEGAKIGAGSVVLIDVPPRTTVVGNPARLVGGKDKPARHDDVPSESMDHTSFIQEWSDYII

SEQ ID NO: 8142 - DNA, 738 bp, Candidatus Kuenenia stuttgartiensis
  CDS (1)..(738): transl_table=11
atgtttggccgattaagagaggacattgatgccgttttccaaaatgaccccgctgcaaaaagcaaatttgaaatagttttctgttatcccggattacatgctttatggctattcaggatatcttcatttttctggaagaaacaatggtatttcaccgcccgttttctttcccacattaatcgttttttaacagggatagaaatccatccggccgcacaaatcggacgaggagtttttatagaccacggcatgggagtcgttatcggagaaacggcaacggtcggcgatggttgtcttatttacaagggagtagtgcttggagggacatcttttgaaaagacaaagagacatccaacgttaggaaaaaaggtcattgtaggctcaaatgcttgtgttttaggcaatatttccataggagataatgtacgcataggttccggttcggtagtagtaaaagacgtccccgctaatgctacggtggtaggtgtacccggaagaattatcgaaagaagcaaaaacaaggatcacgaggtaatgttagaccatggacaactgcccgatccgattgcagaggcctttagagcgctaattaaagaaaacaataaacttctaacgcgtatcaaaaaattggaggaaagtttaaatattgtaagcaatgacaatagccgggaatctaacacagaatcaataatcatgacaacatttatgaaaaattaccataatggcgaggggatctaa

SEQ ID NO: 8143 - protein, 245 aa, Candidatus Kuenenia stuttgartiensis
MFGRLREDIDAVFQNDPAAKSKFEIVFCYPGLHALWLFRISSFFWKKQWYFTARFLSHINRFLTGIEIHPAAQIGRGVFIDHGMGVVIGETATVGDGCLIYKGVVLGGTSFEKTKRHPTLGKKVIVGSNACVLGNISIGDNVRIGSGSVVVKDVPANATVVGVPGRIIERSKNKDHEVMLDHGQLPDPIAEAFRALIKENNKLLTRIKKLEESLNIVSNDNSRESNTESIIMTTFMKNYHNGEGI

SEQ ID NO: 8144 - DNA, 885 bp, Citrullus lanatus
  CDS (1)..(885)
atgccagttggtgagcttcgattttcgtctcagtcttcaacgacggtggtggagtctactacaaacaacgacgagacatggttgtgggggcagattaaagcagaggcgcggcgagatgccgagtcagagccggcattggctagctatctttactcgacgattttgtcacattcatcgctcgagagatcgctttcgtttcatttggggaacaaactttgctcctccacgcttctttctactctcctttacgatcttttcctcaatgctttctccactgattactgtctaagatcagctgttgtcgcggatttgcaagcagctcgtgaacgtgacccagcctgtgtttcattctcacattgcctcctcaattacaaaggattcttagcctgccaggctcatcgtgtggctcacaagctgtggaatcaatcacgtaggccgctagcactggcacttcaatctcgcattgctgatgtcttcgccgttgacattcaccctgcagcaagaattgggaaaggcattctgtttgatcatgctaccggtgtagtggtgggtgagacggcagtgataggcaacaatgtctcaattcttcatcatgtcactcttggagggacaggaaagatgtgtggagacaggcatccaaagattggggatggtgttttaatcggtgctggagcgaccattcttggcaatgttaagattggagaaggagccaagatcggggcaggatcggtggtgctcattgatgtgccaccacgaactactgccgtgggcaatcccgcaaggctggtggggggaaaggagaagccatcacagctcgaggatattcctggagagtccatggaccatacatctttcatatccgaatggtcagattacataatttga

SEQ ID NO: 8145 - protein, 294 aa, Citrullus lanatus
MPVGELRFSSQSSTTVVESTTNNDETWLWGQIKAEARRDAESEPALASYLYSTILSHSSLERSLSFHLGNKLCSSTLLSTLLYDLFLNAFSTDYCLRSAVVADLQAARERDPACVSFSHCLLNYKGFLACQAHRVAHKLWNQSRRPLALALQSRIADVFAVDIHPAARIGKGILFDHATGVVVGETAVIGNNVSILHHVTLGGTGKMCGDRHPKIGDGVLIGAGATILGNVKIGEGAKIGAGSVVLIDVPPRTTAVGNPARLVGGKEKPSQLEDIPGESMDHTSFISEWSDYII

SEQ ID NO: 8146 - DNA, 798 bp, Azotobacter vinelandii
  CDS (1)..(798): transl_table=11
atgagtctgcttacgcaatggcgtgatgacatccgctgcgtcttcgagcgcgacccggcggcacgcaccaccttcgaggtgctcaccacctatccgggggtgcacgcgatcatcggctaccggctggccaatcgcctgtggcgtgccgcgtggcgctatccggcacgtctgctgtcgttcgtcgcccgcatgctgagcaacgtggacattcacccgggggcgaccatcggcgagcgtttcttcatcgatcacggcgcctgcgtggtgatcggcgaaaccgccgagatcggcaacgacgtgaccctctaccatggcgtgactctcggcggcaccagttggaacaagggcaagcgccatccgacgctgagggacggcgtgctggtgggcgcgggagccaagattctcggtcccatcaccgtgggcgcgggcgcccgggtgggggccaactccgtggtggtccaggatgtgccggacggttgcaccgtggtcggcatccccggcaaggtagtcaaggtgcgcgaggccggccgcccgaatccctatggcatcgacctcgaccatcacctgattccggacccggtgggcaaggccatcgcctgcctgctggagcgcatcgatgcgctggagaagcaggtcgaggcgggtgggctggtcaccgtcggcagccagcagcagttctaccaggtctgtaactccgacaacagcatttgcgagagcgactgcgccggtggcaccactgcgcaggctcaacaatcggccggtcgccgtcgggccgtacccactccggtggccgagtga

SEQ ID NO: 8147 - protein, 265 aa, Azotobacter vinelandii
MSLLTQWRDDIRCVFERDPAARTTFEVLTTYPGVHAIIGYRLANRLWRAAWRYPARLLSFVARMLSNVDIHPGATIGERFFIDHGACVVIGETAEIGNDVTLYHGVTLGGTSWNKGKRHPTLRDGVLVGAGAKILGPITVGAGARVGANSVVVQDVPDGCTVVGIPGKVVKVREAGRPNPYGIDLDHHLIPDPVGKAIACLLERIDALEKQVEAGGLVTVGSQQQFYQVCNSDNSICESDCAGGTTAQAQQSAGRRRAVPTPVAE

SEQ ID NO: 8148 - DNA, 936 bp, Thlaspi goesingense
  CDS (1)..(936)
atgccgccggccggagaactccgtcatcaacctccttcagaggatacacagtctacagatactccatctgccgaagcagcagctgcggcagcgatattagcggcagctgcagattcggaggctgctggattatggacacagatcaaagcggaagctcgccgcgacgctgaggcggagccggcgttagctagctatctctactcgacgattctctctcattcttctctcgagcgatcgatctcgttccatttgggaaacaagctctgctcctcgacgcttctctccacgcttttatacgatcttttcttaaacaccttcacctccgatccatctctgcgcaacgccaccgtcgcagatcttcgcgctgctcgcgttcgtgatccggcttgcatctcgttctcgcattgcctcctcaattataaaggcttcttagcaattcaggcgcatcgtgtgtcacacaagctatggacgcaatcgcggaagccattagcgttagctctccactcgagaatctccgacgtattcgccgtcgatatccatcccgcggcgaggatcggaaaagggatacttctcgaccacgcaacgggagtcgtcatcggagaaacagctgtgatagggaacaacgtatcgatcctccaccacgtgacgctcggtggaaccggtaaagcttgcggagacagacatccgaagatcggcgacggttgcttgatcggagctggggcgactattctcgggaacgtgaagatcggcgcaggagctaaagtaggagctggatccgtggtcctgatcgacgtgcctccgcgagctacggcggttgggaatccggcgaggctcgtgggagggaaagagaaaccaacgattcatgatgaggaatgtcccggagaatcgatggatcacacttccttcatctcggaatggtcagattacattatttga

SEQ ID NO: 8149 - protein, 311 aa, Thlaspi goesingense
MPPAGELRHQPPSEDTQSTDTPSAEAAAAAAILAAAADSEAAGLWTQIKAEARRDAEAEPALASYLYSTILSHSSLERSISFHLGNKLCSSTLLSTLLYDLFLNTFTSDPSLRNATVADLRAARVRDPACISFSHCLLNYKGFLAIQAHRVSHKLWTQSRKPLALALHSRISDVFAVDIHPAARIGKGILLDHATGVVIGETAVIGNNVSILHHVTLGGTGKACGDRHPKIGDGCLIGAGATILGNVKIGAGAKVGAGSVVLIDVPPRATAVGNPARLVGGKEKPTIHDEECPGESMDHTSFISEWSDYII

SEQ ID NO: 8150 - DNA, 960 bp, Thlaspi goesingense
  CDS (1)..(960)
atggcaccgtgcatcgacacttccagaaccggaaaaacccagctctctcaaaacgatgattctggtttccgttacctgaatttctgtggacccggtttctctgagcggatttcacgcgggaaccacacgaaaacccaaacagacgacgatgtctggcttaagatgcgagaagaagctaaatctgacgtcgagcaagaacccattttgtcgagctactatgacgcttccattacatcgcatccatcgttggatcatgctttggcgagcatcctctccgtaaagctcagtaatctgaccttaccaagcgacacgctttttgaattgttcatcagcgttttacaagaaagccctgaaactgaaatcattgactcggtgaagcaagatctactagcagccaaggaaagagacccagcttgtgtaagctacgtccactgcttcctgagcttcaagggcttcctcgcgtgtcaagctcatcgaatcgctcacaaactctggactcaggacagaaaaatgctagctttactgatccagaacagagtatcggaggttttcgccgtcgattttcacccaggggcgaggatcggaaaagggattttgttagaccacgcgacggccgtggtgatcggcgagacggcggtggttggagacaatgtttcgattctccacggcgtgacgctcggaggaacagggaaacagtgcggcgaccggcatccgaagattggtgatggagtcttgatcggagccgggacttgtatattggggaatataacaatcggtgagggagttaaaattgggtcgggttcggtggtgctgaaggacgtgccgccgcgtacgacggcggtaggaaatccggcgagattgattggtgggaaagagaatccgacaaaacacgacaagattcccggtctgaccatggaccaaacatcgcatatgaccgagtggtctgattacgttatctaa

SEQ ID NO: 8151 - protein, 319 aa, Thlaspi goesingense
MAPCIDTSRTGKTQLSQNDDSGFRYLNFCGPGFSERISRGNHTKTQTDDDVWLKMREEAKSDVEQEPILSSYYDASITSHPSLDHALASILSVKLSNLTLPSDTLFELFISVLQESPETEIIDSVKQDLLAAKERDPACVSYVHCFLSFKGFLACQAHRIAHKLWTQDRKMLALLIQNRVSEVFAVDFHPGARIGKGILLDHATAVVIGETAVVGDNVSILHGVTLGGTGKQCGDRHPKIGDGVLIGAGTCILGNITIGEGVKIGSGSVVLKDVPPRTTAVGNPARLIGGKENPTKHDKIPGLTMDQTSHMTEWSDYVI

SEQ ID NO: 8152 - DNA, 1188 bp, Thlaspi goesingense
  CDS (1)..(1188)
atgttcccggtcacaagtcgccgccacttctctttctccctatatatgctccgttcatcttctccacacacccatgtcctctactcttcctctttcctcccttcatttgtctcatccaggtcctctgcacccaaacataaccgaaaaaccttaccccctccaatggcggcgtgtatcgacacgtgcagaaccgggaaacctcagatttcttctcgcgattctaccaggtctcacgacgatgaatccggtttccgttacctgaattactaccgtaccggttacccggaccgagtttcgcgagctccgatcaacgggatccagaccagaaccctccacacccgcccgctcgttgaagatctcgaccgagacgccgaaatcgacgatgtctgggagaaaatccgcgaagaagccaagtccgatatccagcgagaacctattgtttccggctattatcacgcatcgattgtctcccagcgatccttggaggcggcgttggcgaacactctatcggttaaactcagcaacttgaaccttcccagcaacacgctcttcgatttgttcaacggcgttctcgaagaacacccagaaatcgttgaatgtgtgaagcaagatctgatagcggtcaaggaaagagacccagcttgcataagctacgtccattgtttcctacacttcaaaggcttcctcgcctgccaagcgcatcgaattgctcatgagctctggacgcaggaccggaaaatcctcgctttgttgatccagaacagagtatcggaggccttcgccgttgatttccaccctggggccaaaatcggaaccgggattttgctcgaccacgctaccgccatcgtcatcggcgagacggcggtggtggggaacaacgtctctatcctccacaacgtaacgctcggaggaacggggaaacagtgcggagacaggcacccgaagatcggcgacggggtcttgattggagctgggacgtgtattttggggaatataacgattggagagggagccaagatcggtgctggctcggtggtgctgaaggacgtgccgccgcgtacgacggctgtgggaaatccggcgagattgcttggtggcaaagataatccgaaaaagcacgacaagatacctggcctgaccatggaccagacgtcgcatatatccgagtggtcggattatgtaatttga

SEQ ID NO: 8153 - protein, 395 aa, Thlaspi goesingense
MFPVTSRRHFSFSLYMLRSSSPHTHVLYSSSFLPSFVSSRSSAPKHNRKTLPPPMAACIDTCRTGKPQISSRDSTRSHDDESGFRYLNYYRTGYPDRVSRAPINGIQTRTLHTRPLVEDLDRDAEIDDVWEKIREEAKSDIQREPIVSGYYHASIVSQRSLEAALANTLSVKLSNLNLPSNTLFDLFNGVLEEHPEIVECVKQDLIAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKKHDKIPGLTMDQTSHISEWSDYVI

SEQ ID NO: 8154 - DNA, 681 bp, uncultured marine bacterium 580
  CDS (1)..(681)
atgtttaaaaaatttaaagaagacctttccattgtttttgaaagagatcctgcagcccgttcctacttagaaatattgaccacttatcccggtgtgcatgcgattttaattcatcggctttcacataaattatggacaattaaacttttttggttgggcaggtttttatctcatatcagtcggtttctaacagggattgagattcatccaggcgcacaaattggaagtagatgttttattgatcatggtatgggtgtagtgattggtgaaacctcaattattggcgatgattgcacactttatcatggcgtcactttaggtggcacatcctggaaacagggtaaaaggcacccgacattagaaaataaagtggtgattggtgcaggagcaaaggttttaggtcctattacgattaaagctggagctagaattggttcaaatgcagtcgtcgtaagtgatgtcacaaaagatgcaacagtcgtcgggatccctgctcgtgctgtcaaggaaactaaaaaaggaacaacctttagaccttatgccgtgggtaaagatgaagatgatccaatggtaaaatcaatccaagcgcttattaacaaagtcgcaaaacaagaaagagagattgaagcgctcactaagaaaaaagataagcctaaaaaagcgcctccaaagagcacttaa

SEQ ID NO: 8155 - protein, 226 aa, uncultured marine bacterium 580
MFKKFKEDLSIVFERDPAARSYLEILTTYPGVHAILIHRLSHKLWTIKLFWLGRFLSHISRFLTGIEIHPGAQIGSRCFIDHGMGVVIGETSIIGDDCTLYHGVTLGGTSWKQGKRHPTLENKVVIGAGAKVLGPITIKAGARIGSNAVVVSDVTKDATVVGIPARAVKETKKGTTFRPYAVGKDEDDPMVKSIQALINKVAKQEREIEALTKKKDKPKKAPPKST

SEQ ID NO: 8156 - DNA, 882 bp, Beta vulgaris
  CDS (1)..(882)
atgccaggaggggaagtcagtgcgccttcatcagtggttctgccgacagcagaatccattgaaaatgacgaggcctgggtgtggggccagatcaaggctgaagcccgtcgtgatgctgactcagaacctgcacttgcctcctacctctactccacaatcctttctcattcctctttggaaagatcgctatccttccacctaggcaataaactgtgctcctccactttgctgtcgaccctcctgtacgacctcttccttaacatcttctcgtccgattcttctctgcgtgttgctgttgttgcagatttacgtgctgccagagtccgtgacccagcatgtgtctccttctctcactgtcttctcaactataaaggttttttggcttgtcaggctcaccgtgtggcccacaggctctggaatcaggaacgacagccccttgcacttgctcttcactcccgaatatccgatgtctttgctgtcgatatccaccctgcagctcgaattggaaaggcaattctctttgaccatgccactggggtggttattggagagacagcagtaataggtgacaactgctcgattttacaccatgtgaccctcgggggaacaggaaaagctgtgggtgatcgtcacccaaaggttggtgatggagttctaattggtgctggggcaacaattttgggtaacattaagattggtgatggggcgaagattggggcgggatcagtggtgctgattgatgttcctccaagggcaacagcagtgggaaacccagcacggttgctcggagggaaagagaaaccgtcgaggaatgtggatgtgccaggagagtctatggatcacacttcttttatttcagagtggtccgattacattatatga

SEQ ID NO: 8157 - protein, 293 aa, Beta vulgaris
MPGGEVSAPSSVVLPTAESIENDEAWVWGQIKAEARRDADSEPALASYLYSTILSHSSLERSLSFHLGNKLCSSTLLSTLLYDLFLNIFSSDSSLRVAVVADLRAARVRDPACVSFSHCLLNYKGFLACQAHRVAHRLWNQERQPLALALHSRISDVFAVDIHPAARIGKAILFDHATGVVIGETAVIGDNCSILHHVTLGGTGKAVGDRHPKVGDGVLIGAGATILGNIKIGDGAKIGAGSVVLIDVPPRATAVGNPARLLGGKEKPSRNVDVPGESMDHTSFISEWSDYII

SEQ ID NO: 8158 - DNA, 942 bp, Zea mays
  CDS (1)..(942)
atggctgcctgtgtcgacaagtggcaccccacgcacgccggccgcctcaccggcgccatctaccgctacttgccggacggcgccacggaccgcgcggtggccgccgccgccgccgcgccggcgtccgcgagcggcggcgacgacgacgacgtctgggacgagctgcgcgcggaggccgaggccgacggcgacgccgagcctctgctccgcaagtactacgccgacctcgtcctgtcgcgcccgtcgctggaggccgccctcgccgcgcacctgtcggccaacgtctgcgtccccggcgcgctgccgcaggacgcgctccgggacctcctggccgccgcactggccgcgcgcccggagtccggcccggccgcgcgcgccgacctcccggcggcgcgcgaccgcgacggctgcggccggatggtgcactgcttcctctactacaagggcttcctcgccctgcaggcgcaccgcgccgcgcacgggctgtggtgcgagggcccgtccgcgccggccttcctcctccagagccgcgcgtccgaggtgttcggcgtcgacatccaccccggcgcgcgcattggttcggggatcctgttcgaccacgccacgggcatcgtcatcggcgagacggccgtcgttgggaacgacgtctccatcctgcacggcgtcaccctcggcggcacgggaaaggagtccggcgaccggcacccgaaggtcggggacggggtgctgatcggcgccggcgccagcgtgctcggcaatgtgcgcgttggagccggggcgaagattggagcaggggcggtcgtgctacgggacgtgccggaggggaccacggccgtcgggaaccccgccaaggcggtcgggaagaaggcggcgccgcagcggcggccggaagagcagcctggggtcaccatggagcaagggtggtcggcatacgtgatttga

SEQ ID NO: 8159 - protein, 313 aa, Zea mays
MAACVDKWHPTHAGRLTGAIYRYLPDGATDRAVAAAAAAPASASGGDDDDVWDELRAEAEADGDAEPLLRKYYADLVLSRPSLEAALAAHLSANVCVPGALPQDALRDLLAAALAARPESGPAARADLPAARDRDGCGRMVHCFLYYKGFLALQAHRAAHGLWCEGPSAPAFLLQSRASEVFGVDIHPGARIGSGILFDHATGIVIGETAVVGNDVSILHGVTLGGTGKESGDRHPKVGDGVLIGAGASVLGNVRVGAGAKIGAGAVVLRDVPEGTTAVGNPAKAVGKKAAPQRRPEEQPGVTMEQGWSAYVI

SEQ ID NO: 8160 - DNA, 933 bp, Zea mays
  CDS (1)..(933)
atgacggccgggcagcttctgcgcaccgagccatcagcccagccccagcgggtgcgccacagcaccccgccggcggcactccaagcagacatcgtgccgtcgtacccgccgcccgagtcggacggtgacgagtcgtgggtctggtcccagatcaaggcggaggcgcggcgcgacgcggacgcggagccggcactggcctccttcctctacgcgacggtgctgtcgcacgcgtccctggaccggtccctggccttccacctggccaacaagctgtgctcctccacgctgctgtcgacgctcctctacgacctcttcgtggcgtcgctcgcggacgacccgtccgtccgcgcggcggcggtggccgacctgatcgccgcgcggtcgcgggacccggcctgcgcgggcttcgcgcactgcctcctcaactacaaggggttcctggccgtgcaggcgcaccgcgtggcgcacgtgctgtgggcgcagggccggcgcgcgctggccgtggcgctccagtcccgcgtcgccgaggtcttcgccgtggacatccacccggccgccaccgtcggcaggggcatcctgctcgaccacgccacgggcgtcgtcgtcggggagacggccgtcgtgggcgacaacgtctccatactccaccacgtgacgctgggcggcaccggcaaggcggtgggcgaccggcaccccaagatcggggacggcgtgctcatcggcgccggcgcgaccgtcctcggaaacgtcaggatcggtcgcggcgccaaggtcggcgcggggtccgtcgtcgtcatcgacgtgccgcccaggagcaccgccgtggggaaccccgccaggctgatcgcgcggaagaagggcgaggaggtgatgccgggggagtccatggaccacacctccttcatacagcagtggtcggactacatcatttga

SEQ ID NO: 8161 - protein, 310 aa, Zea mays
MTAGQLLRTEPSAQPQRVRHSTPPAALQADIVPSYPPPESDGDESWVWSQIKAEARRDADAEPALASFLYATVLSHASLDRSLAFHLANKLCSSTLLSTLLYDLFVASLADDPSVRAAAVADLIAARSRDPACAGFAHCLLNYKGFLAVQAHRVAHVLWAQGRRALAVALQSRVAEVFAVDIHPAATVGRGILLDHATGVVVGETAVVGDNVSILHHVTLGGTGKAVGDRHPKIGDGVLIGAGATVLGNVRIGRGAKVGAGSVVVIDVPPRSTAVGNPARLIARKKGEEVMPGESMDHTSFIQQWSDYII

SEQ ID NO: 8162 - DNA, 870 bp, Zea mays
  CDS (1)..(870)
atgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgtcccacccgtccctgccccgctccctctccttccacctcgccaacaagctctgctcctccacgctcctctccacgctcctctacgacctcttcctcgccacgctcaccgcgcacccctctctccgcgccgccgtcgtcgccgacctcctcgcggcccactcccgcgaccccgcctgcgtcggcttctcccactgcctcctcaactacaagggcttcctcgccatccaggcccaccgcgtcgcgcacgtgctctgggcgcagcagcgacggcccctcgcgctcgcgctccagtcccgcgtcgccgacgtcttcgccgttgacatccaccccgccgccgtcgtcgggaagggaatcctcctcgaccacgccaccggcgtcgtcatcggtgagacggccgtcgtcggcgacaacgtctccatcctccaccacgtcaccttgggcgggaccgggaaggcggtgggtgaccggcaccccaagattggggatggcgtgctgattggagcaggggccaccattcttggtaacgtgaaaattggtgccggggctaagattggagccggatccgtggtgctgatagatgtgccggcgaggagcacggcggttggaaccctgccaggctga

SEQ ID NO: 8163 - protein, 289 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGTLPG

SEQ ID NO: 8164 - DNA, 858 bp, Glycine max
  CDS (1)..(858)
atgccgacggggttaccggcggcgaattccttagtggcgccggacgaagaggggtgggtgtgggggcagatcaaggcggaggcgcgccgcgacgccgagtcggagcctgctttggcgagctacctctactcgacgatcctctcgcactcgtcgctcgagcgttctctgtcttttcacctcggaaataagctctgttcctccacgcttctctcgacgctcctttacgacctgttcctcaacgccttctcctccgacccctccctccgctccgccgccgtcgccgatctccgcgctgcccgcgaacgcgaccccgcctgcgtctcctactcccactgcctcctcaattacaaaggcttcctcgcttgccaggcgcaccgtgtggcgcatctgttgtggcggcaatcacggcggccgttggctttagcgctgcactctcgcatcgcaaatgtgtttgcggtggacattcacccggcggcaaggattgggaaggggattctgttcgaccatgccactggggtggtggaggggagacaccggaatcgggaacaatgtgtcgatcctgcaccatgttctctgggtgggactggcaaggttggtggagaccggcatcctaagattggggatggggtgcttattggtgctggtgctaccattctggggaatattaagattggggaaggtgcaaaggttggtgctggttcagtggttttaattgatgtgccaccacggacaacagcagttgggaacccggcgaggttggttggtgggaaggagaagccctctaagcatgaggatgtgcctggggagtctatggaccatacttcctttatctctgagtggtcagattatatcatttga

SEQ ID NO: 8165 - protein, 285 aa, Glycine max
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIANVFAVDIHPAARIGKGILFDHATGVVEGRHRNREQCVDPAPCSLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 8166 - DNA, 939 bp, Rhizobium leguminosarum
  CDS (1)..(939): transl_table=11
atgctaaaaaaccatggcgacggcacccatatatgttattggcgttttcctctatatattggcattccgaaaacggcattccttccggcaacgaggagagcggcgatggtcgcaaagactgacatccgtgcttttgagacaggccatccgctgaaggtgatggatcccatctgggacagcctgcgcgaggaagcccggctcgccgccgaacgggacccggttctcgcggccttcctctattcgaccgtgatcaactaccactcgctcgaggaatgcgtcatccaccgcatctgcgagcgtctcgatcaccccgacatgcaggcgaacctgcttcgccagaccttcgaggaaatgctcctcgactggccggactggagctccatcctgcgcgtcgatatccaggcgatctatgaccgcgatcccgcctgcctgcgcttcatggaggcggtgctttatttcaagggcttccacgcgctgcagacacatcgtctcgcccattggctgctgaaccgcggccggcgtgattttgcgctctatctgcagagccgctcctccagcgtctttcagaccgacatcaatccggccgcccgtatcggcaagggcatcttcctcgatcacgccaccggcctcgtcgtcggcgagacggccgtcatcggcgacaacgtttcgatcctgcacggcgtcacactcggaggcaccggcaaggagggcgctgaccgccatcccaagatcggctccggcgtcatgatcggcgccggcgccaagatcctcggcaatatcgagatcggctactgctcacgagtcgccgcaggctccgtcgtattgaaggcggtgccgcccaagaagacggtggcgggcgtgccggccaaggtcgtcggtgaggccggttgttccgagccgtcgcgcaacatggaccaggtgattggcgccgatatctga

SEQ ID NO: 8167 - protein, 312 aa, Rhizobium leguminosarum
MLKNHGDGTHICYWRFPLYIGIPKTAFLPATRRAAMVAKTDIRAFETGHPLKVMDPIWDSLREEARLAAERDPVLAAFLYSTVINYHSLEECVIHRICERLDHPDMQANLLRQTFEEMLLDWPDWSSILRVDIQAIYDRDPACLRFMEAVLYFKGFHALQTHRLAHWLLNRGRRDFALYLQSRSSSVFQTDINPAARIGKGIFLDHATGLVVGETAVIGDNVSILHGVTLGGTGKEGADRHPKIGSGVMIGAGAKILGNIEIGYCSRVAAGSVVLKAVPPKKTVAGVPAKVVGEAGCSEPSRNMDQVIGADI

SEQ ID NO: 8168 - DNA, 576 bp, Clostridium sticklandii
  CDS (1)..(576): transl_table=11
atgcgagaggtgttaagcttgagagaaaaacaaaaattaacctttatggaaaaaattaaagagactatagaagtagctagagaaaaagatcctgctgcaaaaggtgcaattaatatcttagttaacacccctggtattcatgcgattatgtttcacagagttgctcacagcctatataatagaaaacatttttttatagctagactcatatctcaaatcagcagatttttaactggaattgagattcatccaggggctcagataggcagaaggttttttatagaccatggtatgggcgttgttataggcgaaactgctgaaataggtgatgatgtaatgcttttccatcaagttacactcgggggaactggaaaagataaaggaaaaagacatccaaccgtagaaaataatgttataatatcagcaggagtaaaggtgcttggacctatagtgataggtgaaaactcgaaaataggagccaatgcagtagtactgcatgatatacctaagaatgctacagcagttggaataccagcgaaggtagttaggctcaatggagaaaaggtcgagcactaa

SEQ ID NO: 8169 - protein, 191 aa, Clostridium sticklandii
MREVLSLREKQKLTFMEKIKETIEVAREKDPAAKGAINILVNTPGIHAIMFHRVAHSLYNRKHFFIARLISQISRFLTGIEIHPGAQIGRRFFIDHGMGVVIGETAEIGDDVMLFHQVTLGGTGKDKGKRHPTVENNVIISAGVKVLGPIVIGENSKIGANAVVLHDIPKNATAVGIPAKVVRLNGEKVEH

SEQ ID NO: 8170 - DNA, 870 bp, Allium tuberosum
  CDS (1)..(870)
atgccatgctcaacggttccatttcctacatttccgccaccagaatcggaatctgacgaatcctgggtttggaaccaaatcaaagctgaggcacgccgcgacgccgaatctgaacccgctttggccagctacttatactctactatcatttctcatccctctcttgctcgatctctatccttccatttggccaataagttgtgttcctcaactttgctttccacttcgctttacgatttgtttttgaacgctctctcaacttttcctaccattctgtcggcgacggttgcggatttgattgcggccaggcatcgcgatcccgcttgtatcggtttcagtcactgcttgttgaattttaaggggtttcttgccgtgcagactcaaaggatagcacacgtgctgtggtcccaatcacggcgaccccttgccctagccctacactctcgtgtggcggacgtcttatcggtggacatccaccctgcagctagaatcggcaaaggcatcctcctcgaccatgccaccggcgtagtaatcggcgaaactgcagtcataggcaacaacgtatccatcctccatcacgtgaccctgggcggcacaggaaaagctggaggagacaggcacccaaaaataggcgacggggttctgattggagcaggggccacgatcctaggaaacatcagaatcggcgctggggcgaagattggagcagggtctgttgttttgatcgatgtgccgcctaggactactgcggttgggaatccagctaggttgattggtgggaaggagaagccttctatgcacgaggatgtgcctggtgagtcaatggatcatacttccttcatttccgagtggtcggattatatcatctga

SEQ ID NO: 8171 - protein, 289 aa, Allium tuberosum
MPCSTVPFPTFPPPESESDESWVWNQIKAEARRDAESEPALASYLYSTIISHPSLARSLSFHLANKLCSSTLLSTSLYDLFLNALSTFPTILSATVADLIAARHRDPACIGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKIGAGSVVLIDVPPRTTAVGNPARLIGGKEKPSMHEDVPGESMDHTSFISEWSDYII

SEQ ID NO: 8172 - DNA, 870 bp, Allium cepa
  CDS (1)..(870)
atgccatgctcaactcttccaattccaacatttccgccacctgaatcggaatccgacgaatcctgggtttggaaccaaatcaaagcggaggcacaccgcgacgcggaatctgaaccagctttggccagctacttgtactctactatcatttctcatccctctctcgcccgttctctatccttccatttggccaataaattgtgttcttcaactttgctttccacttcgctttacgatttgtttttgaacacactctcaacttttcctaccgttctgtcggcgtcggttgccgatttgattgcggccaggcatcgggatccggcttgcgtcggtttcagtcactgcttgttgaattttaaggggtttcttgccgttcagactcaaaggatagcacacgtgctgtggtctcaatcacgccgtcctctcgccctggccctacactctcgtgtagcagatgtcctatcggtggacatccaccctgcagccaggatcggtaagggtatcctcctcgaccatgcaaccggcgtagtgatcggtgaaactgcagtcataggcaacaacgtctccattctccatcacgtgaccttagggggcacgggaaaagctggaggggacaggcaccctaaaataggggatggtgttttgattggggcaggggccacgatcctagggaatatcagaatcggtgctggggcgaaggtcggagcagggtctgttgttctgatcgatgtgccgcctaggactactgcggttgggaatccggctaggctgattggggggaaggagaagccttctgtgcacgaagatgtgcctggcgagtccatggatcatacttcattcatttctgagtggtcggattatatcatctga

SEQ ID NO: 8173 - protein, 289 aa, Allium cepa
MPCSTLPIPTFPPPESESDESWVWNQIKAEAHRDAESEPALASYLYSTIISHPSLARSLSFHLANKLCSSTLLSTSLYDLFLNTLSTFPTVLSASVADLIAARHRDPACVGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKVGAGSVVLIDVPPRTTAVGNPARLIGGKEKPSVHEDVPGESMDHTSFISEWSDYII

SEQ ID NO: 8174 - DNA, 654 bp, Bacillus subtilis
  CDS (1)..(654): transl_table=11
gtgttttttagaatgctcaaagaagacattgatactgtgttcgatcaagatcccgcagcaagaagctattttgaagtgattttaacttattccggtttacatgctatatgggcgcatcggattgcacatgctttatataaacgaaaattttatttccttgcacgccttatatctcaagtaagccgattttttaccgggatagaaatccaccccggcgctacaatcgggagaagatttttcatagaccacggcatgggggttgtcattggggagacatgtgaaatcggcaataacgtaaccgtttttcagggggttaccctcgggggaacgggaaaagaaaagggaaaaaggcacccaacgattaaagatgacgcattgatagccacaggtgctaaagtgctcggttctattacggtcggtgaaggctcaaagattggcgctggttcagtagtgctgcatgatgttcctgatttttcaacagttgtcggtatccctggacgggtcgttgtacaaaatggcaagaaagtaagacgcgatttaaaccatcaggatttgcccgatccagttgctgaccgctttaagtctttggaacagcagattttagagctgaaggcagaacttgaagacagaaaagaaaggatcaatcaaaaatga

SEQ ID NO: 8175 - protein, 217 aa, Bacillus subtilis
MFFRMLKEDIDTVFDQDPAARSYFEVILTYSGLHAIWAHRIAHALYKRKFYFLARLISQVSRFFTGIEIHPGATIGRRFFIDHGMGVVIGETCEIGNNVTVFQGVTLGGTGKEKGKRHPTIKDDALIATGAKVLGSITVGEGSKIGAGSVVLHDVPDFSTVVGIPGRVVVQNGKKVRRDLNHQDLPDPVADRFKSLEQQILELKAELEDRKERINQK

SEQ ID NO: 8176 - DNA, 825 bp, Buchnera aphidicola subsp
  CDS (1)..(825): transl_table=11
atgtgtattttgaaaatatcaagaatatggaataaaatactctacgatgtttcttttttattaaaaaaagaaccaattttatcagatttttaccaaagtagtattttacaacaccaaagttttacaagttctttaagttatatattatcaaataaattatctacatctatgatttctgaaaagaaaatacaaggtatatttgatgatgtatatctgaatgatcgttctattttaaattttatagtgcaagatattaaggctgtactaaaacgagatccagcagtaaatgattatttaacacctttactttatttaaaaggtttccatgcactagaagcttatagaataagtcattatctctggaatacagggaaaaaatcattatctctgtatctgcaaagtagaatctcttctgaattttctgtagatattcatccagcagcgtttattggatctggtgtaatgcttgatcatgcaactggcattgtaatcggagaaggtgtgactatagaaaatgatgtatcaattcttcattcggttactttaggaggaactggtaaaaactttagccaaaatagacatcctactattagaaaaggcgttgttataggggcgggtgccaaaattttaggaaatattgaagtaggttcaggcgcgaaaataggtgcgggatcaatagttttaaaaaatgttccttcagatgtaacagttgtaggagtaccagcgaaaattgttagtcaagtatctagtaaaaagtattattctcagaagaaaaaaaatagtttaaaatatataaatatatttcaacacggagatggtatttaa

SEQ ID NO: 8177 - protein, 274 aa, Buchnera aphidicola subsp
MCILKISRIWNKILYDVSFLLKKEPILSDFYQSSILQHQSFTSSLSYILSNKLSTSMISEKKIQGIFDDVYLNDRSILNFIVQDIKAVLKRDPAVNDYLTPLLYLKGFHALEAYRISHYLWNTGKKSLSLYLQSRISSEFSVDIHPAAFIGSGVMLDHATGIVIGEGVTIENDVSILHSVTLGGTGKNFSQNRHPTIRKGVVIGAGAKILGNIEVGSGAKIGAGSIVLKNVPSDVTVVGVPAKIVSQVSSKKYYSQKKKNSLKYINIFQHGDGI

SEQ ID NO: 8178 - DNA, 822 bp, Escherichia coli O157
  CDS (1)..(822): transl_table=11
atgtcgtgtgaagaactggaaattgtctggaacaatattaaagccgaagccagaacgctggcggactgtgagccaatgctggccagtttttaccacgcgacgctactcaagcacgaaaaccttggtagtgcactgagctacatgctggcgaacaagctgtcatcgccaattatgcctgctattgctatccgtgaagtggtggaagaagcctacgccgctgacccggaaatgatcgcctctgcggcctgtgatattcaggcggtgcgtacccgcgacccggcagtcgataaatactcaaccccgttgttatacctgaagggttttcatgccttgcaggcctatcgcatcggtcactggttgtggaatcaggggcgtcgcgcattggcaatctttctgcaaaaccaggtttctgtgacgttccaggtcgatattcacccggcagcaaaaattggccgtggcattatgctcgaccacgccacgggcatcgttgtgggtgaaacggcggtaattgaaaacgacgtatcgattctgcaatctgtgacgcttggcggtacgggtaaatctggtggtgaccgtcacccgaaaattcgtgaaggtgtgatgattggcgcgggcgcgaaaatcctcggcaatattgaagttggtcgcggcgcgaagattggcgcaggttccgtggtgctgcaaccggtgccgccgcatacaaccgccgctggcgttccggctcgtattgtcggtaaaccagacagcgataagccatcaatggatatggaccagcatttcaacggtattaaccatacatttgagtatggggatgggatctaa

SEQ ID NO: 8179 - protein, 273 aa, Escherichia coli O157
MSCEELEIVWNNIKAEARTLADCEPMLASFYHATLLKHENLGSALSYMLANKLSSPIMPAIAIREVVEEAYAADPEMIASAACDIQAVRTRDPAVDKYSTPLLYLKGFHALQAYRIGHWLWNQGRRALAIFLQNQVSVTFQVDIHPAAKIGRGIMLDHATGIVVGETAVIENDVSILQSVTLGGTGKSGGDRHPKIREGVMIGAGAKILGNIEVGRGAKIGAGSVVLQPVPPHTTAAGVPARIVGKPDSDKPSMDMDQHFNGINHTFEYGDGI

SEQ ID NO: 8180 - DNA, 804 bp, Haemophilus influenzae
  CDS (1)..(804): transl_table=11
atgacattagatgtgtggcaacatattcgccaagaagccaaagaacttgctgaaaacgaacctatgcttgctagtttttttcactctacaattttaaagcatcaaaatctgggcggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccatgcgattcaaagttatcgaattacccattatttatggaatcaaaatcgtaaatcccttgccctttatttacaaaaccaaatttcagtagctttcgatgtagatattcacccagcggcgaaaattggccacggaattatgttcgaccatgcaacaggtattgttgtgggtgaaacatctgtaatcgaaaatgatgtttcaattttgcaaggggtaacgcttggcggtacgggaaaagaatcaggcgatcgtcatcccaaagtacgcgagggtgttatgattggggcgggtgcaaaaattctcggtaatattgaagtaggtaaatacgccaaaattggggcaaactctgttgtgcttaaccctgtgccggaatatgccacagcggctggcgtgcctgctcgtattgtgagtcaagataaagcagcaaaacctgctttcgatatgaaccaatattttatcggcattgatgatggaatgaatttaaatatataa

SEQ ID NO: 8181 - protein, 267 aa, Haemophilus influenzae
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 8182 - DNA, 516 bp, Helicobacter pylori J99
  CDS (1)..(516): transl_table=11
atgttggatttgtcttatagcctggagcgtgtcttgcaagaagacccggcagctaggaataagtgggaggttctcttgctttatccgggcattcatgcactgctttgttaccgcctagcgcatgcgttgcacaagcggaggttttacttcatcgctcgcgcgctttctcagttggcgcgttttatcactgggatagaaatccacccgggcgctaagattgggagagggctttttattgatcatggcatgggtgtggtgattggcgagaccacagagattggagatgatgttaccatttatcatggcgtaactctggggggtacgggcaagtttaagggcaaacgccaccctactttaggcaaccgagtggtagttggggcaggggctaaggtcttgggcgcgatttgcgtgggcgatgatgtgaggattggggctaatgcggtggtgctttcagatttacccacgggttctacggctgtaggtgctaaagccaaaaccatcacaaaggatcgttaa

SEQ ID NO: 8183 - protein, 171 aa, Helicobacter pylori J99
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVRIGANAVVLSDLPTGSTAVGAKAKTITKDR

SEQ ID NO: 8184 - DNA, 516 bp, Helicobacter pylori
  CDS (1)..(516): transl_table=11
atgctggatttgtcttatagcctggagcgtgtcttgcaagaagacccggcagctaggaataagtgggaggttcttttgctttatccgggcattcatgcgctgctttgttaccgcctagcgcatgcgttgcacaagcggaggttttacttcattgcgcgcgcgctttctcagttagcgcgctttatcactgggatagaaatccaccctggcgctaagattgggagagggctttttattgatcatggcatgggtgtggtgattggcgagaccacagagattggagatgatgttaccatttatcatggcgtaactctaggaggcacgggtaagttcaagggcaagcgccaccctactttaggcaatcgtgtggtagtgggggcaggggctaaggtcttgggtgcgatttgcgtgggcgatgatgtgaagattggagctaatgcggtggtgctttcagatttgcccacgggttctacggctgtaggatctaaagccaaaaccatcacaaaggatcgttaa

SEQ ID NO: 8185 - protein, 171 aa, Helicobacter pylori
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVKIGANAVVLSDLPTGSTAVGSKAKTITKDR

SEQ ID NO: 8186 - DNA, 822 bp, Salmonella typhimurium
  CDS (1)..(822): transl_table=11
atgccgtgtgaagaactggaaatcgtctggaagaatattaaagctgaagcccgcgctttagctgactgtgagcctatgttggccagtttttatcacgccacgctactcaagcatgaaaatctgggcagtgcgctgagctatatgctggcaaataaactggcttcgcccatcatgcccgctatcgctatccgtgaagtagttgaagaagcctatgccgccgacccggaaatgatcgcgtcggcagcctgcgatattcaggccgtgcgcactcgcgatccggcggtggataaatactccacgccgctgttatatctgaaaggctttcatgcgctacaggcctaccgcattggtcactggttgtggaataaaggtcgccgcgcgctggctatcttcctgcaaaatcaggtttcggtctcgtttcaggtggatattcacccggcagcgaaaattggccgcgggattatgctcgaccatgccaccggtattgtggtgggggagacggcggttattgaagatgatgtgtcgatcttgcaatccgtcaccctgggcggtaccgggaaaacgagcggcgatcgtcatcctaaaatccgcgaaggcgtgatgattggcgcgggcgcgaaaattctcggcaatatcgaggtggggcgcggcgcgaaaattggcgcaggttccgtcgttttacagcctgtcccgccgcacactaccgccgcaggcgttccggcgcgtattgtcggcaagccgggcagcgataagccgtcgatggatatggaccagcatttcaacgggatacaccatacgtttgagtatggcgacggcatctga

SEQ ID NO: 8187 - protein, 273 aa, Salmonella typhimurium
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGIHHTFEYGDGI

SEQ ID NO: 8188 - DNA, 642 bp, Staphylococcus aureus
  CDS (1)..(642): transl_table=11
ttgttaaaaagaatgagagacgatataaaaatggtatttgagcaggatccagcggcacgttcaacattagaagtcattacaacgtatgcaggtttacatgcagtttggagtcatttgattgcacataagttatacaaccaaaaaaaatatgttgcagcacgcgcgatatctcaaatttcaagatttttcacaggtatagaaatccatccaggtgctaaaattggaaagcgtctatttatagatcatggtatgggcgttgtaataggagaaacatgtacaattggtgataatgtgacaatctatcaaggcgtgacacttggtgggacagggaaagaaagagggaaaagacacccagatataggagacaatgttttaatagcagccggtgcgaaagttttaggaaatattaaaataaattcaaatgtaaatattggtgcaaattcagttgttttacaatcagttccaagttattcaacggttgttggtataccaggacatattgttaagcaagatggtgttcgagttggaaaaacatttgatcatcgccatctacctgatccaatttatgaacaaattaagcatttagaacgacaacttgaaaagactaggaatggagagattcaagatgattacattatataa

SEQ ID NO: 8189 - protein, 213 aa, Staphylococcus aureus
MLKRMRDDIKMVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 8190 - DNA, 648 bp, Staphylococcus aureus
  CDS (1)..(648): transl_table=11
atgatcttgttaaaaagaatgagagacgatataaaaatggtatttgagcaggatccagcggcacgttcaacattagaagtcattacaacgtatgcaggtttacatgcagtttggagtcatttgattgcacataagttatacaaccaaaaaaaatatgttgcagcacgcgcgatatctcaaatttcaagatttttcacaggtatagaaatccatccaggtgctaaaattggaaagcgtctatttatagatcatggtatgggcgttgtaataggagaaacatgtacaattggtgataatgtgacaatctatcaaggcgtgacacttggtgggacagggaaagaaagagggaaaagacacccagatataggagacaatgttttaatagcagcgggtgcgaaagttttaggaaatattaaaataaattcaaatgtaaatattggtgcaaattcagttgttttacaatcagttccaagttattcaacggttgttggtataccaggacatattgttaagcaagatggtgttcgagttggaaaaacatttgatcatcgccatctacctgatccaatttatgaacaaattaagcatttagaacgacaacttgaaaagactaggaatggagagattcaagatgattacattatataa

SEQ ID NO: 8191 - protein, 215 aa, Staphylococcus aureus
MILLKRMRDDIKMVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 8192 - DNA, 642 bp, Staphylococcus epidermidis
  CDS (1)..(642): transl_table=11
gtgttaaaaagaatgagagacgatataaagatggtgtttgaacaggatcctgcagcgcgctcgactttagaagtaataactacttacgctggattacatgcagtttggagtcacttaattgcccataaattatataaaaatagacgctatgtagcagccagaatgatttctcaactatcacgtttttttaccggaattgaaatacatccaggtgcaaaaatcggtaagcgtttatttatcgaccatggcatgggtgtagttattggagaaacatgtacaattggtgataatgttactatttatcaaggagttactttaggtggtacaggcaaagaaaaaggaaaacgccatcctgatattggtgataatgttttgatagcagctggatctaagatattaggtaatataaaaattgaatcaaatgtgaatattggagctaattccgtagtattacagtctgttcctagttatacaactgtagtaggtataccaggtcacattgttaaacaagaaggtagacgtattggtaaaacatttgatcaccgtaacttacctgatccactttacgaacaaattaaacacttagaaagacagcttgaaaaagctaagaatggagagattcaagatgattacattatataa

SEQ ID NO: 8193 - protein, 213 aa, Staphylococcus epidermidis
MLKRMRDDIKMVFEQDPAARSTLEVITTYAGLHAVWSHLIAHKLYKNRRYVAARMISQLSRFFTGIEIHPGAKIGKRLFIDHGMGVVIGETCTIGDNVTIYQGVTLGGTGKEKGKRHPDIGDNVLIAAGSKILGNIKIESNVNIGANSVVLQSVPSYTTVVGIPGHIVKQEGRRIGKTFDHRNLPDPLYEQIKHLERQLEKAKNGEIQDDYII

SEQ ID NO: 8194 - DNA, 651 bp, Staphylococcus xylosus
  CDS (1)..(651): transl_table=11
ttgtttaaatttttgaaaagaattaaagatgatgtaaatatggtgtttgaacaagacccagctgcacgtactacgttagaagtgattacatcttatgcaggtgtacatgcagtatggagtcatttgattgcacatgaactgtataaaaagaaaaagtatgttttggcaagactaatttctcaagttacacgtttttttacaggtattgagatacatccaggtgcccaaatcggtagacgtttgtttattgatcacggtatgggtgtagtcattggagagacatgtcgcattggtgataacgtaacgatttatcaaggtgttacattaggtggaacgggtaaagaaagaggtaaacgtcacccagatataggtgataatgtattgattgctgcaggagcaaaagtgcttggcaacataacgattaatgctaatgtgaatattggggctaactcagtagtgttaaattcagtgccaagttattcgacagtagtaggtataccaggacatatcgtaaaacaagatggtagacgtatagggaaaacgtttgaccatcgtaatttacctgacccaatttacgagcaattaaaagagttagaaaaacaacttgagaaaacaagaaatggagagattcaagatgattacattatataa

SEQ ID NO: 8195 - protein, 216 aa, Staphylococcus xylosus
MFKFLKRIKDDVNMVFEQDPAARTTLEVITSYAGVHAVWSHLIAHELYKKKKYVLARLISQVTRFFTGIEIHPGAQIGRRLFIDHGMGVVIGETCRIGDNVTIYQGVTLGGTGKERGKRHPDIGDNVLIAAGAKVLGNITINANVNIGANSVVLNSVPSYSTVVGIPGHIVKQDGRRIGKTFDHRNLPDPIYEQLKELEKQLEKTRNGEIQDDYII

SEQ ID NO: 8196 - DNA, 735 bp, Synechococcus sp
  CDS (1)..(735): transl_table=11
gtgtttaaaacgctggctgccgatttccgcatcatctttgaacgggaccccgctgcccgcaacgggctggaagtcctgctgtgctaccccggatttcaggcgctagtttgccatcgggttgctcattggctctatcagcagcgcttgccagtgattccgcgcctgttgtcgcatctcagccgtctactgacgggagtggaaattcaccccggggctcgcctcggtcaaggcattttcatcgaccacggcatgggcgtggtgattggtgaaacggcgatcgttggcgactactgcctgatttatcagggtgtaaccctcggcggtacgggtaagcaaagcggaaaacgccacccaacgctagctaacaacgtcgtggttggcgctggagcgaaggtactcggcaatatccagatcggcgagaatgtccgcattggtgctggttcggtggtgctgcgagatgtgccctcagactgcacggtggttggtattcccggccgcgtcatctatcgttctggcgtgcgcgtcgatccactggatcacagccagatgcccgactcggaagcgcgggtgattcggatgctgctcgatcgcatcgaagcgcttgaggatcaactggaagggctcaatcttccacctgccgaagaagccatcgatgtcaccttggctcccgtgggcgatcgctgtcaactacgcgatcgcacgattgaagaatttttagacggcgcgggcatctaa

SEQ ID NO: 8197 - protein, 244 aa, Synechococcus sp
MFKTLAADFRIIFERDPAARNGLEVLLCYPGFQALVCHRVAHWLYQQRLPVIPRLLSHLSRLLTGVEIHPGARLGQGIFIDHGMGVVIGETAIVGDYCLIYQGVTLGGTGKQSGKRHPTLANNVVVGAGAKVLGNIQIGENVRIGAGSVVLRDVPSDCTVVGIPGRVIYRSGVRVDPLDHSQMPDSEARVIRMLLDRIEALEDQLEGLNLPPAEEAIDVTLAPVGDRCQLRDRTIEEFLDGAGI

SEQ ID NO: 8198 - DNA, 810 bp, Azotobacter chroococcum mcd 1
  CDS (1)..(810): transl_table=11
atgagcctgcttgcgcaatggcgtgaagacatccgctgcgtgttcgagcgcgatccggcggcacgcaccaccttcgaggtgctgaccacctatccgggcgtgcacgcgatcatgctctaccggctcgcccatcgtctgtggcggccgaatgcgttacctcgcccggctgctgtcgttcgcgcgcgcctggtgagcaacgtcgacatccatcccggggccgtcatcggtgcgcgcttcttcatcgaccacggcgcctgcgtggtgatcggcgagaccgccgagatcggccgggacgtgactctctaccacggcgtcaccctgggcggcaccactggcgcaaagggcaagcgtcatccgaccctgggcgacgttgtgctggtcggcgccggggcgaagatcctcggcccgatcaccatcggcgccaatgcccgggtcggcgccaactcggtggtggtccaggatgtgcccgagggctgcacggtggtcggcattcccggcaaggtggtcaagctgcgcgaggccggccagctcaacccctacggcatcgacctcgatcaccatctgattcccgacccggtcggcaaggcgatcgcctgcctgctggagcgtatcgactcgctggagaagagggtcgaggcgggcgggctggtcgccgcggcagccagcagcacgttctacgagggctgcaatcccgacaacagcatctgcgaaacgaatctgcgccggtcggcgccctggtccagcggccggccgcggcggcccgcccacgccggtgatcgagtgagcggcagggccaaggggagcgattga

SEQ ID NO: 8199 - protein, 269 aa, Azotobacter chroococcum mcd 1
MSLLAQWREDIRCVFERDPAARTTFEVLTTYPGVHAIMLYRLAHRLWRPNALPRPAAVVRARLVSNVDIHPGAVIGARFFIDHGACVVIGETAEIGRDVTLYHGVTLGGTTGAKGKRHPTLGDVVLVGAGAKILGPITIGANARVGANSVVVQDVPEGCTVVGIPGKVVKLREAGQLNPYGIDLDHHLIPDPVGKAIACLLERIDSLEKRVEAGGLVAAAASSTFYEGCNPDNSICETNLRRSAPWSSGRPRRPAHAGDRVSGRAKGSD

SEQ ID NO: 8200 - DNA, 945 bp, Arabidopsis thaliana
  CDS (1)..(945)
atggcaacatgcatagacacatgccgaaccggtaatacccaagacgatgattcccggttctgttgcatcaagaatttctttcgacccggtttctctgtaaaccggaagattcaccacacccaaatcgaagatgacgatgatgtctggatcaagatgcttgaagaagccaaatccgatgttaaacaagaacccattttatcaaactactactacgcttcgatcacatctcatcgatctttagagtctgctttagctcacatcctctccgtaaagctcagcaatttaaacctaccaagcaacacactcttcgaactgttcataagcgttttagaagaaagccctgagatcatcgaatccacgaagcaagatcttatagcagtcaaagaaagagacccagcttgtataagctacgttcattgcttcttgggcttcaaaggcttcctcgcttgtcaagctcatcgaatagctcataccctctggaaacagaacagaaaaatcgtagctttattgatccaaaacagagtatcagaatctttcgccgtcgatattcatcccggagcgaagatcggaaaagggattcttttagaccatgcgacgggcgtggtgatcggagagacggcggtggttggagacaatgtttcgattctacacggagtgaccttgggaggaacagggaaacagagtggtgatcggcatccgaagattggtgatggtgtgttgattggagctgggagttgtatattggggaatataacaatcggtgagggagctaagattggatcagggtcggtggtggttaaggatgtgccggcgcgtacgacggcggttggaaatccggcgaggttgattggtgggaaagagaatccgagaaaacatgataagattccttgtctgactatggaccagacatcgtatttaaccgagtggtctgattatgtgatttaa

SEQ ID NO: 8201 - protein, 314 aa, Arabidopsis thaliana
MATCIDTCRTGNTQDDDSRFCCIKNFFRPGFSVNRKIHHTQIEDDDDVWIKMLEEAKSDVKQEPILSNYYYASITSHRSLESALAHILSVKLSNLNLPSNTLFELFISVLEESPEIIESTKQDLIAVKERDPACISYVHCFLGFKGFLACQAHRIAHTLWKQNRKIVALLIQNRVSESFAVDIHPGAKIGKGILLDHATGVVIGETAVVGDNVSILHGVTLGGTGKQSGDRHPKIGDGVLIGAGSCILGNITIGEGAKIGSGSVVVKDVPARTTAVGNPARLIGGKENPRKHDKIPCLTMDQTSYLTEWSDYVI

SEQ ID NO: 8202 - DNA, 972 bp, Arabidopsis thaliana
  CDS (1)..(972)
atgaatggcgatgagcttcctttcgagagtggtttcgaggtttacgctaagggaactcataagtcagagtttgactcgaatttgcttgatcctcgttctgatcctatttgggatgctataagagaagaagctaaacttgaggcagagaaagagcctattttgagtagcttcttgtatgctggtatcttagcacatgattgtttagagcaagctttagggtttgttctagccaaccgtctccaaaacccaaccttgttggcaacacaactcttggatatattttatggtgttatgatgcatgacaaaggtattcagagttcgattcgccatgatctccaggcatttaaagatcgtgatcctgcttgtctgtcgtatagttctgctattttacatctgaagggttatcatgcgttacaagcatatagggttgcgcataaactgtggaatgaagggaggaaactattagctcttgcattgcaaagccgaataagcgaggtttttggcattgacatacatccagcggcaagaattggggagggaatattgttggatcatggaactggagtggtcattggtgagaccgctgtgataggcaacggtgtctcgatcttacatggtgtgactttaggaggaaccggaaaggaaactggcgatcgccacccaaagataggtgaaggtgcattgcttggagcttgtgtgactatacttggtaacataagcataggtgctggagcaatggtagctgcaggttcacttgtgttaaaagacgttccttcgcatagtgtggtggctggaaatcctgcaaaactgatcagggtcatggaagagcaagacccgtctctagcaatgaaacacgatgctactaaagagttctttcgacatgtagctgatggttacaaaggggcacaatctaacggaccatcactttcagcaggagatacagagaaaggacacactaacagcacatcatga

SEQ ID NO: 8203 - protein, 323 aa, Arabidopsis thaliana
MNGDELPFESGFEVYAKGTHKSEFDSNLLDPRSDPIWDAIREEAKLEAEKEPILSSFLYAGILAHDCLEQALGFVLANRLQNPTLLATQLLDIFYGVMMHDKGIQSSIRHDLQAFKDRDPACLSYSSAILHLKGYHALQAYRVAHKLWNEGRKLLALALQSRISEVFGIDIHPAARIGEGILLDHGTGVVIGETAVIGNGVSILHGVTLGGTGKETGDRHPKIGEGALLGACVTILGNISIGAGAMVAAGSLVLKDVPSHSVVAGNPAKLIRVMEEQDPSLAMKHDATKEFFRHVADGYKGAQSNGPSLSAGDTEKGHTNSTS

SEQ ID NO: 8204 - DNA, 1068 bp, Arabidopsis thaliana
  CDS (1)..(1068)
atggcttgtataaacggcgagaatcgtgatttttcttcctcgtcatctttgtcttctcttccaatgattgtctcccggaacttttctgccagagacgatggagagaccggtgacgagtttcctttcgagaggattttcccggtttacgctagaggaacccttaatcccgtggccgacccggttttgctggattttaccaattctagttatgacccaatttgggattctataagagaagaagctaagcttgaggcagaagaggagccggttttgagtagcttcttgtatgctagtatcttgtcgcatgactgtttagagcaagcattgagttttgttctagctaaccgtctccaaaaccctaccttgttggcaactcagcttatggatatattttgcaacgttatggtacatgacagaggtattcaaagctcgattcgtcttgatgttcaggcattcaaagacagagatcctgcttgtctatcgtatagttcggctattttacatctgaagggctatcttgcactgcaggcgtatagagtagcacataagttgtggaagcaaggaagaaaactattagcattggcactgcaaagccgagtaagcgaggtttttggaatcgatattcatcccgctgcaagaattgggaaaggaatattgttggatcatggaactggtgtggtcataggtgagactgctgtgataggcgaccgtgtctcaattttgcatggtgtgacattaggaggaactgggaaagaaaccggtgaccgccatccaaatataggcgacggtgctcttcttggagcatgtgtgactatacttggtaacattaagataggcgctggagcaatggtagctgctggttcgcttgtgttaaaggatgttccttcgcatagcatggtggctggaaatccagcaaaactcatcgggtttgttgatgagcaagatccatctatgacaatggagcatgatgctaccagagagttctttcaaaatgtagctgttgcttatagagagacaataccaaatggatcttcagtttcagggagttgcagggaaaggagacattaa

SEQ ID NO: 8205 - protein, 355 aa, Arabidopsis thaliana
MACINGENRDFSSSSSLSSLPMIVSRNFSARDDGETGDEFPFERIFPVYARGTLNPVADPVLLDFTNSSYDPIWDSIREEAKLEAEEEPVLSSFLYASILSHDCLEQALSFVLANRLQNPTLLATQLMDIFCNVMVHDRGIQSSIRLDVQAFKDRDPACLSYSSAILHLKGYLALQAYRVAHKLWKQGRKLLALALQSRVSEVFGIDIHPAARIGKGILLDHGTGVVIGETAVIGDRVSILHGVTLGGTGKETGDRHPNIGDGALLGACVTILGNIKIGAGAMVAAGSLVLKDVPSHSMVAGNPAKLIGFVDEQDPSMTMEHDATREFFQNVAVAYRETIPNGSSVSGSCRERRH

SEQ ID NO: 8206 - DNA, 939 bp, Arabidopsis thaliana
  CDS (1)..(939)
atgccaccggccggagaactccgacatcaatctccatcaaaggagaaactatcttccgttacccaatccgatgaagcagaagcagcgtcagcagcgatatctgcggcagctgcagatgcggaagctgccggattatggacacagatcaaggcggaagctcgccgtgatgctgaggcggagccagctttagctagctatctatattcgacgattctttctcattcgtctcttgaacgatctatctcgtttcatctaggaaacaagctttgttcctcaacgcttttatccacacttttatacgatctgttcttaaacactttttcctccgatccttctcttcgtaacgccaccgtcgcagatctacgcgctgctcgtgttcgtgatcctgcttgtatctcgttctctcattgtctcctcaattacaaaggcttcttagctattcaggcgcatcgtgtatcacacaagctatggacacaatcacggaagccattagcattagctctacactcaagaatctccgatgtattcgctgttgatatccatccagcagcgaagatcggaaaagggatacttctagaccacgcaaccggagttgtagtcggagaaacagcggtgattgggaacaatgtttcaatccttcaccatgtgacactaggtggaacaggtaaagcttgtggagatagacatccgaagatcggtgacggttgtttgattggagctggagcgactattcttggaaatgtgaagattggtgcaggtgctaaagtaggagctggttctgttgtgctgattgacgtgccttgtcgaggtactgcggttgggaatccggcgagacttgtcggagggaaagagaagccaacgattcatgatgaggaatgtcctggagaatcgatggatcatacttcattcatctcggaatggtcagattacatcatataa

SEQ ID NO: 8207 - protein, 312 aa, Arabidopsis thaliana
MPPAGELRHQSPSKEKLSSVTQSDEAEAASAAISAAAADAEAAGLWTQIKAEARRDAEAEPALASYLYSTILSHSSLERSISFHLGNKLCSSTLLSTLLYDLFLNTFSSDPSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 8208 - DNA, 960 bp, Synechococcus sp
  CDS (1)..(960): transl_table=11
atgagtttgtcccctcgcagcgatcgcactgagattcgccggagttggggcttagactccattgtctcggcactgagccaagcctcgactgatccgcttccccaccatctgctgtccgatcagttctacccgctgccatcccgggagagcttggggctgatcttgcacggcttgcgatcggtgctattcccccgccactttggtgaccctgaactgtcggtcgaaaccacgcactatttcatcggcaatacgctcgataagacgctcaatctcctgaatgagcagatccgtcgcgagctatggctacagcacgtcacccaaggcacacctgaggctaccccagccgtgctcagtcagcatgccagtgagctgacgcaagcctttgcccaagccttgcccgagattaagcggttactcgacagtgatgtcaatgcagcctatctcggtgatccagcagcacagtcgatcagtgaaatcttgttttgctatcccggcatcacggcaattactttccaccgcctcgcccatcggctctatcagttagggctaccgctgctagcgcgaattacggcggaggttagccactcggaaaccggcattgatattcatccgggagctgcgatcgggggtagctttttcatcgaccacggcacgggtgtggtgattggcgaaacctgtgtgatcggcgatcgcgtgcggatttatcaggcggtgaccctgggggcaaaaagttttccccgtgatgaaaccggcgctttgatcaagggacaggctcgccatccagtaattgaagacgatgtggtgatttacgccggagctacgttgctaggccggatcacggtgggtcgtggctccacgattggcggcaatgtttggctgactcggagtgttcccgctggcagctttatctcgcaggcgcaaattcgttcggacaactttgaaagtggcggaggcatttag

SEQ ID NO: 8209 - protein, 319 aa, Synechococcus sp
MSLSPRSDRTEIRRSWGLDSIVSALSQASTDPLPHHLLSDQFYPLPSRESLGLILHGLRSVLFPRHFGDPELSVETTHYFIGNTLDKTLNLLNEQIRRELWLQHVTQGTPEATPAVLSQHASELTQAFAQALPEIKRLLDSDVNAAYLGDPAAQSISEILFCYPGITAITFHRLAHRLYQLGLPLLARITAEVSHSETGIDIHPGAAIGGSFFIDHGTGVVIGETCVIGDRVRIYQAVTLGAKSFPRDETGALIKGQARHPVIEDDVVIYAGATLLGRITVGRGSTIGGNVWLTRSVPAGSFISQAQIRSDNFESGGGI

SEQ ID NO: 8210 - DNA, 912 bp, Oryza sativa
  CDS (1)..(912)
atgactgcgggccagcctctccgggacgatccccagccacgccggcacagcccgccggcgctccacccggccgtcgtgccggcgtacccgcccccggagtcggacgccgacgagtcgtgggtctggtcccagatcaaggccgaggcgcgccgcgacgccgacgccgagccggcgctcgcgtcgttcctctacgccaccgtgctctcccacccctccctcgaccgctcgctcgccttccacctcgccaacaagctctgctcctccacgctgctctccacgctcctctacgacctcttcgtcgcctccctcgccgcgcaccccaccctccgcgccgccgtcgtcgccgacctcctcgccgcgcgctccagggaccccgcctgcgtcggcttctcccactgcctcctcaactacaagggcttcctcgccatccaggcccagcgcgtcgcgcacgtgctctgggcgcaggaccgccgcgccctcgcgctcgcgctccagtcccgcgtcgccgaggtgttcgccgtcgacatccaccccgccgccgcgatcggcaagggcgtcctcctcgaccacgccacgggcgtcgtcatcggagagaccgccgtcatcggcgacaacgtctccatcctccaccacgtcacgctgggcgggacaggcaaggccgtgggcgaccggcaccccaagatcggcgacggcgtcctcattggcgccggcgcgacgatcctcggcaatgtcaggatcggcgccggggccaagatcggggccgggtcgctggtgctcatcgacgtgccgccgaggaccacggcggtggggaatccggcgaggctgctcggcgggaagaagggcgacgacatgccgggtgaatccatggaccacacctccttcatccagcaatggtcggactacagcatctga

SEQ ID NO: 8211 - protein, 303 aa, Oryza sativa
MTAGQPLRDDPQPRRHSPPALHPAVVPAYPPPESDADESWVWSQIKAEARRDADAEPALASFLYATVLSHPSLDRSLAFHLANKLCSSTLLSTLLYDLFVASLAAHPTLRAAVVADLLAARSRDPACVGFSHCLLNYKGFLAIQAQRVAHVLWAQDRRALALALQSRVAEVFAVDIHPAAAIGKGVLLDHATGVVIGETAVIGDNVSILHHVTLGGTGKAVGDRHPKIGDGVLIGAGATILGNVRIGAGAKIGAGSLVLIDVPPRTTAVGNPARLLGGKKGDDMPGESMDHTSFIQQWSDYSI

SEQ ID NO: 8212 - DNA, 897 bp, Oryza sativa
  CDS (1)..(897)
atgaccaccgcccagccactccagcacgagcatgacccgtccccgccggagccggacgccgacgccgacgacgaggaggaggagtcgcgggtgtggtcccagatcaaggccgaggcgcgccgcgacgccgacggcgagccggcgctggcgtcgttcgtgtacgccaccgtgctctcccaccccaccctcgccggctccctcgccttccacctcgccaacaagctcgcctcctcctccacgctgctctcctccacgctcctctacgacctcttcgccgccgcccacgccgcgcgccccgacctccgcgccgccgccgccgccgacctcctagccgcgggcgcccgcgacccggcctgcgcgggccgcctctcccactgcctcctcgactacaagggcttcctcgccgtccaggcccaccgcgtcgcgcacgcgctctgggcgcagggccgccgcgccctggcgctcgcgctccagtcccgcgtcgccgaggtcttcgccgtcgacatccacccggccgccgccgtggggagcggcgtcctcctggaccacgccaccggggtggtcatcggcgagaccgccgtcgtcggcgacggcgtgtccatcctccaccacgtcacgctgggcgggaccggcgaggccgtcggcgaccggcaccccaaggtcggcgacggcgtgctcatcggcgccggcgcgaccatcctcgggaacgtcaggatcggcgccggcgccaagatcggggccgggtcgctggtgctcgccgacgtgccgccgggggccacggcggtggggaacccggcgaggctgctgctcggcggggaccagcgcggcggcgcgccggccggtgaatccatggaccatgcctccttcatgctggagtggtcggattacaccatttga

SEQ ID NO: 8213 - protein, 298 aa, Oryza sativa
MTTAQPLQHEHDPSPPEPDADADDEEEESRVWSQIKAEARRDADGEPALASFVYATVLSHPTLAGSLAFHLANKLASSSTLLSSTLLYDLFAAAHAARPDLRAAAAADLLAAGARDPACAGRLSHCLLDYKGFLAVQAHRVAHALWAQGRRALALALQSRVAEVFAVDIHPAAAVGSGVLLDHATGVVIGETAVVGDGVSILHHVTLGGTGEAVGDRHPKVGDGVLIGAGATILGNVRIGAGAKIGAGSLVLADVPPGATAVGNPARLLLGGDQRGGAPAGESMDHASFMLEWSDYTI

SEQ ID NO: 8214 - DNA, 1065 bp, Oryza sativa
  CDS (1)..(1065)
atgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagtatggcagtaggaaaccctgcaaaggtagttgggtataaagataaggaagacccttctttaactatgaaacatgatgccagaagagattattttgagcatgttgccgttagtttttcagatgacaaagctaatggaagtgttgtgaagtaa

SEQ ID NO: 8215 - protein, 354 aa, Oryza sativa
MTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANGSVVK

SEQ ID NO: 8216 - DNA, 981 bp, Oryza sativa
  CDS (1)..(981)
atgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagagagcaaaatcaggggaggcgggcaggccggggtgggcggggggataacatgatcatgataaagtaa

SEQ ID NO: 8217 - protein, 326 aa, Oryza sativa
MTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHREQNQGRRAGRGGRGDNMIMIK

SEQ ID NO: 8218 - DNA, 906 bp, Oryza sativa
  CDS (1)..(906)
atggcagcctgcgtcgataagtggccggcggcgtacccgtgccgcctgccggataagttctactgcgccttgccggactgcaccaccacggaccgtccggtggcgccggcgccggcggctagcgggagcagcggcgactacgtgtgggacgcgctgcgcgccgaggcgcaggacgacgcggacgacgagccgctcctccgcaagttctaccacgacctcgtcctgtcgcggccgtcgctggagtccgcgctcgcctcgctgctggcggccaagctctgcatccccggcgcgctgccgcaggaccagctccgggacctcctcgccggcgcgctcgccgcgcacccggaggccgggcgcgccgcgcgcgccgacctcgccgcggcgcgcgaccgcgacccggcctgcgccaagatggtccactgcttcctctactacaggggcttcctggcactgcaggcccaccgcgcggcgcacgcgctctggtccgacaaccgcagggcgccggccctccttctccagagccgcgcctccgaggtgttcggcgtcgacatccaccccggggcgcgcattggcggcggcatcctgctcgaccacgccacgggcgtcgtcatcggcgagacggccgtcgtcggctacggcgtgtccatcctgcacgccgtgacgctgggcggcacggggaaggagtccggcgaccggcaccccaaggtcggggacggtgtgctgatcggcgccggggcgagcgtgctcggcaatgtgcacattggcgacggagcggagatcggagccggtgcaatcgtgctacgggacgtggcggacggaaccacggccaagccgatcatcggcaagaaggcggagccgcaacgagagcttcccggggtaaccatggagcagagatggtcggattga

SEQ ID NO: 8219 - protein, 301 aa, Oryza sativa
MAACVDKWPAAYPCRLPDKFYCALPDCTTTDRPVAPAPAASGSSGDYVWDALRAEAQDDADDEPLLRKFYHDLVLSRPSLESALASLLAAKLCIPGALPQDQLRDLLAGALAAHPEAGRAARADLAAARDRDPACAKMVHCFLYYRGFLALQAHRAAHALWSDNRRAPALLLQSRASEVFGVDIHPGARIGGGILLDHATGVVIGETAVVGYGVSILHAVTLGGTGKESGDRHPKVGDGVLIGAGASVLGNVHIGDGAEIGAGAIVLRDVADGTTAKPIIGKKAEPQRELPGVTMEQRWSD

SEQ ID NO: 8220 - DNA, 948 bp, Oryza sativa
  CDS (1)..(948)
atggcagcctgcgtcgacaagtggccgccggcggcgtacctgtgccgcctgccggagaagttctactgcgtcttgccggactgcaccgctacggaccgtccggtggtcaccgcatcggcggcgccggcgccggccgctagcgggagcagcggcgactacgtgtgggacgtgctgcgcgccgaggcgcaggacgacgcggacgacgagccgctcctccgcaagttctaccacgacctcgtcctgtcgcggccgtcgctggagtccgcgctcgcctcgctgctggcggccaagctctgcatccccggcgcgctgccgcaggaccagctccgggacctcctcgccggcgcgctcgccgcgcacccggaggccgggcgcgccgcgcgcgccgacctcgtcgcggcgcgcgaccgcgacccggcctgcgccaagatggtccactgcttcctctactacaagggcttcctggcactgcaggcccaccgcgcggcgcacgcgctctggtccgacaaccgcagggcgccggctctcctcctccagagccgcgcctccgaggtgttcggcgtcgacatccaccccggtgcgcgcattggctgcggcatcctgctcgaccacgccacgggcgtcgtcatcggcgagacggccgtcgtcggctacgacgtgtccatcctgcacggggtgacgctgggcggcacggggaaggagtccggcgaccggcaccccaaggtcggggacggtgtgctgatcggcgccggggcgagcgtgctcggcaatgtgcacattggcgacggagcgaagatcggagccggcgcagtcgtgctacgggacgtggcggacggaaccacggccgtcgggaacccagcgaagccgatcatcggcaagaaggcggcgccgcaacggcggccggaagagcttcccggggtaaccatggagcagagatggtcggattga

SEQ ID NO: 8221 - protein, 315 aa, Oryza sativa
MAACVDKWPPAAYLCRLPEKFYCVLPDCTATDRPVVTASAAPAPAASGSSGDYVWDVLRAEAQDDADDEPLLRKFYHDLVLSRPSLESALASLLAAKLCIPGALPQDQLRDLLAGALAAHPEAGRAARADLVAARDRDPACAKMVHCFLYYKGFLALQAHRAAHALWSDNRRAPALLLQSRASEVFGVDIHPGARIGCGILLDHATGVVIGETAVVGYDVSILHGVTLGGTGKESGDRHPKVGDGVLIGAGASVLGNVHIGDGAKIGAGAVVLRDVADGTTAVGNPAKPIIGKKAAPQRRPEELPGVTMEQRWSD

SEQ ID NO: 8222 - DNA, 945 bp, Oryza sativa
  CDS (1)..(945)
atgccggccggccagccgcacgcgcacgagcccgacggcggcggcgcgagccaccgccggccccagtcgccgccgtcgctccccgcggaggtggtcccggcgttcgcgccgccggagtcggaggacgaggagtcctgggtctggtcccagatcaaggccgaggcgcgccgcgacgccgacgccgagccggcgctcgcgtccttcctctacgccaccgtgctctcccacccctccctcccgcgctccatctccttccacctcgccaacaagctctgctcctccaccctcctctccacgctcctctacgacctcttcctggcttccttcaccgcgcacccctccctccgcgccgccgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttga

SEQ ID NO: 8223 - protein, 314 aa, Oryza sativa
MPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 8224 - DNA, 1173 bp, Brassica napus
  CDS (1)..(1173)
atgttcccggtcacaagtcgccgccacttcacatcctccctatatatcctccgttcatcttctccacacaaccatctacgtcctctactctccctcctcttcctcccttccgtccgctcctccaaatccaaatccaaatcctcctcttcaaccaacaaacacaaccaacaatctcctcctccaatggccgcgtgcatcgacacgtgccgaaccggtaaaccacagatctcacgcgactcgaaccggtcccacgacgacgaatccggtttccgttactccaattactaccgcccctccggttatcatccaacaacccagacgaaaaccatccacacccgtcctctcgtcgaagacctcccaaacgacgacgtatgggccaagatccgacaagaggccagatccgacatcgagagagagccaatcgtctccggctactaccaggcctcgatcgtctcgcaacgatctctcgaagccgccttagccaacacgctctccgtcaagctcagcaacctgaacctcccgagcaacacgctcttcgatctcttcaacggcgtcctcgaacagcaccctaagatcgtcgagtccgttaagcaagacctcttagccgtcaaagaaagagaccccgcctgcatcagctacgtccactgcttcctccacttcaaaggctttttagcctgccaggcccatcgaatagcccacgagctttggacccaaaaccgaaaggttcttgctctgctgatccagaacagagtctccgaagccttcgccgtcgatttccaccccggggccaagatcgggacggggattttgctcgaccacgcgacggcgattgtgatcggagagacggcggtggtgggggataatgtttcgattcttcataacgtgacgcttggaggcacggggaagcagtgtggggataggcacccgaagattggggacggggtgttgatcggagctgggacgtgtattcttgggaatattacgattggtgaaggggcgaagattggggctggctcggtggtgttgaaggatgtgccgccgaggacgacggctgtggggaatccggcgaggttgcttggtgggaaagataatccgaagaagcatgataaggatcctggtctgactatggaccaaacctcgcatatatccgagtggtcggattatgttatttaa

SEQ ID NO: 8225 - protein, 390 aa, Brassica napus
MFPVTSRRHFTSSLYILRSSSPHNHLRPLLSLLFLPSVRSSKSKSKSSSSTNKHNQQSPPPMAACIDTCRTGKPQISRDSNRSHDDESGFRYSNYYRPSGYHPTTQTKTIHTRPLVEDLPNDDVWAKIRQEARSDIEREPIVSGYYQASIVSQRSLEAALANTLSVKLSNLNLPSNTLFDLFNGVLEQHPKIVESVKQDLLAVKERDPACISYVHCFLHFKGFLACQAHRIAHELWTQNRKVLALLIQNRVSEAFAVDFHPGAKIGTGILLDHATAIVIGETAVVGDNVSILHNVTLGGTGKQCGDRHPKIGDGVLIGAGTCILGNITIGEGAKIGAGSVVLKDVPPRTTAVGNPARLLGGKDNPKKHDKDPGLTMDQTSHISEWSDYVI

SEQ ID NO: 8226 - DNA, 948 bp, Brassica napus
  CDS (1)..(948)
atggcaccctgcatctacacgtccaatacccatctctctcaagacgataattctcggttccgttacatgaatctcttccctgatcggatttcacgagcacccttcacgaaaacctcaaactctctggacggtgatgatgaagatgtctggattaagatgcttgaagaagctcaatccgacgttgagcaagaacccatattgtcaagctactattactcttccgttacatcgcatcggtcgttagactccgctttggcgaacattctctcggtaaagctcagcactttaaccttaccaagcagcaccctcttcgaactcttcaccagcgtcttacaagaaagcccagagatcatggagtcggcgaaacaagacctgttagcagcaaaggaaagagacccagcttgcttaagctacgtccaatgcttcctaagcttcaaaggcttcctcgcttgtcaagctcatcgcatcgctcacaagctctggacccaagacagaaagatcctcgctttactcatccaaaacagagtatccgaagctttcgccgtcgatatccatcccggagctaagatcgggaaaggggtgctgttagaccacgcgacggccgtggtgatcggagagacggcggtggttggagacaacgtttcgattctccacggcgtgacgctcggaggaacagggaagcagtgcggcgataggcatccgaagatcggcgacggagtcttgatcggagcagggacttgtatactggggaatataacaatcggagagggagctaaggttggatcggggtcggtggtgcttaaagacgtgccgccgcatacgacggcggttggaaacccggcgagattgatcggtgggaaagagaatccgaaaatgcttgataagatacccggtttgagcatggaccagacatcgtacttaaccgagtggtctgattatgtcatctaa

SEQ ID NO: 8227 - protein, 315 aa, Brassica napus
MAPCIYTSNTHLSQDDNSRFRYMNLFPDRISRAPFTKTSNSLDGDDEDVWIKMLEEAQSDVEQEPILSSYYYSSVTSHRSLDSALANILSVKLSTLTLPSSTLFELFTSVLQESPEIMESAKQDLLAAKERDPACLSYVQCFLSFKGFLACQAHRIAHKLWTQDRKILALLIQNRVSEAFAVDIHPGAKIGKGVLLDHATAVVIGETAVVGDNVSILHGVTLGGTGKQCGDRHPKIGDGVLIGAGTCILGNITIGEGAKVGSGSVVLKDVPPHTTAVGNPARLIGGKENPKMLDKIPGLSMDQTSYLTEWSDYVI

SEQ ID NO: 8228 - DNA, 948 bp, Brassica napus
  CDS (1)..(948)
atggcaccctgcatctacacgtccaatacccatctctctcaagacgataattctcggttccgttacatgaatctcttccctgatcggatttcacgagcacccttcacgaaaacctcaaactctctggacggtgatgatgaagatgtctggattaagatggttgaagaagctcaatccgacgttgagcaagaacccatattgtcaagctactattactcttccgttacatcgcatcggtcgttagacaccgctttggcgaacattctctccgtaaagctaagcactttgaccttaccaagcagcaccctcttcgaagtcttcaccagcgtcttacaagaaagcccagagatcatcgggtcggcgaaacaagacctgttagcagcaaaggaaagagacccagcttgcttaagctacgtccaatgcttcctaagcttcaaaggcttcctcgcttgccaagctcatcgcatcgctcacaagctctggacccaagacagaaagatcctcgctttgctcatccaaaacagagtatccgaagctttcgccgtcgatatccatcccggagctaagatcgggaaaggggtgttgttagatcacgcgacggccgtggtgatcggagagactgcggtggttggagacaacgtttcgattctccacggcgtgacgctcggaggaacagggaagcagtgcggcgatcggcatccgaagatcggtgacggagtcttgatcggagcagggacttgtgtattggggaatataacaatcggcgagggagctaaggttggatcggggtcggtggtgcttaaagacgtgccgccgcatacgacggcggttggaaacccggcgagattgatcggtgggaaagagaatccgaaaatgcttgataagatacccggtttgagcatggaccagacatcgtacttaaccgagtggtctgattatgtcatctaa

SEQ ID NO: 8229 - protein, 315 aa, Brassica napus
MAPCIYTSNTHLSQDDNSRFRYMNLFPDRISRAPFTKTSNSLDGDDEDVWIKMVEEAQSDVEQEPILSSYYYSSVTSHRSLDTALANILSVKLSTLTLPSSTLFEVFTSVLQESPEIIGSAKQDLLAAKERDPACLSYVQCFLSFKGFLACQAHRIAHKLWTQDRKILALLIQNRVSEAFAVDIHPGAKIGKGVLLDHATAVVIGETAVVGDNVSILHGVTLGGTGKQCGDRHPKIGDGVLIGAGTCVLGNITIGEGAKVGSGSVVLKDVPPHTTAVGNPARLIGGKENPKMLDKIPGLSMDQTSYLTEWSDYVI

SEQ ID NO: 8230 - DNA, 20 bp, Artificial sequence
  primer
atgctgaattcactaattgc

SEQ ID NO: 8231 - DNA, 24 bp, Artificial sequence
  primer
ttagagggtgccccccaaaaattc

SEQ ID NO: 8232 - protein, 182 aa, Artificial sequence
  consensus sequence
  Variant (2)..(8): Xaa in position 2 to 8 is any amino acid
  Variant (12)..(19): Xaa in position 12 to 19 is any amino acid
  Variant (20)..(24): Xaa in position 20 to 24 is any or no amino acid
  Variant (26)..(27): Xaa in position 26 to 27 is any amino acid
  Variant (29)..(31): Xaa in position 29 to 31 is any amino acid
  Variant (32)..(32): Xaa in position 32 is any or no amino acid
  Variant (34)..(35): Xaa in position 34 to 35 is any amino acid
  Variant (36)..(36): Xaa in position 36 is any or no amino acid
  Variant (38)..(38): Xaa in position 38 is any amino acid
  Variant (40)..(48): Xaa in position 40 to 48 is any amino acid
  Variant (49)..(69): Xaa in position 49 to 69 is any or no amino acid
  Variant (73)..(73): Xaa in position 73 is any amino acid
  Variant (75)..(75): Xaa in position 75 is any amino acid
  Variant (78)..(82): Xaa in position 78 to 82 is any amino acid
  Variant (83)..(87): Xaa in position 83 to 87 is any or no amino acid
  Variant (90)..(91): Xaa in position 90 to 91 is any amino acid
  Variant (93)..(93): Xaa in position 93 is any amino acid
  Variant (100)..(101): Xaa in position 100 to 101 is any amino acid
  Variant (103)..(109): Xaa in position 103 to 109 is any amino acid
  Variant (110)..(110): Xaa in position 110 is any or no amino acid
  Variant (116)..(121): Xaa in position 116 to 121 is any amino acid
  Variant (122)..(131): Xaa in position 122 to 131 is any or no amino acid
  Variant (135)..(139): Xaa in position 135 to 139 is any amino acid
  Variant (141)..(143): Xaa in position 141 to 143 is any amino acid
  Variant (147)..(148): Xaa in position 147 to 148 is any amino acid
  Variant (151)..(154): Xaa in position 151 to 154 is any amino acid
  Variant (155)..(155): Xaa in position 155 is any or no amino acid
  Variant (157)..(161): Xaa in position 157 to 161 is any amino acid
  Variant (163)..(165): Xaa in position 163 to 165 is any amino acid
  Variant (168)..(170): Xaa in position 168 to 170 is any amino acid
  Variant (172)..(172): Xaa in position 172 is any amino acid
  Variant (174)..(175): Xaa in position 174 to 175 is any amino acid
  Variant (176)..(176): Xaa in position 176 is any or no amino acid
  Variant (178)..(179): Xaa in position 178 to 179 is any amino acid
  Variant (181)..(181): Xaa in position 181 is any amino acid
DXXXXXXXDPAXXXXXXXXXXXXXGXXAXXXXRXXXHXLXXXXXXXXXXXXXXXXXXXXXXXXXXXXXXIHPXAXIGXXXXXXXXXXDHXXGXVIGETAXXGXXXXXXXXVTLGGXXXXXXXXXXXXXXXXRHPXXXXXVXXXAGAXXLGXXXXXGXXXXXGXXXVVXXXVXPXXXTXXGXP

SEQ ID NO: 8233 - protein, 28 aa, Artificial sequence
  protein pattern
  Variant (3)..(3): Xaa in position 3 is Ala or Gly
  Variant (4)..(4): Xaa in position 4 is any amino acid
  Variant (6)..(6): Xaa in position 6 is any or no amino acid
  Variant (8)..(8): Xaa in position 8 is any amino acid
  Variant (9)..(9): Xaa in position 9 is any or no amino acid
  Variant (13)..(13): Xaa in position 13 is Ala, Cys, Ser or Thr
  Variant (14)..(14): Xaa in position 14 is any amino acid
  Variant (15)..(15): Xaa in position 15 is Ile or Val
  Variant (16)..(16): Xaa in position 16 is Asp, Glu or Gly
  Variant (17)..(18): Xaa in position 17 to 18 is any amino acid
  Variant (19)..(19): Xaa in position 19 is Ala, Cys, Ser or Val
  Variant (20)..(20): Xaa in position 20 is any amino acid
  Variant (21)..(21): Xaa in position 21 is Ile, Leu, Met or Val
  Variant (22)..(24): Xaa in position 22 to 24 is any amino acid
DHXXGXVXXGETXXXXXXXXXXXXVTLG

SEQ ID NO: 8234 - protein, 24 aa, Artificial sequence
  protein pattern
  Variant (2)..(5): Xaa in position 2 to 5 is any or no amino acid
  Variant (9)..(9): Xaa in position 9 is any amino acid
  Variant (10)..(10): Xaa in position 10 is Ile, Leu or Val
  Variant (11)..(13): Xaa in position 11 to 13 is any amino acid
  Variant (15)..(15): Xaa in position 15 is any amino acid
  Variant (16)..(16): Xaa in position 16 is Ile or Val
  Variant (17)..(17): Xaa in position 17 is any amino acid
  Variant (18)..(18): Xaa in position 18 is Ala, Ser or Thr
  Variant (19)..(19): Xaa in position 19 is Cys, Gly or Asn
  Variant (20)..(20): Xaa in position 20 is Ala, Ser, Thr or Val
  Variant (21)..(21): Xaa in position 21 is any amino acid
  Variant (22)..(22): Xaa in position 22 is Ile, Leu or Val
KXXXXRHPXXXXXVXXXXXXXXLG

SEQ ID NO: 8235 - protein, 13 aa, Artificial sequence
  protein pattern
  Variant (2)..(3): Xaa in position 2 to 3 is any or no amino acid
  Variant (6)..(6): Xaa in position 6 is Ala or Gly
  Variant (8)..(8): Xaa in position 8 is any amino acid
  Variant (9)..(9): Xaa in position 9 is Ile, Leu or Val
  Variant (11)..(12): Xaa in position 11 to 12 is any amino acid
  Variant (13)..(13): Xaa in position 13 is Phe, Ile, Leu or Val
IXXHPXAXXGXXX

SEQ ID NO: 8236 - DNA, 1812 bp, SACCHAROMYCES CEREVISIAE
  CDS (1)..(1812)
atgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttga

SEQ ID NO: 8237 - protein, 603 aa, SACCHAROMYCES CEREVISIAE
MPRNPLKKEYWADVVDGFKPATSPAFENEKESTTFVTELTSKTDSAFPLSSKDSPGINQTTNDITSSDRFRRNEDTEQEDINNTNLSKDLSVRHLLTLAVGGAIGTGLYVNTGAALSTGGPASLVIDWVIISTCLFTVINSLGELSAAFPVVGGFNVYSMRFIEPSFAFAVNLNYLAQWLVLLPLELVAASITIKYWNDKINSDAWVAIFYATIALANMLDVKSFGETEFVLSMIKILSIIGFTILGIVLSCGGGPHGGYIGGKYWHDPGAFVGHSSGTQFKGLCSVFVTAAFSYSGIEMTAVSAAESKNPRETIPKAAKRTFWLITASYVTILTLIGCLVPSNDPRLLNGSSSVDAASSPLVIAIENGGIKGLPSLMNAIILIAVVSVANSAVYACSRCMVAMAHIGNLPKFLNRVDKRGRPMNAILLTLFFGLLSFVAASDKQAEVFTWLSALSGLSTIFCWMAINLSHIRFRQAMKVQERSLDELPFISQTGVKGSWYGFIVLFLVLIASFWTSLFPLGGSGASAESFFEGYLSFPILIVCYVGHKLYTRNWTLMVKLEDMDLDTGRKQVDLTLRREEMRIERETLAKRSFVTRFLHFWC

SEQ ID NO: 8238 - DNA, 2087 bp, Glycine max
  CDS (88)..(1932)
gtcgcgtgagcgaatcgatacaccaccaagctatctctatacatttctagatcggagctccttgtgcagcgcccgacccccatcaccatgtcttacgacaagaacccatcgccggtgccgacgagcacgacgggcgatgaggagaagaaagtcaccggcggcggctacgacgtcggcgtctactctgcccacggacgagtcgaccacaatgcgcgtgcggttgacgggcacgacctcaacgactcgtacgacccgtccaaggagtcgctgctcacgcgattgggtctcaacatcgagagtttcaagcgggcacccggtaccacgcgcggtctcgtcgcccacggtgacatcccacccgagtacctgcaacacgacaacccgctgctgcagcagaagatgaagccgaggcatttgcagatgattgctgtcggtggatctatcggtactggtcttttcgtcggttccggagcttcccttggaaacggaggtcccgctgcggtgctcatggcctggattatcatgggtgtcatgttgatcatggtcacccaggctctcggtgaaatggctatcatctaccccgtctctggaggtttctacaccttggcttcccgtatgctcgacccctcgtttgcctttgctatgggctggaactacgttctccagtgggccgttgtccttccgctcgagatcactgttgccggtacgaccgttcagtactggacggacaaggtgccgctcggcgtgtggatcaccatcttcttcctgctcatcatcttcttcgccacgctcggcacactcggatacgccgaggaagagttctggtcgtcgtgtctcaagctcgccgtcgtcatcatgttcatcttcatcggtatcgtctgtatctgcggtggtggacccgccagcggtgactacggctcgtacgtcggtggccgatactggcaaaacccgggtgcgttcgccaacggcttcaagggtgtctgtgccatgttcgtcactgccgccttctcgttcgccggtaccgagctcgtcggtctcgccgcgaccgagacgcccaacccgcgcaagacgctcccctccgccgtcaagaacaccttctggcgaatcaccatcatctacatcacctcgctcaccatcatcggcctgctcatcccttacgatgaccccgatctgttcggcggctccggcgccaacgtctcgcccttcgtcatcgttctcgaccgagccaacatcggcggcttgaaccacctcgtcaacgccaccatctgtatctcggtcctgtccatcggtctctcgtgtgtctacgccggttcgcgaaccctcactgccctcgccgagactggttacgctcccaagatgttcacctacgtcgacaagtccggacgacccctgtactcggtcctcgccatcctcgcctttggccccatcgcgtacgtcaacctcgccaacgtcggaaccgacgtcttcaactggctcttggccctttccggtctgtccacccttttcacctggcttgccatctgcgtcacgcacatccgattcaggcaggcgtggaagatccagggccactcggtcgaggagctgccgtttaccgccatcgccggcgtgtggggctcgtggctcggtgccatcctcatcgtgatcgtcctcatcgctcagttctacatcggtctcttccccctcggaggcgtcgagagcggcaacgcccgtgctgagagcttcttcctctcgtacctggccttcccgatcctgctcgcattctgggttgtcggttacgcctggaagcgaactctgccccgaaagacgaccgaaatcgacctggacaccggccgaaagtcttggctcaccgtcgaggagatgaggcagtacaaggccgagcgacgactggctccgtggtggaagaggatataccgcatgctctttaccagcagctaagcgtcgcgtggcgtctctccttttcctgtcgtcatcgacaccaaaagtatcagctcacgggagggattggggaagaagagtaagccgggagagtgaagcacttgtagtcgacgcatctaattgtatcttccgatacatgcatgttgctagtcatc

SEQ ID NO: 8239 - protein, 614 aa, Glycine max
MSYDKNPSPVPTSTTGDEEKKVTGGGYDVGVYSAHGRVDHNARAVDGHDLNDSYDPSKESLLTRLGLNIESFKRAPGTTRGLVAHGDIPPEYLQHDNPLLQQKMKPRHLQMIAVGGSIGTGLFVGSGASLGNGGPAAVLMAWIIMGVMLIMVTQALGEMAIIYPVSGGFYTLASRMLDPSFAFAMGWNYVLQWAVVLPLEITVAGTTVQYWTDKVPLGVWITIFFLLIIFFATLGTLGYAEEEFWSSCLKLAVVIMFIFIGIVCICGGGPASGDYGSYVGGRYWQNPGAFANGFKGVCAMFVTAAFSFAGTELVGLAATETPNPRKTLPSAVKNTFWRITIIYITSLTIIGLLIPYDDPDLFGGSGANVSPFVIVLDRANIGGLNHLVNATICISVLSIGLSCVYAGSRTLTALAETGYAPKMFTYVDKSGRPLYSVLAILAFGPIAYVNLANVGTDVFNWLLALSGLSTLFTWLAICVTHIRFRQAWKIQGHSVEELPFTAIAGVWGSWLGAILIVIVLIAQFYIGLFPLGGVESGNARAESFFLSYLAFPILLAFWVVGYAWKRTLPRKTTEIDLDTGRKSWLTVEEMRQYKAERRLAPWWKRIYRMLFTSS

SEQ ID NO: 8240 - DNA, 1902 bp, Saccharomyces cerevisiae
  CDS (1)..(1902)
atgtcgtcgtcgaagtctctatacgaactgaaagacttgaaaaatagctccacagaaatacatgccacggggcaggataatgaaattgaatatttcgaaacaggctccaatgaccgtccatcctcacaacctcatttaggttacgaacagcataacacttctgccgtgcgtaggtttttcgactcctttaaaagagcggatcagggtccacaggatgaagtagaagcaacacaaatgaacgatcttacgtcggctatctcaccttcttctagacaggctcaagaactagaaaaaaatgaaagttcggacaacataggcgctaatacaggtcataagtcggactcgctgaagaaaaccattcagcctagacatgttctgatgattgcgttgggtacgggtatcggtactgggttattggtcggtaacggtaccgcgttggttcatgcgggtccagctggactacttattggttacgctattatgggttctatcttgtactgtattattcaagcatgtggtgaaatggcgctagtgtatagtaacttgactggtggctacaatgcataccccagtttccttgtggatgatggttttgggtttgcagtcgcttgggtttattgtttgcaatggctgtgtgtgtgtcctctggaattggtgaccgcatccatgactatcaaatattggacgacatctgtgaacccggatgtgttcgtcattattttctatgttttggtgattactattaatattttcggtgctcgtggttatgcagaagctgagttcttcttcaactgttgcaaaattttgatgatgactgggttcttcattcttggtattatcatcgatgttggtggcgctggtaatgatggttttattggtggtaaatactggcacgatccgggcgctttcaatggtaaacatgccattgacagatttaaaggtgttgctgcaacattagtgactgctgcttttgcctttggtggttcagagtttattgccatcaccactgcagaacaatctaatccaagaaaggccattccaggtgcggccaaacaaatgatctacagaatcttattcctattcttggctaccattattctactgggtttcttggtgccatacaattccgatcaattattgggttctaccggtggtggtactaaagcctcgccatatgtcattgctgttgcatcccacggtgtccgtgtcgtcccacacttcattaacgccgttattctactttccgtgctgtccatggctaactcctccttctactccagtgctcgtttatttttaactctatccgagcaaggttacgctcctaaggttttctcctacatcgacagagccggtagaccattgattgccatgggtgtttctgcattgtttgccgttattgccttctgtgctgcatctcccaaggaagaacaagttttcacttggttattggccatttctggtttgtctcagcttttcacatggactgccatttgtttatcccatcttagatttagaagagccatgaaagtccaagggagatctcttggagaattgggtttcaaatctcaaactggtgtttggggatctgcctacgcttgcattatgatgattttaattcttattgcccaattttgggtcgctatcgcccccattggtgaaggtaagctggatgcacaagcctttttcgaaaactacttggctatgccaatcttgattgcactttatgtcggctacaaggtctggcacaaggattggaaactgttcatcagggcagacaagatcgacctagattctcatagacaaatctttgatgaagaattaatcaagcaagaagacgaagaatatagggaacgtttgaggaacggaccttattggaaaagggtcgttgccttctggtgttaa

SEQ ID NO: 8241 - protein, 633 aa, Saccharomyces cerevisiae
MSSSKSLYELKDLKNSSTEIHATGQDNEIEYFETGSNDRPSSQPHLGYEQHNTSAVRRFFDSFKRADQGPQDEVEATQMNDLTSAISPSSRQAQELEKNESSDNIGANTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGFIGGKYWHDPGAFNGKHAIDRFKGVAATLVTAAFAFGGSEFIAITTAEQSNPRKAIPGAAKQMIYRILFLFLATIILLGFLVPYNSDQLLGSTGGGTKASPYVIAVASHGVRVVPHFINAVILLSVLSMANSSFYSSARLFLTLSEQGYAPKVFSYIDRAGRPLIAMGVSALFAVIAFCAASPKEEQVFTWLLAISGLSQLFTWTAICLSHLRFRRAMKVQGRSLGELGFKSQTGVWGSAYACIMMILILIAQFWVAIAPIGEGKLDAQAFFENYLAMPILIALYVGYKVWHKDWKLFIRADKIDLDSHRQIFDEELIKQEDEEYRERLRNGPYWKRVVAFWC

SEQ ID NO: 8242 - DNA, 1434 bp, Lactococcus lactis subsp. lactis Il1403
  CDS (1)..(1434): transl_table=11
atggaaaatcaaaatcaggtcaagcgcaaccttaaacagcgccacatcaccatgattgcattgggtggtacaattggaacaggtttatttttaacttcaggagcaacaattagtcaagcaggtccctggggcgcagttcttgcttattgttttattggtattatggtttacttcgtaatgacttccttaggtgagatggcgacatatttgcctacctcaggttcattctccgattatggcggtcgttatgttgatcctgcttttggctttgcattagggtggaactattggctcaatggagcgattaccattgccgtggatttaacgacagcaggattgattacgcagttttggttcccgcaccttccgtcttggatattttcaggaattgcgacggtcttaatttttattattaatgttatggcggttggagcattcggggaaacagaatattggttatcaacgattaaagtgattacgattgtcctctttttagctattggtttacttaccatttttggagttttgggacaaggaaatgttgatgtcgttgccaatttaagtgctggcaatcatggctttgttggtggaatttcaggatttgttggagttttacttattgccggattctcttttcaaggaactgagcttttagggattaccgcaggtgaatctgaagacccaggtaagtcaattcctaaagcaatgaactctattttctggcgtatcttacttttttacatcttttcaatcattgtgattgctgcaattatcaattttaaagaccctcgcttgttaaatccaaattcgacagctgtcatgagtccatttactattgtctttaaaaatattggctttgcagttgcagcttcagttatgaatgcggtcattcttacttcggtaatttcatcagcaaattcagtaatgtatgcttcaacacgtattctttattcattgggacaagaaaaaggcgcaccaaaattctttggacgaacagcaaaaaatggaattcctttttatgccctattagccacaacaattatttgttttattgctttcttaactggaatatttggaacgcaaatttatcttttcttggttgatttatcatcactaacaggctttcttgcttggcttggaatttctatcagtcatatccgttttagaagagcctatattgctcaagggaaaaaattggaagatcttccttacaaagctaaatggttcccatttggtccaattgttgcgctcttgatgactgcggcgattgccattaatcttgacccagccatgctctttagtgagcactggggtgaaggcttagctttatacgctgcaattcctattttcattattctttattttggttataaatggaagtataatacaaaaattattccacttgaagaagtagatttgagtcgggaaaaataa

SEQ ID NO: 8243 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 8244 - DNA, 1521 bp, Lactococcus lactis subsp. lactis Il1403
  CDS (1)..(1521): transl_table=11
ttgagtctgagtcaaacaagtcggtgtagaataaattttattagggagagaattttggaaaattcttcaaactcaactactgagacgcaagtaaaacgcggcttaaaatcacgtcatgtttccatgattgcccttggcggaacaatcggaactggattgtttctgacttcaggcgatgtcattcacacggcaggaccatttggtgcactgactgcctatgttcttatcggagcaatggtttacttcctcatgacatcacttggtgaaatggccacttatttacccacttctggttctttttcagactatggaacacgttatgttgacccagcttttggttttgctctaggttggaattactggttaaactgggcaattaccgtagcggttgatttaacagccgttgccctttgtatcaaattctggttaccagatgttccaagttggattttttcactgattgccttaattattgtctttgcaatcaatgccttatcagttaaaacttttggcgaaactgaatattggttgtcagccattaaaattactgttgttgttttattcttgattattggtttcttatctatttttggaattatgggcggtcatattgacgtcgctaaaaatctttcagttggtaatcatggttttgtcggaggacttggtagtttcactaccggcggagggattctcggcgtactcttagtcgctggtttctctttccaaggaacagaattgctcggaattacagctggcgaagctgaaaatcctgaaaaatcaattcctaaagctatgaactctatcttctggcgtattcttgtcttttatatcttatctatcttcgtgatggcggctatcattccatttaccgacccacacttagttggaggaaattcagctgctcaaagccctttcacaattgtatttgaacgtgttggtctctctattgcagcttctatcatgaacgccgttgttttaacttctgtcgtttcagcagcaaattctggaatgtatgcctctactcggatgctttattcactagctaaagatggtggcgcaccaaagattttctcaaaaacttcaaaaaacgggatccctttcattgctttattagctacaactgctattgctttactcacattcttgacatcaatttacggagttagcttctttacattcctcgtctcagcctctggtttaacaggatttattgcttggattgggattgcaattagccacttccgcttccgccgcgcctatgttgctcaaggaaaagatgttaaaaaattaccttatcatgcaaaactattcccatttggtccaatcttagccttaattatgaccgttttagtcacactcggccaagacccaatgcttctttttggtaaaacttgggtgcaaggtgtcatcatgtatgccgcaattccactcttcttcatcctttacttgggttataaatttaaaaacaaaacgaaacttatcccccttaaagaggttgatttaagtcgtcataaagattaa

SEQ ID NO: 8245 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 8246 - DNA, 1470 bp, Escherichia coli O157:H7 EDL933
  CDS (1)..(1470): transl_table=11
  misc_feature (170)..(170): w is a or t
atggtttccgaaactaaaaccacagaagcgccgggcttacgccgtgaattaaaggcgcgtcacctgacgatgattgccattggcggttccatcggtacaggtctttttgttgcctctggcgcaacgatttctcaggcaggtccgggcggggcattgctctcgtatatgtwgattggcctgatggtttacttcctgatgaccagtctcggtgaactggctgcatatatgccggtttccggttcgtttgccacttacggtcagaactatgttgaagagggctttggcttcgcgctgggctggaactactggtacaactgggcggtgactattgccgttgacctggttgcagctcagctggtcatgagctggtggttcccggatacaccgggctggatctggagtgcgttgttcctcggcgttatcttcctgctgaactacatctctgttcgcggctttggtgaagcggaatactggttctcactgatcaaagtcacgacagttattgtctttatcatcgttggcgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggggaaaaacattccacgcgcggtacgtcaggtgttctggcgaatcctgttgttctatgtgttcgcgatcctgattatcagcctgattattccgtacaccgatccgagcctgctgcgtaacgatgttaaagacatcagcgttagtccgttcaccctggtgttccagcacgcgggtctgctctctgctgcggcggtgatgaacgcagttattctgacggcggtgctgtcagcgggtaactccggtatgtatgcgtctactcgtatgctgtacaccctggcgtgtgacggtaaagcgccgcgcattttcgctaaactgtcgcgtggtggcgtgccgcgtaatgcgctgtatgcgacgacggtgattgccggtctgtgcttcctgacctccatgtttggcaaccagacggtatacctgtggctgctgaatacctccgggatgaccggttttatcgcctggctggggattgccattagccactatcgcttccgtcgcggttacgtattgcagggacacgacattaacgatctgccgtaccgttcaggtttcttcccattggggccgatcttcgcattcattctgtgtctgattatcactttgggccagaactacgaagcgttcctgaaagataccattgactggggcggcgtagcggcaacgtatattggtatcccgctgttcctgattatttggttcggctacaagctgattaaaggaacccacttcgtacgctacagcgaaatgaagttcccgcagaacgataagaaataa

SEQ ID NO: 8247 - protein, 489 aa, Escherichia coli O157:H7 EDL933
  misc_feature (57)..(57): The Xaa at location 57 stands for Stop, or Leu.
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 8248 - DNA, 1470 bp, Clostridium acetobutylicum ATCC 824
  CDS (1)..(1470): transl_table=11
atgtctgcagagttagagaaagataaaaatggtgaattaaagagaagtttaaaaacacgacatatgaatatgattgccattggaggatcaattggtacaggtttgttttttactagtggtaatacaataagtacggcgggtccaggaggtgctattgcagcctatgctattatgggggtgcttgtgtattttttaatgacatcgctgggagaaatggctacaatgataccaaacgctggttcatttgaaacctatgcctcaaagtttgtagatccagcattaggttttgcattaggttggaactactggtttaactgggcgataactgttgcagcagaattagttgcaggcggacttgttgttaagttttggttgccaaatacagggacaactatttggagtataggatttttagttattttatttggtctgaatttgctatctgcaaaagcatatggtgaaggagaatactggttttcaagtataaaagtcgtaacaattatagtatttcttattatgggagtgcttattatatttggaataatgggcggacatggagtaggttttagcaattgggtgcttaaggatggaaaagggaattcagcaccatttgtaggtggaggaatggctatattaatgagctttttaactgccggattttcttttgctggcacagaggtagtaggtttagctgctggtgaagctgaaaatccggaaaaggatgtaccaaaagcaataaattcagttttttggagaatacttattttttatattggtgcaattatagttattggttttatcattccttttaatgattctaatttgcttaaaaatggtgtatcagatatagcgtatagtccatttactatagtgtttaaaagatctggaattgctcttgcagcgtcaataatgaatgcagttatactaacttctgtgctttcctgtggtaattcaggtctttatgcaggttcacgtatgatgtatgctatggctaaagaaggaaaagcaccaaagatatttggtaaattaaataaaagtggtgtaccactaaatgctcttatttttacttctgttattgcatcaacagcgttttttgcatcgcttattggtgacggtaagatatattcaattctttacaatttatcgggtataacaacatttataacatggcttggaatagcaatttgtcattatagatttagaaaagcttatattgctcaaggaaataaaattgaagatttaaagtataaggctttattgtatccatttggtcctatatttgcaatgatactttgtacagtagttttatttggtgctaatatatgggtgtttcaagcaaaaaccttcagttggttcgattttacaactaactatggaagcattcctttatttttatgtttttattttatatataaaaaagtgcataaaacaaggatagtttctttaatggagtgtgatcttaataagtag

SEQ ID NO: 8249 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 8250 - DNA, 1476 bp, Clostridium acetobutylicum ATCC 824
  CDS (1)..(1476): transl_table=11
atgacgtctaaaaaagaacaaaagaatgagcttaagagaacactgacggcaaggcatatgaatatgatcgcaataggaggctctgttggaactggacttttttttgcaagtggaagtgcaataagcacagcaggaccaggaggagcgcttcttgcatatataatcacgggaattctagtttatgtactaatgatgtcactaggagaaatgtcaacactattacctatttcgggttcttttgaaacctatgctactagatttgtagatccagcacttggatttactcttggctggaactactggttttcttggtccatatgtgtggcatcggaattagttgcaggatcacttatagtgaagttttggtttcctcatactaatacaaccatttggagcataggatttttacttgtaatttttatactaaatattctttctgctaaagcttatggagaaagcgaatattggttttcaagtattaaggtagttactataatcatatttatcatagttggagtacttatgatatttggaattatgggaaatgattcacctggttttaaaaattgggttatatcgggaaatggttcgagagcaccgtttgtaggtggaatagcagcaattataaatgtttttttagttgcaggcttttcgttttcaggtacagaaatagttggacttgcagctggagaaacagaaaatcctgaggaaaacgtcccaaaggcaattaaatctgttttttggcgtatactactattttatatttgtgcaattataataataggctttctagttccttttaatgacaagaatctattaaaaagtggagttaataatatagcatatagtccatttacaatggtatttgcaaagtgtggaatagcttttgcggcaagtgctatgaatgctgtaattttaacctcagtactttcttgcggaaactcaggactttatgtatcatcacgtatgctatattctcttgcaaaagaaggaaaagcacctaagtttttagcaaaggtaaacaagcaaggtgtacctatgaatgcgttatatgcaacaactttagttgcatcctctgcatttttgtcatcacttattggtgaaggaaagatatactatgttttatacaatgcatctggaataacagcattgtttgcatggcttggtataggaatctgtcattacaggtttagaaaagcttatgtagcgcaaggaagagatttaaaggacttgaagtttaaggctaagttttatccttatggtcctattatggcaatagtgttatgcgtagtaataatatttggagctaacatatggatatttcaggctccaaagttcagttggtttgattttataagtaattacatttgtattcctatatttatagcactatatatagcatataaatacattaagaaaactaagctagttccgcttgaggaatgcgattttgaatataacggaaaagataaataa

SEQ ID NO: 8251 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 8252 - DNA, 1455 bp, Staphylococcus aureus subsp. aureus Mu50
  CDS (1)..(1455): transl_table=11
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatgtcatcaattggagagttggcaacattttatccagtatcaggttcattcagctcttattcaacacgctttattgactcatctcttggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagttcagacaaaaaagcaccccaatttttaagtaaattaaacaagacaactaagttacctttaagagcattattaactacttatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagaccctaataaggtcctaccatataaagcacctttttatccattaggaccaatcattgtcatcactacactattattcttgctatttggtggctcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaactaa

SEQ ID NO: 8253 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 8254 - DNA, 1494 bp, Staphylococcus aureus subsp. aureus Mu50
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggtgaaatggctacgtatttaccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcatggagtgcgttgtttttagttataatttttagtctgaattcgttatcagttcgcgtctatggtgaaagtgaatactggttggcattgataaaagtgattacagttattgttttcattgcaattggtttattaacgattgtaggaatcatgggtggtcatgttgtaggatttgaaatatttaataaaggtgaaggtcctattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatgggtggtagtgataatgtagcaacgtctccattcacattagtgtttaaaaatgctggatttgcgtttgcagcatcatttatgaatgcagtcattttaacgtctgtgttatcagcaggtaactcaggtatgtatgcttcaacccgaatgctatattcaatgagtaaagataaattagcgtttgaagcatttggtaaaacaaataaaaacggtgtgccatatatgtcgttactcgttacagcaatcattgtagtgattattttcgtattacaaagccttacaaaaggtgcatacgaatatatcgttgcagcaagtggtttaactggttttattgcttgggtaggtatagcagtaagtcattatcgatttagaagagcatttgataaacaaaattatgacaaatctaaattaaaatatactgctaaattattcccattcggaccattatttgctggctttttatgtattgtagtaattattggtcaagatgttgactttattaaaacaggagattttaattttagtcgcttcttaattacgtatatgggaattccagtatttttagcattctttatttatcataagcttcgatataaaacgaaaaaaattccattagaacaagtagatttacgtcaagacgtgtcaatggatgaaataaaaggttaa

SEQ ID NO: 8255 - protein, 497 aa, Staphylococcus aureus subsp. aureus Mu50
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 8256 - DNA, 1461 bp, Listeria innocua Clip11262
  CDS (1)..(1461): transl_table=11
atgaaaaaagaaacacatggcgagattcgtcgtgacttaaagacaaggcatctatccatgatagcaattggtggttcaatcggaacaggattatttttagcaagtggaaatgcgattcatactgctgggcctggtggagcgctagttgcttatattgcgattggcattatggtgtactttttaatgacaagcttaggtgagatggctacctatatgcctgtttccggctcatttagtacgtatgctagtcgatttgttgatccagcttttggttttgcactcggttggaactattggtttaactgggcgatcacgcttgcggtcgatatttcaacagcggcgattattgttcaattttggttgccgaatacgcctgcttggctctggagtgcgattttcttactcttgattttcgggttaaatgccctatcggtaaaagcttacggggagtcagagtactggttctcaattattaaagtagcgactgttattatttttcttatcgtcggtgtgctgacaattgttggtattcttggcggcgaagtgattggcttttctaactttacagcaggagatgcaccatttaaaggtggatttttcgcgatattaggcacgttcttgattgctggattttctttccaaggtactgaaatggttgggattgcagctggtgaaagcgctactccagaaaaaagtgttcctaaagcgattaagcaagttttctggcggattttgttattttatatttttgcgattttcattatcgggatgattattccttatactaatccgaatttactgagcgctgaggcaacagatgtggcgattagtccatttacgctcgtatttgaaaaggctgggctagcttttgcggcttcggtaatgaacgcggttatcttgacttccgttctatccgctggtaattcaggcctttacgcttccacaagaatgctttgggcaatggctcgtgataaaaaagctcctaaattcttaggcaaagtaaaccgtcgtggtatcccgatggctgcacttattgtgacaaccattgttggtgcgatgacattcattactacgcttaccgaaaatgggacagtgatttatacatggctcctttctgcctctggtttaaccggatttatcgcttgggtcggcatcgctattagccattaccgattccgtaaagctttcattaagcaaggccatgatttgaacgaactaaaatataaagccaaatttttcccttttggtccgattttagctttaatcttatgtattttagttattgtcggtcaagattacgcggcatttttaaaacctgaatttacgaatcctgcttggtggcaaaaaatcggtatttcttatatcggcctccctattttccttatcttctggttatcatttaaatttacaaataaaacaaaagtcattccactggaagactgcaaatttgatcaaaaataa

SEQ ID NO: 8257 - protein, 486 aa, Listeria innocua Clip11262
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 8258 - DNA, 1539 bp, Ralstonia solanacearum GMI1000
  CDS (1)..(1539): transl_table=11
atgtcagaacacaccaccgcgtccgccgggacgccgggcttgcgccggactttgcgtgcgcgccacctcaccatgatcgccatcggcgggtcgatcggcaccgggctgttcgtcgcctcgggcgcgtcggtgtcgcaggccggccccggcggcgcgctggccgcctacgtgctgatcgggacgatggtctactttctgatgaccagcctcggcgagctcgccgcctacatgccggtgccgggctcgttcgccacctacggcgcgcgctacgtggacgaaggcttcggcttcgcgctgggctggaactactggtacaactgggcggtgacgatcgcggtggagctggccgccgcgcagctggtcatgcactactggtttcccgaggtgccgggcgtgctgtggagcgcgggcttcctggcggtgatgttcctgctcaacgcgatctccgtgcgcggcttcggcgaggcggaatactggttcgcgctcatcaaggtcgtcaccgtgctgtgcttcatcgcgatcggcctggcgatgatcttcggcatcatcaagggcgcgccggcatcgggcctgcacaacctgaccctcggcgaggcgccgttcgtgggcgggctgccggcgatgatcggcgtggcgatgatcgccgggttctcgttccagggcaccgagctgatcggcgtggcggcgggcgaatcggccgacccggcgcgcaccattccgcgcgcggtccggcaggtgttctggcgcatcctgctgttctatgtgctggcgatcttcatcatcggcgcgctggtgccgtacaccgatccgaacctgctgtcgacggaggtcgccaacatcggcgtgagcccgttcacgctggtcttccgccatgccggcctggcctttgccgccgggctgatgaacgcggtgatcctgacggcggtgctgtcggcgggcaattcgggcatgtatgcgtccacgcgcatgctctacaacctcgccaccgaaggccgcgcgccgcgcctgttcgcgcggctatcgaagaacggcgtgccgcgcaatgcgctgctggccaccaccgccgtgggcgcgctgtgcttcctgagctcgctgtacggcgacaagaccgtctacctgtggctgctcaacacctcgggcatgaccggcttcgtcgcgtggctgggcatcgcgatcagccattaccgcttccgcaagggcctggtgctgcagggccacgacccggcgctgctgccctaccgctcgccgttctttccgtacggcccgctgttcgcgttcgggttgtgcctggtcatcaccctgggccagaactaccaggccttcgccagcggccgggtcgactgggccgaggtgaccgccacctatatcggcatcccgatcttcttcgcggtctggctaggctaccggctggtgcgcggcggcggcatcatccgctaccaggacatgcgcttcccgcgcccgcccgtcacgcgcgacccgccgggcgaagcgcccgccgcccccgggctgccggccgccgcgacgagcccgcagcgttga

SEQ ID NO: 8259 - protein, 512 aa, Ralstonia solanacearum GMI1000
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 8260 - DNA, 1470 bp, Clostridium perfringens str. 13
  CDS (1)..(1470): transl_table=11
atgagtcaagaacaaaatactaatctaaaaagaggcttgaaatcaagacatcttagcatgattgccatgggtggtgccataggaactggtattttcttagccatgggagatacacttcatcaagccggtgtaggaggagcttttgtagcttacggaatcataggagtaatggtatatttcttgtgtacaagcttaggggagatggcaacatatatgccagaaacaggttcctttggagcttatgcaacaaaatttgttgatcctgctttaggatttgctctaggatggaattactggtataactgggctataacaatagcagcagaaatggttgcaggttctttattaatgaagttttggtttcctaatattccagcaatagtttggagcgcattattcttagtaattatattaactcttaatttattatctgccaaagcttatggagaatcagagttttggtttgcagctgtaaaagttgctactgttataatattcttaatcgtaggagttcttatgatttttggaatattaggtggagataatgtaggattcaaaaacttctatgaaaatggagggccatttattggaggagcaaaatcaattttcatgatctttttaatagctggtttctcatttcaaggaactgaattagtaggggttgctgctggagaaagtgaagatcctgaaaaaaatgtacctaaggctgttaatacaatattttggagaatcttattattttatttaggaacaattttagtaataggtgctttagtgccaaatgctcaagcaggagtagaaacaagtgcatttacaatagtatttgaaaaattaggattagctggagccgcttctattatgaatgctataatacttacatccgttttatcagctggtaactctggtatgtatgcatcgagtagaatgctttatgctatggctaaaaatggaatggcacctaagatttttgaaaaaactaattctagaggagtaccagttaatgctattataataacaacaataattgcaagtttatgtttcttaacaggtatttatgccgaaaatacagtttatgtatggcttgtagcagcctcaggattatcaggatttatagcttggcttggaatcgcaatatgtcattatagatttagaaaagcttatgtagctcaaggtaaagatatgagtagattagtttataaagctaaattattcccactagggcctataatagctttaatattatgtggaataatagttttaggtcaaggatatgcatacttagatgttagaaatggagtagactggggtggattaatttcatcttatattggattacctctattctttggattatttgcatattataaaattaaatataaaactaaaataatagacttaaaagatgttgacttaagtgtagagcatatagatactgatgagagtatagaagatgaagtattttcttactaa

SEQ ID NO: 8261 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 8262 - DNA, 1512 bp, Yersinia pestis KIM
  CDS (1)..(1512): transl_table=11
atgactcagcaaaatactaaaatcccagcgcagcagggtgcacagcgcttacgccgggagcttaaatcgcggcatttagccatgattgctatcggtggttctattggtaccggtttatttgttgcctctggtgcaacggtatcgcaagccggtccagggggggcattgctctcctacgcattgattggcttgatggtttacttcctgatgaccagcttgggagaattggctgcgttcatgccagtttcaggctcattctctacttatggttctaaatatgtcgaggaaggctttggctttgccctaggttggaactactggtacaactgggcggtaaccatcgcagttgacttggtagccgcacagttagtgatgaactactggttcccggacgcgcccggttggatctggagtgctttattcctgggcctgatgttcttactgaactacatctcagtgaaaggtttcggtgaagcggaatattggttctcgctgattaaagtgacaaccgtggttatcttcatcatcgttggtgtcatgatgatcaccggtatcatgaaagggggcgaaacggcgggttggcataactggactatcggtgatgcaccatttgctggtggtttctctgccatgattggggtggccatgatcgtcggcttctccttccaagggactgaattgattggtattgcggctggggaatccaaagatccaggcaaaaatattccaaaggcaattcgcaaagtgttctggcgtattctgttgttctatatcttcgctattctgattattagcctgattattccgtataccgatcccagtttgttacgcaacgatgtgaaagatatcagcgtcagcccgttcacactggtattccagaatgcgggtctgttatcagcagcggcagtgatgaatgcggttattttgaccgctgttttatcggcgggtaactcggggatgtatgcctcgacccgtatgctgtttaccttagcctctgaaggcaaagcaccgcgtattttcgccaagttatctaagggcggtgtccctcgtaatgcgctgtatgccacgacagtcgttgcaggtttgtgcttcctgagctccatgtttggtaaccaaactgtgtatttgtggttactgaatacctcggggatgactgggtttatcgcctggttgggtattgccatcagccactaccgcttccgtcggggctatatgatgcagggccgtgacttgaacgacttaccgtatcagtctggtttcttccctctggggccaatttttgccttcgtcctgtgtctaatcatcacgttaggccagaattatcaggcattcctgcaagaccgtattgattggtatggcgtgacggcaacctatattggtattccattgttcctggtgatttggtttggctataagctcagccgtggtacccgggtagtgaaataccaagagatggaattcccaaaatggcgtgatgagagtgaagagcatcagaaaccgacaagtcggtga

SEQ ID NO: 8263 - protein, 503 aa, Yersinia pestis KIM
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 8264 - DNA, 1575 bp, Bifidobacterium longum NCC2705
  CDS (1)..(1575): transl_table=11
atgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtaatcggcaccggcctgttcctgagctccggatacaccatccagcaggcgggccccatcggcacgatcctggcatacagcatcggcgcgctgatcgtctatctggtcatgcttacgctcggcgaattgtccgtggccatgccggtgaccggctccttccacgtgtatgccgaaaagttcatcggccccggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccttaaacgccttgtcggtgcggctcttcgccgaagcggaattctggttcgcctcgatcaaggtgttcgctatctgcgcgttcatcgtcatcggcctgctcgccatattcggcgttattccgattgccggctaccagcatgctccgatgttcggcaacctcgttaaggacggcatcttccccaacgggttcatgccagtgttcgccacgattctgaccgtcaacttcgcgttctccggcaccgagctcatcggcgtgaccgccggcgagacgcgcgacccggaaaccaccgtgccgaaggccatccacaccacgctgtggcgcctggtgctgttcttcatcggctcgatcaccgtgatgtgcgcgctgatcccgtggcgccaggccggcgtgggcgaaagcccgttcgtgctcgtcttcaacagcatcggcatcccctatgcgggcgacatcatgaatttcgtggtgctgacggccgtgctttccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactga

SEQ ID NO: 8265 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 8266 - DNA, 1449 bp, Staphylococcus epidermidis ATCC 12228
  CDS (1)..(1449): transl_table=11
atggaagataataatatgaaacgtggtctcaattcgagacatatatctatgatagctataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttaactctgttgtttttaattaatattttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgataaaatagggatcgcttttgctgcatccgtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcattcgaaactttacaccattatttattctagctatcatctatattgctcataaattaatcaaacggacacattttgtcaaactggaagaaatagatttaactccgcataattacaagaattaa

SEQ ID NO: 8267 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 8268 - DNA, 1452 bp, Lactobacillus plantarum WCFS1
  CDS (1)..(1452): transl_table=11
atggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgttttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggttttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacaccatcaagattaa

SEQ ID NO: 8269 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 8270 - DNA, 1383 bp, Lactobacillus plantarum WCFS1
  CDS (1)..(1383): transl_table=11
atgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcccggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaaacggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacaactatgctaacggtcaactttgccttttctggaactgagctaattggaattacagctggtgagactaaggatccggcccacaccattccgaccgcaatcaaaacgaccctctggcgcctgattattttcttcatcggtagcatgttcgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaagcctacctgaaaagtgggcagtcgcttgatcaattgacttttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaa

SEQ ID NO: 8271 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 8272 - DNA, 1425 bp, Bacillus cereus ATCC 14579
  CDS (1)..(1425): transl_table=11
atggcgcaagtaagcaatacaaacaatgaattaaaacgtacgatgaaaagtagacacttattcatgattgcactcggtggtgtgattggaaccgggttatttaacggatctggctttattataagtcaggctggacctggtggatccgtacttgcctttattgctggtggattattaatgtatttcgttatgctatgtcttggtgaacttgctgtagccatgcctgtttcaggttcctttcaggaatatgctactaaatttatcaatcctgcaactggctttacaatcggatggttgtattggttaagctgggcgaatacgaccggtcttgaatttacaactgccggtattacaatgcagcgctggtttcctgatattcctgtttgggtttggtgtttaatatttggcgttaccatcttcactattaacgcattatctgctcgtagttatgcagaaacagaattttggttttcaagtataaaagtatctgccattatagcttttatacttcttggtggcgccgctatgttcggttttattgatttaaaaggcgatgaaccagctccacttctttcaaatttcgtaaatcatggtggtttatttccgaatggacttgcagctattctattaacaatggttacagtcaattattccttccaaggtacagagcttgtcggaatcgcagcaggtgaaagtgaagatccagcaaaaactttacctcgttctattagaaatattatatggcgcacaatgtttttcttcgtcttagcaatctttgttcttgttgctttaattccttgggaagaagctggattaacaaagagtccattcgttgctgtttttgataatatcggtattccatatgcagctgatattatgaactttgttattcttactgctgttctttctgtcgcaaactcaggactatacgctgctactcgaatgctttggtctttatcaaaaaacgaaatggctccagcatttttaaagaaattatcatcacgtgggattcctctcaacgctttaatcatgacaatagctatttctgctttttctcttttgacaagtgtagtagctgctgaaactgtttacttgtggctcatttcaatttccggagtcattaccattattgtttggatgtcaatttgtgtttctcaattctttttccgcaaacattatttagcagacggcggaaaattagaagacttaaaatttaaaacgccactttatccactcgtaccaattcttggttttggattgtatggcattatattaatcagtcttatttttatcccagaacaacgacttggaatctattgcactgtcccatttatcatcttttgctacacttactatcactttaaagttaagaaaagaaattctactaacactcatagtgaaactaaaattagcgagacttcgtaa

SEQ ID NO: 8273 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 8274 - DNA, 1476 bp, Bacillus cereus ATCC 14579
  CDS (1)..(1476): transl_table=11
atgttgaacatgaatagcgcaacaaatcaagctacctctaaaacagaaactacacaaggaaaaggtgaattaagacgcggtctaaaatcaaggcaccttacgatgatttctctcggtggtacaattggtaccggactatttcttgccagcggtggtgtcatccattcagctggacctggtggtgcattaattgcatacgccgcaattggaattatggtttacttcttaatgacaagcttagctgaactcgcagcttacatgcctgttactggatcttttagcacgtacgcaacaaaatttgttgatccatcacttggctttgcacttggatggaactattggtataactgggcaattacgattgctgctgaactagctgctgtaacattaattatgaaattttggttcccagataccccttctcttatttggagcggattatgtttagctattattttccttttaaactatttatctgttaaagggtttggtgaatctgaatattggttcgcacttattaaagtagttacgattattatctttttaattgttggtttcatgatgatttttggaattatgggcggcgaaacggttggcttcaaaaacttcactgttgcagatgcaccatttaacggcggtatcatggcaattatcggtgtgtttatggcagctggtttctcattccaaggtactgaactattaggagtagctgctggtgaaacatctgatccagaacgtaatatcccaaaagcaattcgttcaatcttttggcgtattcttttattctatatccttgcgattctcgttatcggtttattaattccttatacaactgaaagtcttgctgcaagtgatgtaacagtaagtccatttacacttattttcgaaaaagcgggcgttgcctttgctgcttctgttatgaacgctgttattttaacggcagtactatctgctggtaactctggtatgtatgcatcaactcgtatgctttgggatttagctcgccaagggaaggcaccaaagtttcttggtaaattagatagccgcggtgtacctgttaacgcattaatcgtaacatcgattgtcggtagtattgctttcattgcttctttattcggtgacggtgttgtatacatttggttattaaatgcatcaggaatgtctggctttatcgcttgggtcggcattgcaattagtcattaccgtttccgtaaagcgtatatcgcacaaggaaaagatttaaatgacttaccatatagagcaaaatggttccccttcggtccaatctttgcatttacactttgtatcatcgtaattttaggacaaaactacggggcatttatgggtgagtcaatcgactggaacggtgtactcgtttcttacatcggtttaccactcttcttagtactatggttaggttataaatttacgaaaaaaacaaaagtgattccacttgataaatgtgaactaaaataa

SEQ ID NO: 8275 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 8276 - DNA, 1575 bp, Bordetella parapertussis 12822
  CDS (1)..(1575): transl_table=11
atggctccaccgggccacgtcgtccccagcccggcgaacggccaccgccatgacgcccggcccgccacgcgcctgcccgaaccgacgagcctgcgccgcaccctgtcggcgcgccacctgaccatgatcgcggtcggcggctcgatcggcaccggcctgttcgtcgcctcgggcgccaccatcgcccaggccggcccgggcggcgccctgctggcctacttgctggtcggcatcatggtgtacttcctgatgaccagcctggacgaactggcggccagcatgccggtggcgggctcgttctccacctacggcgccaagtatgtcgacgaaggcttcggcttcgcgctgggctggaactattggtacaactgggccgtgaccgtcgcggtggacctggttgccgcgcagctggtcatggcctattggtttcccgaaatgcccggcgtgctctggagcgccgccttcctggcgctgatcgtcgggctgaacgccctgtcggcgcgcggcttcggcgaggccgagttctggttcgcgctgatcaaggtgatcgcggtgctggcgttcattgccatgggcgtgctgatgctgctgggcatcatccgcggcggcgagcacggcggcctggcctactggaccctggacgacgcgccattcgccggcggattcgccgcgctgatcggcgtggccatggtagtgggcttttcgttccagggcaccgagctgatcggcatcgccgccggcgaatccaaggacccggcccgcaacctgccgcgcgccgtgcgccaggtgttctggcgcatcctgctcttctacgtgctggccatcgccgtcatcggcctgctgattccctataccgatccgcaattgctgcgcaacgaggtgtccgacgtcagcgtcagcccgtttgcgctgatcttcgagcgcgccggcctgctggcggccgcctccatcatgaatgcggtggtgctgacgtcggtgctgtcggcaggcaattccggcatgtacgccgccacccgcatgctgtacagcctggcccgcgacggcaaggcgccggcgcgcttcggccgcctgtcgcgcagcggcgtgcccctgtgggcgctgctggccaccaccgcggtcgccgcgctgtgttttctgtcgttcctgttcagccccaaggcggtgtacatctggctgctgaacacctcgggcatgaccggattcatcgcctggctgggcatcgccatcagccactaccggtttcgccgcggctatgtcgcccagggcaacaacctggccgacctgccgtatgtctcgcccttcttcccgttcggcccgctgttcgcgttcgtcctgtgcctggtcatcacgctgggccagaactaccacgccttcctgcaggaccgcatcgactggaccggcgcggccgccacctatgtcggcattccgctgttcctggcgatctgggcgggctatcgcctggtgcgcggctcgcgcttcgtgcgctaccgcgacatgcagttccccgacctgcgcatgcgcaaccgcgagttgaacgccatgctcagcggcgactgcgccgagccccgccgctag

SEQ ID NO: 8277 - protein, 524 aa, Bordetella parapertussis 12822
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 8278 - DNA, 1575 bp, Bordetella bronchiseptica RB50
  CDS (1)..(1575): transl_table=11
atggctccaccggaccacgtcgtccccagcccggcgaacggccaccgccatgacgcccggcccgccacgcgcctgcccgaaccgacgagcctgcgccgcaccctgtcggcgcgccacctgaccatgatcgcggtcggcggctcgatcggcaccggcctgttcgtcgcctcgggcgccaccatcgcccaggccggcccgggcggcgccctgctggcctacttgctggtcggcatcatggtgtacttcctgatgaccagcctgggcgaactggcggccagcatgccggtggcgggctcgttctccacctacggcgccaagtatgtcgacgaaggcttcggcttcgcgctgggctggaactattggtacaactgggccgtgaccgtcgcggtggacctggttgccgcgcagctggtcatggcctattggtttcccgaaatgcccggcgtgctctggagcgccgccttcctggcgctgatcgtcgggctgaacgccctgtcggcgcgcggcttcggcgaggccgagttctggttcgcgctgatcaaggtgatcgcggtgctggcgttcattgccatgggcgtgctgatgctgctgggcatcatccgcggcggcgagcacggcggcctggcctactggaccctggacgacgcgccattcgccggcggattcgccgcgctgatcggcgtggccatggtagtgggcttttcgttccagggcaccgagctgatcggcatcgccgccggcgaatccaaggacccggcccgcaacctgccgcgcgccgtgcgccaggtgttctggcgcatcctgctcttctacgtgctggccatcgccgtcatcggcctgctgattccctataccgatccgcaattgctgcgcaacgaggtgtccgacgtcagcgtcagcccgtttgcgctgatcttcgagcgcgccggcctgctggcggccgcctccatcatgaatgcggtggtgctgacgtcggtgctgtcggcaggcaattccggcatgtacgccgccacccgcatgctgtacagcctggcccgcgacggcaaggcgccggcgcgcttcggccgcctgtcgcgcagcggcgtgcccctgtgggcgctgctggccaccaccgcggtcgccgcgctgtgttttctgtcgttcctgttcagccccaaggcggtgtacatctggctgctgaacacctcgggcatgaccggattcatcgcctggctgggcatcgccatcagccactaccggtttcgccgcggctatgtcgcccagggcaacaacctggccgacctgccgtatgtctcgcccttcttcccgttcggcccgctgttcgcgttcgtcctgtgcctggtcatcacgctgggccagaactaccacgccttcctgcaggaccgcatcgactggaccggcgcggccgccacctatgtcggcattccgctgttcctggcgatctgggcgggctatcgcctggtgcgcggctcgcgcttcgtgcgctaccgcgacatgcagttccccgacctgcgcatgcgcaaccgcgagttgaacgccatgctcagcggcgactgcgccgagccccgccgctag

SEQ ID NO: 8279 - protein, 524 aa, Bordetella bronchiseptica RB50
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 8280 - DNA, 1527 bp, Chromobacterium violaceum ATCC 12472
  CDS (1)..(1527): transl_table=11
atgagcaagaaacaagacgcgccggagctgcggcgctcgctgcaggctcgacacctgtcgatgatcgccatcggcggctcgatcggcaccggcctgttcctggcgtccggcgccaccatctcgggcgcgggcgccggcggcgcgctgctggcctacgcgctggtcggcctgatggtgtacttcctgatgaccagcctgggcgaaatggccgccttcatgccggtgtccggctccttccaggcctacggctcgcgtttcgtcgatccggccttcggcttcgcgcagggctggaactactggtacaactgggcgatcaccgtcgcggtggaactggccgcggccgccatcatcatgaactactggtatcccgggataccgggcgtggtgtggagcgggggcttcctggccatcatcttcgcgctcaactatttctcggtgaagggcttcggcgaggccgagttctggtgctcgatgctgaaggtggccaccatcatcgccttcatcgtcatcggcttcctgatgattctgggcatcatgaccgagccgaacccgagccgcatcgcgccgggtctgcaagtgatgatgcagggcgaggggcccttcgtcggcggcctggcggccttcgtcggcgtggccatggtggtgggcttctccttccagggcaccgagctgatcggcgtcgccgcgggcgagtcggccaaccccggccgcaccattccgcgcgccgtgcgccagatcttctggcgcatcctgatgttctacatgctgtccatcctgatcatcggtctgatcctgccgcacaacgatccgtcgctgctgaagaacgacatgaaggatgtcggcgccagcccgttcacgctggtgttcaaccgcgccggcctcgctttcgccgccagtctgatgaacgcggtgatcctgtccgccatcctgtcggccggcaactccggcatgtacgcgtccacccgcatgctgtacgcgatggccaagaacggcatggcgcccaaggttttcggcaagctgaccgacaacggcgtgccgcgcaacgcgctgtacgccaccacgctggtggcctgcctgtgcttcctgacgtcgttgttccagagcaacgctgtctacatgtggctgttgaactcgtccggcatgaccggcttcatcgcctggctgggcgtggcgatcagccattaccgcttccgccgcgcctacgtgaagcagggctacagcctggacgacctgccgtacaaggccaaatggttcccgctgggcccgctgttcgccttcgcgctgtgcctgctgatcatgctgggccagaactacaccgccttcaccgccgccaaggtggattggaacggcgtcatcgccacctatctgggcattccgctgttcctggcgctgtggtggggctaccgcgtcaagcacaatacccgcatggtgcccttggaaaaggtggaactggcggaggcgcatcgcaacgccttgatgcagcgagaggaaaatcgcggcggcaagcccgccgccgcccaggcctga

SEQ ID NO: 8281 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 8282 - DNA, 1542 bp, Bacillus cereus ATCC 10987
  CDS (1)..(1542): transl_table=11
ttgacttttctttttaattatctgaaaattataacaagatttcacatcacggaatatattccacaatacggaaaaacatcaaactttattctatcaactacgaaagtgaggaaaacaatggcgcaagtaaataatacaaacaatgaattaaaacgtacgatgaaaagtagacacttattcatgattgcactcggtggtgtgattggaacggggttatttaacggatctggctttattataagtcaagctggacctggtggatccgtacttgcctttatggccggtggattattaatgtatttcgttatgctatgtcttggtgagctcgctgtagccatgcctgtttcaggctctttccaggaatatgccactaagtttattaatcctgcaactggctttacaatcggatggttgtattggttaagctgggcaaatacaaccggccttgaatttacaactgccggcattacaatgcagcgctggtttcctgatattcctgtttgggtttggtgtttaatatttggcgttacaatcttcacaattaacgcattatctgctcgtagttatgcagaaacagaattttggttttcaagtataaaagtatctgccattatcgcttttattattcttggcggcgccgctatgttcggttttatcgatttaaaaggcgacgaaccagcaccgctattatcaaatttcgtgaatcatggtggtttatttccaaatggacttgcagctatcctattaacaatggttacagtcaattattccttccaaggtacagaacttgtcggaatcgcagcaggtgaaagtgaagatccagcaaaaactttacctcgttctattagaaatattatatggcgcacgatgtttttcttcgtcttagcaatctttgttctcgttgctttaattccttgggaagaagcaggattaacaaaaagtccgttcgttgctgtatttgataatatcggtattccatatgccgctgatattatgaactttgttattcttactgctgttctttcggtcgccaattcaggattgtacgcagcaactcgcatgctttggtcattatccaaaaatgaaatggctccagcctttttaaagaaattatcatcacgaggaatacctttgaatgctttaattatgacaattgctatttctgctttttctcttttaacaagcgttgtagctgctgaaacggtttacttatggctcatttccatttctggcgtcataacaatcattgtttggatgtcaatttgtgtctctcaattctttttccgtaaacattatttagcagacggcggaaaattagaggacttaaagttcaaaactccactttatccacttgtaccaatacttggttttggattgtacggcattatattaatcagtctaatctttatcccagaacaacgacttggaatctattgcactgtaccatttattatcttttgctacacttattatcacttaaaagttaagaaaagaatttctactaacactaatagtgagactaaaattagcgagacgatgtaa

SEQ ID NO: 8283 - protein, 513 aa, Bacillus cereus ATCC 10987
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 8284 - DNA, 1626 bp, Magnaporthe grisea 70-15
  CDS (1)..(1626)
atggaggccgacaagcacaaggagactgcaaacacgtcggcggtagtgtccgacaacaacagccacgatgaggaagtcggcgttgtcaacaagtcgaagcccttggtccgtgagctgcggaacaggcacatgcaaatgattgccattggcggatccatcggcgccggtctgttcgtcggtagtggaaaggctctgcgaaccggtggccctgcatcactgctgatctgttatagtatcatcggaggaatgcttttctttgtgtgccaagcactcgccgagttggctgtcttgtatcctgtaaacggtgctttctatacctatgtcgtccgctttgttgatccttcctggggcttcgctgttggttgggactacgcactttcatggcttaccgtcttgccattcgaactgatcgcagcatcaatcacgatcaagtactggcgcgacgacctgcgcccttccatctggatcgccaccttcctcgccgttctgatcattatacagttttttggagtcaggggttatggtgaagttgagttcatactcagcgtgatcaagattgcggcttgcactggtttcatcattctgggtattgtcatcaacactggtggtgtgggtgaccaaggatacctcggagcgaagtactgggtagatcccgggccttttcaaaatgggtttaacgggtttgcgggtgtatttgcaatcgcagcctttgcattcggcggtaccgagcttgttggcctggcagctgctgagtcggacaacccgaggaagagcatccccgcggcgagcaagcaggtgttctggcgcattgccttcttttacatcgtcaaccttttcatcattggtcttattgtgcccgccaacgaccctcgtctcatgggtgcctcgggcgccaacaccaaggcttctccctttgtgctcgccatcgaagatgccggtatccgcgtcctcccccacatcatgaacggggtcatcaccgtcgccgtcatctccgtggccaactcgtgcgcctttggcagcacccgtactatgcaggccatggccgagcgtggcatggcccccaagcagctcgcctatgtcgacaagaagggtcgcccagtcatttgcatcatcatccagctggcttttggtctcctcgccttcatcggcgagtccgccgactcgggcaaggtctttgactggctgctgtcgctctcggccctgtccttcttcttcgtctggggctccatctgcctcgcgcacatccgcttcagggccgcctggaagctgcagggctactcgctggagcagatcccctacaggccggcgtttggcgtctatggcagctggatcggcttcgctctcaactgcttgtgcctgattgcgactttttacaatgctttatacccatcgccgaacgccaaacccgacgccgaggtgttcttccagagctacctggctgctttcatcgtcatcggtctttaccgtgtgtctgagaaggtttactctagggaatggagcctttatgtgccactggccgacatcgacctcatgtctggagcccgcatggcggagccgtctgacgagcccgaggaggagcggacttggaagaaccttcccaagcgggtaatcaaggctctcttctaa

SEQ ID NO: 8285 - protein, 541 aa, Magnaporthe grisea 70-15
MEADKHKETANTSAVVSDNNSHDEEVGVVNKSKPLVRELRNRHMQMIAIGGSIGAGLFVGSGKALRTGGPASLLICYSIIGGMLFFVCQALAELAVLYPVNGAFYTYVVRFVDPSWGFAVGWDYALSWLTVLPFELIAASITIKYWRDDLRPSIWIATFLAVLIIIQFFGVRGYGEVEFILSVIKIAACTGFIILGIVINTGGVGDQGYLGAKYWVDPGPFQNGFNGFAGVFAIAAFAFGGTELVGLAAAESDNPRKSIPAASKQVFWRIAFFYIVNLFIIGLIVPANDPRLMGASGANTKASPFVLAIEDAGIRVLPHIMNGVITVAVISVANSCAFGSTRTMQAMAERGMAPKQLAYVDKKGRPVICIIIQLAFGLLAFIGESADSGKVFDWLLSLSALSFFFVWGSICLAHIRFRAAWKLQGYSLEQIPYRPAFGVYGSWIGFALNCLCLIATFYNALYPSPNAKPDAEVFFQSYLAAFIVIGLYRVSEKVYSREWSLYVPLADIDLMSGARMAEPSDEPEEERTWKNLPKRVIKALF

SEQ ID NO: 8286 - DNA, 1716 bp, Magnaporthe grisea 70-15
  CDS (1)..(1716)
atggcggacgagaagggtaccgtcggttccggtacccttcccacctacggcgcatcccctgatgcgtcgcaccaagacatggccatggatggccgcgaggagaacttttacacccgaaacggtctcaacctcgagtcgttcaagtgccgcagctacggccagggcattgtcgagctcgaccgctccatgaagaagcgccatttgcacatgattgccattggtggttctatcggtgctggtttcttcgtcggttccggtgctgccttcgccaagggtggtcccggtgccgtgttcatcgacttcgccatcatcggagtcatgatgttcaacgtcgtctacgctctcggtgaactcgctgtcatgtatcctgtctctggtggtttctacacgtactcggtccgcttcatcgatccttcatggggtttcgccatgggctggaactatgttttccaatgggctgtcgttcttcctctcgagcttactgtatgcggtctaacgttgaactactgggaaggcacacaagccgttccgctgtggggatggattctcatctggtggttcgccattatcatcatcaacatctttggcactcttggttacgctgaggaagaattctggtcatcatgcctgaagctttcggctattgtcatcttcatgatcatcgcttttgttctcgtcctcggcggcggccctaagggaggcaagtacgactcgtactggggtgcaaggcattggtacgagcccggtgcgttccagaacggattcaagggattctgcgccgtcttcgtcaccgctgccttctccttttccggcactgagctcgttggtctcgccgccgccgagtcggccaaccccgccaaggcccttcccggtgccatcaagcaggtgttctggcgtatcaccctcttctacatcctcggtctgttcttcgtcggactcctggtatcttcaaccgacgacaggctcctgagctccaacccgtacgccgacggtacctctcccttcgtcattgctgccaaggacgccggtctcgtcggattcgaccacttcatgaacgtcatcatcctggtttccgtcctgtccattggtgtttcttgcgtctacggaggctcgcgtacccttaccgctcttgcccagcagggttacgcccccaaggtcttcacctacgttgacaagtctggccgtcccctggcctccgtcttcgtaattatcgcttgcggtgcccttgctttcctcaacctggatgctggtgccgagaaggttttcagctggctcctttcgctttccggcctggctgccctcttcacctggggctccatctgcctggcccacatccgtttccgtcaggcctggaaggcccagggtcacaccctcgacgagattcctttccaggctgctcttggtgtcaccggctcctggatcggcctcattctttgtgtcctcgtcctgattgccactttctactcggctcttttcccctacaacaagcccggtgtcggtaccgccgagtcattcttccaggagtggctctcggtccccgtcattctcttcttctgggcctgtggttacatctggaagcgcgagggtggtctcaagctggagcagatcgacgtcgacactggtcgtcgtgagcacgactgggaccagatcaacgcctacaaggctgagctcgctgccatgccctcatggaagcgtttcgtgaagaagatcttctag

SEQ ID NO: 8287 - protein, 571 aa, Magnaporthe grisea 70-15
MADEKGTVGSGTLPTYGASPDASHQDMAMDGREENFYTRNGLNLESFKCRSYGQGIVELDRSMKKRHLHMIAIGGSIGAGFFVGSGAAFAKGGPGAVFIDFAIIGVMMFNVVYALGELAVMYPVSGGFYTYSVRFIDPSWGFAMGWNYVFQWAVVLPLELTVCGLTLNYWEGTQAVPLWGWILIWWFAIIIINIFGTLGYAEEEFWSSCLKLSAIVIFMIIAFVLVLGGGPKGGKYDSYWGARHWYEPGAFQNGFKGFCAVFVTAAFSFSGTELVGLAAAESANPAKALPGAIKQVFWRITLFYILGLFFVGLLVSSTDDRLLSSNPYADGTSPFVIAAKDAGLVGFDHFMNVIILVSVLSIGVSCVYGGSRTLTALAQQGYAPKVFTYVDKSGRPLASVFVIIACGALAFLNLDAGAEKVFSWLLSLSGLAALFTWGSICLAHIRFRQAWKAQGHTLDEIPFQAALGVTGSWIGLILCVLVLIATFYSALFPYNKPGVGTAESFFQEWLSVPVILFFWACGYIWKREGGLKLEQIDVDTGRREHDWDQINAYKAELAAMPSWKRFVKKIF

SEQ ID NO: 8288 - DNA, 1734 bp, Magnaporthe grisea 70-15
  CDS (1)..(1734)
atggacaaaacggaactgggcgccgccggcgtccacccggtcacttccaatgcggccggcagccaggaaaaggtgacgatccaagaggacaacaagcgcggcgaggactggtacacccgaaatggcctcaacctcaggtccttccagcggcgcgatgaggatagcggcactggcaccgccgaattggaccgtaccatgaagggtcgccacctgcacatgattgccataggtggttctatcggtgcgggtttctttgtcggttccggaggcgccctcggcagtggtggccctggatctctcctcatcaacttcctcatcatcggtgtcatgatgttcaacgtcgtctacgcccttggtgaactctccatcatgtaccctgtctccggtggcttctacacttactctgctcgcttcatcgacccgtcgtggggttttgccatgggttggaactacgttttccagtgggcaatcgtcctgcccctggaactgacggtctgcggtatcaccatatcctactggaacgatagtatcagcgtcggcgtgtggatcacggtgttctggcttgccatcctcatcatcaacatctttggaacgcttggttacgcagaggaggagttcgcatcgtcggcattcaagctgctcgccacctgcatcttcctcgtcatcgccttcgtcctcgtcctcggcggtggtcccaaggatggtcgctacaacgaatactggggtgcccgcctgtgggtggaccctggcccattccagaacggcttccgcggtttctgcagcgtgtttgtcacggcggcttttgctttcagcggaaccgagctggttggtttggccgctgctgaggcgcgcaaccccgtcaaggagatgcctggtgctatcaagcaggtcttctggcgtatcacactcttttacatcctcggtctcttcttcgtcggtctcctcatcgacgctcgtgaccccaaccttctcggatcctcgtcccacgatgtgcacgcctcgccctttgtcctcgtcggcaagtacgccggcctcaagggattcgatcacttcatgaacattaccattctcgtgtcggttctttccatcggagtgtcggctgtctacggtggctcccgtaccctcactgccctttctcaacagggctacgcccccaagatcttctcctacatcgaccgctccggccgtcccctctactcggtgggcatcattctcgtctttggtctgctggcctacgtcaaccttaacgcgcaaggcgaggttgtgttcaactggctcctctcgctgtcttcgctggccgctctgttcacctggggctccatctgcctcgcccacatccgcttccgcaaggcctgggcccacaacggccacaccaccgacgagatccccttcaaggccatcggcggcgtctggggctcgtaccttggactgacgcttaacattctcgtccttgcagctcagatctttgccgccatcgcccctccccccaaggccggcgaggagcccaccttcagcgacgccgagggcttcttcagcgccatgcttgccctccccatcgtcatcctgttctggatcatcggctacttgtggaagcgcgagggttggctcaagacggagcagatcgacgtcgactcgggacgccgtgagctgccgtgggatgagatcaatgcttaccgtgccgagctcgcggccatgccggcgtggaagcgcattgtgcacaccgttttcgtctaa

SEQ ID NO: 8289 - protein, 577 aa, Magnaporthe grisea 70-15
MDKTELGAAGVHPVTSNAAGSQEKVTIQEDNKRGEDWYTRNGLNLRSFQRRDEDSGTGTAELDRTMKGRHLHMIAIGGSIGAGFFVGSGGALGSGGPGSLLINFLIIGVMMFNVVYALGELSIMYPVSGGFYTYSARFIDPSWGFAMGWNYVFQWAIVLPLELTVCGITISYWNDSISVGVWITVFWLAILIINIFGTLGYAEEEFASSAFKLLATCIFLVIAFVLVLGGGPKDGRYNEYWGARLWVDPGPFQNGFRGFCSVFVTAAFAFSGTELVGLAAAEARNPVKEMPGAIKQVFWRITLFYILGLFFVGLLIDARDPNLLGSSSHDVHASPFVLVGKYAGLKGFDHFMNITILVSVLSIGVSAVYGGSRTLTALSQQGYAPKIFSYIDRSGRPLYSVGIILVFGLLAYVNLNAQGEVVFNWLLSLSSLAALFTWGSICLAHIRFRKAWAHNGHTTDEIPFKAIGGVWGSYLGLTLNILVLAAQIFAAIAPPPKAGEEPTFSDAEGFFSAMLALPIVILFWIIGYLWKREGWLKTEQIDVDSGRRELPWDEINAYRAELAAMPAWKRIVHTVFV

SEQ ID NO: 8290 - DNA, 1863 bp, Magnaporthe grisea 70-15
  CDS (1)..(1863)
atgccctcggagggggacatcgagatgcacagtctcgccgccaaggaggacataatgctggcccagcagggcagcagcagcaaccacagcatgcgccgcgagcccatatacgacgacaacacgcgcggccccagcgccctccgccgctgggccgacagcttccgacgcgacccgggcatacgcatcacaccaaaggaggtccccctgtatctagaccgcgatcaggtgcaccaccaccacattcaccacgagcagtaccaccacccgccgccgccactaccgccccaggtgcccatgcgcgaacacgatggcgagcgatactacgacctgcgcagcgccactctggctaccgtcaacactggcctgtcgcgcgagctcaagggccgccacctgcagatgatagccataggaggctccataggaactggtctgtttgtcgcatccggcaaggccctcgccaccggcgggcccgcctcggtcttgctggcatattgtatcatcggcgtcatgctgtactgtaccgtacatgccctgggagagctggccgtcgtgttcccagtcgcaggttccttctcggcgttttcgacccgcttcctggatccttcctgggggtttgcgatgggatggaacagcctccatgactatacaatactgggatcccagcgtgaaaagagccgtgtttgtggcaatattcttgatggtcatattggtctcaacttgttcggcgtcaagggatatggtgaagccgagtttatatttgccatagtcaaggtgacggctgttattggcttcatactcctgggcatcgtcataaatgtcggtggcaccacaacagagggatacatcgggaccaagtattggcacaacccgggcgcattcaacaatggcttcaaggggctctgctccgtctttgtccaggccgcctttgcgtttgccggtacggagctcgtcggcctcgccgccgccgagacggccaacccgagaaaatctctcccgacggccatcaagcaggtcttttggcgcatcacgctcttctacatcgtggccctgaccatcgtcggcttcctggttccgtacgactcgaaacgcctgctggccagaaacatcgccgacgccgctgcgtccccctttgtcatcgctatcgagagcgccggcatcgaggttcttccgtccatcatgaacagcgttatcctcatcgcggtgctcagcgtcggcaacagcgccgtcttcggctccagtcgcaccttggccgccctcgccgaccagggccaggccccgcgcatcttggcctacgtcgaccgccgcggccgcccccttgtggccattcttctcagcatgtctatcggcctgctggcctttgtggccgactcggatatacagcaggagctgctcgactggctcctcgccatctcggccctcagctccatcttcacctggggcagcatctgcctgtcgcacatacgcttccgccgcgcctggagcaaaaagggccgctcgctcggcgatctcgcctttcgcgcccagccgggcctggccggttcgtggatcggctttttgctaaacgccatcttcctcgtcgcccagttctgggtcggcggctggccgctcccacccgtcacgggcgaggagatgacgcccctctccatcgccggcgagttctttctgcagtgcatggccatccccatcgtcctcatcatgtggctcggccacaagctctactaccgcaccagcctcgtccgcaccgacgacatggacatcgacacgggccgccgcgactttaacctccccatcctcatggcccaggagtacgaggaaaagctcaactggccgcgctggaagcgtctgtataggttcttttgctga

SEQ ID NO: 8291 - protein, 620 aa, Magnaporthe grisea 70-15
MPSEGDIEMHSLAAKEDIMLAQQGSSSNHSMRREPIYDDNTRGPSALRRWADSFRRDPGIRITPKEVPLYLDRDQVHHHHIHHEQYHHPPPPLPPQVPMREHDGERYYDLRSATLATVNTGLSRELKGRHLQMIAIGGSIGTGLFVASGKALATGGPASVLLAYCIIGVMLYCTVHALGELAVVFPVAGSFSAFSTRFLDPSWGFAMGWNSLHDYTILGSQREKSRVCGNILDGHIGLNLFGVKGYGEAEFIFAIVKVTAVIGFILLGIVINVGGTTTEGYIGTKYWHNPGAFNNGFKGLCSVFVQAAFAFAGTELVGLAAAETANPRKSLPTAIKQVFWRITLFYIVALTIVGFLVPYDSKRLLARNIADAAASPFVIAIESAGIEVLPSIMNSVILIAVLSVGNSAVFGSSRTLAALADQGQAPRILAYVDRRGRPLVAILLSMSIGLLAFVADSDIQQELLDWLLAISALSSIFTWGSICLSHIRFRRAWSKKGRSLGDLAFRAQPGLAGSWIGFLLNAIFLVAQFWVGGWPLPPVTGEEMTPLSIAGEFFLQCMAIPIVLIMWLGHKLYYRTSLVRTDDMDIDTGRRDFNLPILMAQEYEEKLNWPRWKRLYRFFC

SEQ ID NO: 8292 - DNA, 1788 bp, Gibberella zeae PH-1
  CDS (1)..(1788)
atggctccccacgatgtcgagcgcggcagcattagcaagatgaaggaggagtcccttgctccggggagctccttcagcatgcgtgagcccgaatacgccgatattcttccaccatcgtactggggccgcttcgttgatggcttcagacgagaccaacggtcgagcttgttcaccaacgacccactcgggcagcaggagggattgggaagagtccatgatggagcgcattactatgatcttcagagcgctatgctagaaacggccaattcaggcctggcgagagaattgaagggccgacatttacagatgattgcaattggaggttctataggaagagctctggcagatggaggtccagcatcaatactgctagctttcactattgtgggagccatgctcttttgtacatgccaggcgctaggtgaactcgcagtcattttccccatcgctggatcgttttcatcttgggcaactcgatttattgacccttcatggggtttcgcaatgggatggaactacgcaatgcaatggttgattgtgttaccgcttgagatcatcgccgcatctctaaccctctcatactgggacgaaagtcttacccgcgccatcttcgtctcagcgtttctcgtactcatcatcgtcatcaatatgtttggtgtaaaaggctatggtgaagccgaatttatcttttctataataaaggtcattgccgtcattggcttcatccttcttggcatagttctcaactgtggcggaacgccagacagcggttatattggcggccgtttctggcatgaacctggtgctttcaacaacggtttcaaaggaatgtgcaacgtttttgtcacagccgcattttctttcgctggcaccgagcttattggcctcgctgccgctgaaactgccaatccacgaaagtcattaccaacagctttaaagcaggtgttctggcggattactcttttctatatcgttgcccttacgttggtagggttgcttgttccatacaacgacccccgacttaccaagggtactagcgacgcagatgcagctgcatcaccttttgttattgctatcgaagaagcgggtattcaagttctaccttcggtcatgaacgcagttatcctttgcgccgttctatctgttggaaactcggccgtgtttggatcttcacgtaccctcgccgctctcgcaaaccttcgacaagctccaaagatcttgggatatgtagatcgtaaaggtcgcccacttgtcgccattgccattgcgagtgcctttggtcttattgccttccttgctgatctcccccagcaaggggctgtactcgactggctcatgtccatatcaggtctatcaacgattattacatggggctcgatctgcgtctgccatattcgcttccgccgtgcctgggccgctcgtgggcgctctgtctcggaactgccctttcagtctcaagttggtgtcgtgggctcatggatcggcatcaccctcaacgtcctcgtccttatcgctcagttctgggtcggagcatttcccataggctggcaggacttgacgagctctcaggtagcgcagaacttcttccacaaatgggttggcgcaccttgcgtcctggccttttacattttccacaagctgtatttccgcaccacgtttgtaagaactcgagatatggacgttgatactggacgccgagatttcaacgttcctatacttgtagctcaagagaagcaagagcgcgcacgctggccgcggtggaagagatactataaatttatgtgctga

SEQ ID NO: 8293 - protein, 595 aa, Gibberella zeae PH-1
MAPHDVERGSISKMKEESLAPGSSFSMREPEYADILPPSYWGRFVDGFRRDQRSSLFTNDPLGQQEGLGRVHDGAHYYDLQSAMLETANSGLARELKGRHLQMIAIGGSIGRALADGGPASILLAFTIVGAMLFCTCQALGELAVIFPIAGSFSSWATRFIDPSWGFAMGWNYAMQWLIVLPLEIIAASLTLSYWDESLTRAIFVSAFLVLIIVINMFGVKGYGEAEFIFSIIKVIAVIGFILLGIVLNCGGTPDSGYIGGRFWHEPGAFNNGFKGMCNVFVTAAFSFAGTELIGLAAAETANPRKSLPTALKQVFWRITLFYIVALTLVGLLVPYNDPRLTKGTSDADAAASPFVIAIEEAGIQVLPSVMNAVILCAVLSVGNSAVFGSSRTLAALANLRQAPKILGYVDRKGRPLVAIAIASAFGLIAFLADLPQQGAVLDWLMSISGLSTIITWGSICVCHIRFRRAWAARGRSVSELPFQSQVGVVGSWIGITLNVLVLIAQFWVGAFPIGWQDLTSSQVAQNFFHKWVGAPCVLAFYIFHKLYFRTTFVRTRDMDVDTGRRDFNVPILVAQEKQERARWPRWKRYYKFMC

SEQ ID NO: 8294 - DNA, 1881 bp, Gibberella zeae PH-1
  CDS (1)..(1881)
atgtcacatgacattaagaagacgaccgacatcaaagtcgaggtcgctctcgcccgcgatgtcgaagccatcgagatgaacgacatgagcgcatcgtcgtcgcaatacaaggatgacggcaacaacaacaacaccaccaaagcctgggccgtctcggtgcccagctcagaggaacagtccagagaacagagcgattggttggatggttttcgaagggccgatcgacgaaagatgaagaagggttgggataaacaataccagtctgaggagccaccccaaatcccaggcgataacagatactttgacataagagctgccaatgcaaagacggcgacgtcggcgctggcaagggaattgaagggaaggcatttacagatgattgcttttggtggtgctattggtactggtctctttgttacttccggtacagctcttcacgaaggtggccctggtagtgttctgatctcatacattgccatcggtgctctacaatactgcaccatgcaatcgctcgccgaactcgccgtcatcttccccatcgctggttcattctctgccttttccacacgtttcctcgacccctcatggggctttgctatgggatggaattattgtctccaatggctcttcactctacctctcgagattatcgccggcgcttttactattacttactggaatgagggtatcaccaagtccgtctttgtcgtcattttccttgctgccattttcatcatcaacctctttggcgtaaaagcctacggtgaagccgagttcgtcttttcaaccatcaaagtcactgctatcgtcgccttcatccttcttggaatcgtcatcaacattggaggcgaacctacaggaagctacatcggaggccgctattgggttgacccaggcttcttcaacaacggcttcaaaggcttttgttccgtgctcgtcacgtcatgtttctcattcaccggcacagaacttatcggattagcagcagccgagacagccaaccctcgcaagtccctacccagcgccatcaagcaggtcttttggcgcatcacgctcttctacatcgtctccctcatgctcgtcagcctattggttcctcacaacgaccctcgcatcctcgatgccagctcctccaactctgccgcctcacccttcgttgtcgccattgaatcgatgggaacgacagtcttaccaagtgtcatgaacgccgtcattcttatcgccgtcatcagtgttggcaactcttctgttttcggttcctcgcgaacgctagctgctcttgcagatcagtctatggcgccagccatcttctcctatgttgataagcagggtcgtccgttggtggctatcatctttgcctcctgtgtcggattgttggcttttattgttgacttgaaggcccaaaatgttatctttaactggttgttgtctgttagttctcttgcgacgctgtttacctggggcagcatttgcctcacgcatatccgattccgcaaatcctgggcccatgcatcgcacactctcgagcaattgcccttccgcgcgcgatccggcaccgctggatcatggttcgctctctgcggatacactcttatcctgttgagccaagtctggacggctgtttcacccgtcgagatgaaggcagacgcgacaacaggagatattgttcaaaatgtcttccttcgactgatggctgtgcccattgttcttgtcatgtacgtcggccataagctttggtaccgaacgagctttgtcaagttggaggacatagatatccagacgggacgaagatactaccgtgtgcatttgatgaatgaggaggacagggaagcgagaggggcatggcctttgtggaagaagatctatcgccaagtctgctag

SEQ ID NO: 8295 - protein, 626 aa, Gibberella zeae PH-1
MSHDIKKTTDIKVEVALARDVEAIEMNDMSASSSQYKDDGNNNNTTKAWAVSVPSSEEQSREQSDWLDGFRRADRRKMKKGWDKQYQSEEPPQIPGDNRYFDIRAANAKTATSALARELKGRHLQMIAFGGAIGTGLFVTSGTALHEGGPGSVLISYIAIGALQYCTMQSLAELAVIFPIAGSFSAFSTRFLDPSWGFAMGWNYCLQWLFTLPLEIIAGAFTITYWNEGITKSVFVVIFLAAIFIINLFGVKAYGEAEFVFSTIKVTAIVAFILLGIVINIGGEPTGSYIGGRYWVDPGFFNNGFKGFCSVLVTSCFSFTGTELIGLAAAETANPRKSLPSAIKQVFWRITLFYIVSLMLVSLLVPHNDPRILDASSSNSAASPFVVAIESMGTTVLPSVMNAVILIAVISVGNSSVFGSSRTLAALADQSMAPAIFSYVDKQGRPLVAIIFASCVGLLAFIVDLKAQNVIFNWLLSVSSLATLFTWGSICLTHIRFRKSWAHASHTLEQLPFRARSGTAGSWFALCGYTLILLSQVWTAVSPVEMKADATTGDIVQNVFLRLMAVPIVLVMYVGHKLWYRTSFVKLEDIDIQTGRRYYRVHLMNEEDREARGAWPLWKKIYRQVC

SEQ ID NO: 8296 - DNA, 1614 bp, Gibberella zeae PH-1
  CDS (1)..(1614)
atggcttctactcctccccaagctgactacggcaaggaggccgttctcgatgtcagcgagaaccaagatgtcgagaccggcgaggtcaagaacggtggtctccagcgagatctcaagaaccgacacatgcagatgattgccatcggtggtgccatcggtgctggtctcttcgtcggttcgggtggtgcccttcagaagggtggccccgctgctctcctcatcggttacctcatcatcggtatcatgcttctctgcacatgcttggccctggctgagatggctgtcctctaccccgtcaacggtgccttcttcacatacatctgccgcttcgtcgatccttcttggggcttcgccatgggttggcaatacgctttggcttggttgactgtgctcccctttgaactgatcgctgcctccatcaccatcaagttctggagagaagatatcaacatggctgtctgggtctccgtcttccttgtcactctcattggtattcagttcttcggtgttcgaggatacggtgaggtcgagtttgtgctctccatcatcaagatctgcgcctgtgttggtttcatcatccttggtattgtcatcaactgtggtggtgtcggcgaccagggctacattggtgtcaagtactggcaggaccctggtgctttcaccagcttcaagggtttctgcgctgtctttgtcgtcgctgctttctctttcggtggtactgagatggttggtcttgctgctgccgagtccgccgacccccgccgatccatccccatggctagcaagcaggttttctggcgaattgccattttctacatcctcaacctgttcatcgtcggtctcatcctccccgccaacgaccctcgtctcatgggtgccagcggtgccaacactaaggcctctcccttcgttcttgctatccaggatgctggtatcaaggtcctccctagcatcatgaacgctgtcatcactgttgctgtcctctctgttgccaactcctgcactttcggttccacccgaaccatccaggccatggctgagcgcaacatggcccccggcttcttcaagtacatcgactccaagggccgccctctctactgtgttctcctccagatcgctttcggtctcctcgcctacatcggtgccgctcctcagggtatggagatctttggctggctcctggcccttactggtctcggtttcctcttcgtctggggttctatctgccttgcccacatccgcatgcgcgctggtatgaaggcacagggtgtcaacctcggcctcatcccctacaagacccccttcggcgttgctggttcttacctcggacttggactcaacattctcgctctcatcgcctctttctacactgctctctaccctgcctctggagcctctcctgccgctgaggccttcttcagctcttacctggctttcttctctgtcaccctcctctacgtcggttacaaggtctgcactcgcaagtggcagatgtatgtccgaccttctgagatggatctcagcactggagctgtcttcctcgaggaggaggagcccaaggagcctttcgtctgggccgacgcccctaagcgagtgctccgcagcttcttttaa

SEQ ID NO: 8297 - protein, 537 aa, Gibberella zeae PH-1
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICACVGFIILGIVINCGGVGDQGYIGVKYWQDPGAFTSFKGFCAVFVVAAFSFGGTEMVGLAAAESADPRRSIPMASKQVFWRIAIFYILNLFIVGLILPANDPRLMGASGANTKASPFVLAIQDAGIKVLPSIMNAVITVAVLSVANSCTFGSTRTIQAMAERNMAPGFFKYIDSKGRPLYCVLLQIAFGLLAYIGAAPQGMEIFGWLLALTGLGFLFVWGSICLAHIRMRAGMKAQGVNLGLIPYKTPFGVAGSYLGLGLNILALIASFYTALYPASGASPAAEAFFSSYLAFFSVTLLYVGYKVCTRKWQMYVRPSEMDLSTGAVFLEEEEPKEPFVWADAPKRVLRSFF

SEQ ID NO: 8298 - DNA, 1605 bp, Gibberella zeae PH-1
  CDS (1)..(1605)
atgtcatctcacaaagatgaagtcaaggacgaaaccaccgtcgcgacccctcacgatgaagagctcggctcgaccgatggtgaaggtcagctcaagcgtcatctgcaaaacagacacatgcagatgattgctatcggaggagccatcggagcaggtcttttcgtcggatctggaagtgctcttcacaagggaggtccagcagcgcttgttatcggatacctcatcatcggaatcatgcttctctgcaccaacctcgccctcgccgaaatggccgtcctgtaccccgtcaacggtgccttttacacctacatcgttcgcttcgtcgatccatcatggggtttcgcctgtggttgggaatacgccttgtcgtggcttacagttcttcctttcgagttgatcgccgcatccaagactattgagttttggcgttccgatatccacatggctgtttgggttactgtcttcctcgtcgctctcaccattgtccaaatctttggtgttcgtggttacggagaggtcgaatttgttctctcagccatcaagatcgctgcttgtttgggcttcatcatcctcggcatcatcatcaactgcggtggtgtcggtgatcagggctacctcggtaccaagtactggcacgaccccggtgctttcaccgacttcaagggtttctgcgctgttttcgtcgtagctgcctttgcctttggtggaaccgaaatggtcggtctcgctgccgccgaaacagctgaccctcgcaagtccgtccctactgcctccaagcaagtcttttggcgtattgctctcttttacgtcatcaacctcttcatcgtcggaaccatccttcgatcagacgatgacagactccagggtgcttctggtgccaacaccaaggcgtcacctttcgttcttgccattcaagacgccggtatcaaggttctgccatccatcttcaacgccgtgattacaatctcggttttgtccgtcgcaaacacgtgtacctttggttccacacgtaccatgcaagctatggctatgagaggccatgctcccaagttcctcaactacattgatggcaagggacgacctatttactgtgtcatcattcagctcggcttcggtctattggcgtacatcggagagtctcccaagggcggcaccattttcgattggctccttgccttgtccggtctcgcattcctcttcgtttggggaaccatttgtctcgcacacgcccgcatgagatctggaatgaaggctcagggtgtaaacatgaacttgatcccctacaagactccctttggtgtctggggtagctacttgggtgtcttcctcaatgtccttgctctggttgctactttctactcggcccttttcgctcctgatggctcggcccccaacgcagagtccttcttcatgtctttcctcgctggtcccatcattcttgtcctgtacctgggctacaaggtgtactctcgggattggaagttgtatgtcagggctattgatatggatctccagaccggtatttccttgttggatgaggagattcctgaagaacccaagacttgggcttctctgccaagacgtatcctgtcggctgttatctag

SEQ ID NO: 8299 - protein, 534 aa, Gibberella zeae PH-1
MSSHKDEVKDETTVATPHDEELGSTDGEGQLKRHLQNRHMQMIAIGGAIGAGLFVGSGSALHKGGPAALVIGYLIIGIMLLCTNLALAEMAVLYPVNGAFYTYIVRFVDPSWGFACGWEYALSWLTVLPFELIAASKTIEFWRSDIHMAVWVTVFLVALTIVQIFGVRGYGEVEFVLSAIKIAACLGFIILGIIINCGGVGDQGYLGTKYWHDPGAFTDFKGFCAVFVVAAFAFGGTEMVGLAAAETADPRKSVPTASKQVFWRIALFYVINLFIVGTILRSDDDRLQGASGANTKASPFVLAIQDAGIKVLPSIFNAVITISVLSVANTCTFGSTRTMQAMAMRGHAPKFLNYIDGKGRPIYCVIIQLGFGLLAYIGESPKGGTIFDWLLALSGLAFLFVWGTICLAHARMRSGMKAQGVNMNLIPYKTPFGVWGSYLGVFLNVLALVATFYSALFAPDGSAPNAESFFMSFLAGPIILVLYLGYKVYSRDWKLYVRAIDMDLQTGISLLDEEIPEEPKTWASLPRRILSAVI

SEQ ID NO: 8300 - DNA, 1872 bp, Candida glabrata CBS 138
  CDS (1)..(1872)
atgtctgattttaaagataattccgctgattttaatgataaagtcagtgataaagaggttgagtatatgtcacctcgtgaagtctctgtgactccggagacctctgctacaccaaatactccagccccatcccaatttagaagatttgttgactcattcaagagagctgaacaacaaaataactctgaaatcacctctgccgcttcttgtgatggtagttctgaaaacttggacaaagatggtaaagaagttgccgatcttgaagtacaagaaaatcaagttctcactgaaaagagtaatcaaaagaacaaagaattgaaacaaacaatcaaacctagacatgtcattcttatctctttgggtacaggtattggtacaggtttattggttggtaacgctaaggccctgcacaatgctggtcctgctggtcttctaattggttactctattatgggtacttgtctgtactgtattattcaagctgctggtgaattggctgtctcatacagttctctaagtggtggttttaatgtttatccttcattcttggttgaccctgcatttggtttctctgttgcttgggtatactgtatccaatggttatgtgtctgtcctttagaactggttaccgcctcgatgactattaagtattggactaccactgttaatgctgatatttttgttggtattttctacgtcttgatcattgtcattaatacttttggtgctcgtggttacgctgaagctgaattcttcttcaattgctgcaaaattctaatgatgattggcttctttatcctgggtattgtaatcaacactggtggtgctggtaatgatggctacattggtgacaggtactggcatacaccaggtgcctttgctggtgaccgtccaattgatcatttcaagggtatcatggctaccatggttactgccgcctttgcttttggtgccactgaattcatcgccttgactgctgccgagcaatcaaatccaagaaaggctattccatctgctgccaaaaaggttctttatagaattttgttcattttcttaggttcaatcactttggtcggtttcttggttccatatgactctgatcagttaatgggttctgggggttctgccacaaaggcctctccatatgttctggctgtttctacacatggtgtaaaagtcgttccacatttcattaatgctgtgatcctattgtcagttctatcggttggtaactctgctttctattccagttctcgtcttttgtactccttggcacaacaaggtaatgctccaaagttctttgactatgttgacagggaaggtagaccattcagagctatggtttgtgctggtgtatttgcaattatttccttctgtgctgcttctccaaaggaagaacaagttttcacctggttgttagctatttcaggtttatctcaagtatttacttggttcgccatttgcctatcccatattagattcagaaaggccatgtttgtacaaaagaggtctttgggagagattggtttcaaggctcagactggtgtttggggttcttactatgtctgtttcatgctggtcatgattttgattgctcagttctgggttgccattgcaccaattggtgaaggtaagttagacgcccaaggtttctttgagaattacttagctatgccaattttgattttattctacgttggttacaaaatttggaagaaggactggagcttgttcattagagcgaacaatattgacttggataagcacagacaaatttttgatgaagaattgttaaagcaagaagacgaagagtatagagagaagctaaagaatggtggctacctcaagagaatagctgccttctggtgttga

SEQ ID NO: 8301 - protein, 623 aa, Candida glabrata CBS 138
MSDFKDNSADFNDKVSDKEVEYMSPREVSVTPETSATPNTPAPSQFRRFVDSFKRAEQQNNSEITSAASCDGSSENLDKDGKEVADLEVQENQVLTEKSNQKNKELKQTIKPRHVILISLGTGIGTGLLVGNAKALHNAGPAGLLIGYSIMGTCLYCIIQAAGELAVSYSSLSGGFNVYPSFLVDPAFGFSVAWVYCIQWLCVCPLELVTASMTIKYWTTTVNADIFVGIFYVLIIVINTFGARGYAEAEFFFNCCKILMMIGFFILGIVINTGGAGNDGYIGDRYWHTPGAFAGDRPIDHFKGIMATMVTAAFAFGATEFIALTAAEQSNPRKAIPSAAKKVLYRILFIFLGSITLVGFLVPYDSDQLMGSGGSATKASPYVLAVSTHGVKVVPHFINAVILLSVLSVGNSAFYSSSRLLYSLAQQGNAPKFFDYVDREGRPFRAMVCAGVFAIISFCAASPKEEQVFTWLLAISGLSQVFTWFAICLSHIRFRKAMFVQKRSLGEIGFKAQTGVWGSYYVCFMLVMILIAQFWVAIAPIGEGKLDAQGFFENYLAMPILILFYVGYKIWKKDWSLFIRANNIDLDKHRQIFDEELLKQEDEEYREKLKNGGYLKRIAAFWC

SEQ ID NO: 8302 - DNA, 1818 bp, Candida glabrata CBS 138
  CDS (1)..(1818)
atgcctaaaaatccgctgaaaaagcagtattggactgaagttatcgatggcttccacagtcccgacagaacagacagtgccaatgacagaagctcaagcccagacaactttgagttgagttctgtcaactcaccagtacgagtgaacgtcagctctagtggtaatgatgatatactgaaaggagatacaaaggagtaccctcgtgatgtcaaagcgacacctgaagctgcatcatatgtcgaggatattaacaacactaacttgaacaaagacctgagtgtgcgtcacttgctgacacttgctgttggtggtgccattggtacaggtttgttcgtcaactccggtgcttctcttacaactggtgggcctgcatctctagtcatcggctgggtcattgtttctacttgtctgtttacagttatcaactctttgggtgaactggcggctgcattcccagttgttggtggtttcaacgtctacatcaccagattcatagaaccatcgttcgcatttgccatcaatctaaactacttggcccaatggttagtgttactgcctctagaactggtggctgcatccattactattagatattggaatgacaagatcaactctgacgcctgggttgccatcttctacactgctatcgcccttgcaaacatgcttgacgtgaaatcctttggtgagaccgaattcattctatccatggtcaagatcctagctatcatcggttttggtatcctgggtatcgtattgacctgtggtggtggtccacacggtggatacattggtggtaagtactggcataaccctggtgcctttgttggccacagcgctggctctcagtttaagggtctatgttccgtcttcgttaccgctgcattctcatattccggtattgaaatgacagccgtctctgctgctgaaagtagaaaccctaaggagactatcccaaaggccgctaagaggactttctggttgatcacagtatcctatgttggtattttgactctaattggctgtttggtcccatacaacgatccaagactgctaaacggtagcagttccgtcgatgccgccgcttcaccattagtcatcgcaattgagaacggtggtatcaagggtcttccttctttgatgaatgccattatcttgatcgccatcgtcagtgtcgccaatagtgctgtctacgcttgttctcgttgtatggtttccatggctcacattggcaacttaccaaaattcttgagtaaagttgacaagcgtggtagaccattgaacgctattctattgaccttgtttttcggtctactgtccttcattgctgcgagtgacaagcaagaagaagtattcacttggttgagtgctctatccggtttgtctactattttctgctggatggccatcaacttgtcgctaattagattcagggatgccatgaaggctcaaggtagatctctagacgagatgccattcctttcacaatcaggtacttggggtgcatggtatggtgtcatcgtgctattcttggttctagtagcatcgttttggacctcgctattcccagtgggttcctccaccgcaagtgcaaaatcatttttcgaaggctatctatctctacctatcctaattgcgtgctacgtaggacacaagctatggaagagagactggagattactagtgccactaatggaaatggacttagattccggtagaagagtgctagacgcagagaccagagaggaagagttgcgtgtagagagagaatacttggccaatgcctctttctttacccgtttcttgcacatctggtgttaa

SEQ ID NO: 8303 - protein, 605 aa, Candida glabrata CBS 138
MPKNPLKKQYWTEVIDGFHSPDRTDSANDRSSSPDNFELSSVNSPVRVNVSSSGNDDILKGDTKEYPRDVKATPEAASYVEDINNTNLNKDLSVRHLLTLAVGGAIGTGLFVNSGASLTTGGPASLVIGWVIVSTCLFTVINSLGELAAAFPVVGGFNVYITRFIEPSFAFAINLNYLAQWLVLLPLELVAASITIRYWNDKINSDAWVAIFYTAIALANMLDVKSFGETEFILSMVKILAIIGFGILGIVLTCGGGPHGGYIGGKYWHNPGAFVGHSAGSQFKGLCSVFVTAAFSYSGIEMTAVSAAESRNPKETIPKAAKRTFWLITVSYVGILTLIGCLVPYNDPRLLNGSSSVDAAASPLVIAIENGGIKGLPSLMNAIILIAIVSVANSAVYACSRCMVSMAHIGNLPKFLSKVDKRGRPLNAILLTLFFGLLSFIAASDKQEEVFTWLSALSGLSTIFCWMAINLSLIRFRDAMKAQGRSLDEMPFLSQSGTWGAWYGVIVLFLVLVASFWTSLFPVGSSTASAKSFFEGYLSLPILIACYVGHKLWKRDWRLLVPLMEMDLDSGRRVLDAETREEELRVEREYLANASFFTRFLHIWC

SEQ ID NO: 8304 - DNA, 1734 bp, Candida glabrata CBS 138
  CDS (1)..(1734)
atgtcgaccaaggagtttaaggaggagatccatacttctacctctgagtttaccaaatatgactctcaaaagccgtattatagttccggcgagtctccggaaccagtcgttaccaagagaaatatattccaaagatgtgtcgattctttcaagccaccagtggatggttccttcgatactagtaacttaaagagaacactgaagtctaggcacctgattatgatcgccatcggtggtagtataggtactggtttgttcattggtagtggtcaagcgttggccacaggtggcccactagcagttatcatcggttggactattgcgggatctcagattgtcggtaccatacatggtcttggtgaaataactgtgcgattccctgttgttggtgcatttgcagactacagtaccagattccttgatccaagtatcagttttgtggtttctacgatttatgtgatacaatggttctttgtcttacccttggaaattattgcctcagctattaccatacaatattggaactcttctattgatcccgtggtctgggtcgcaattttttatggtgtcattgttagtatcaatcttttcggtgccagagggtttggtgaagccgaatttgtcttctctaccattaaggctatcacaatctgtggattcattattctatgtattgtgctaatttgtggtggtggtccagaccatgaattcattggtgccaagtactggcatgatccaggtgctttggcacatggattccctggtgtcttgtctgtgcttgttgttgcatcttactccctaggtggtacggagatgacttgcctagcttcgggtgagactgatccaaaggaattgccaagtgccatcaaacaagtgttctggcgtatattatttttctttctagcttcattaaccctagtcggatttttagtcccatacacaaatgaaaatcttttaggtggttcttccgttgataactctccatttgttatcgctatcaagctacatcacatcaaagctctaccatcgatagttaatgctgttattttgatcagcatcctaagtgtcggtaattcatgtatttttgcttctagtagaactctttgttccatggcacaccaaggattgattcctagattttttggttacattgacagagccgggagacctctagctggtattgttaccaactctctattcggtctactggcatttttggtcaagtcaagctctgtcagtgaggtgtttgactggttaatggcaattgccggtctagcgacttgtattgtctggctaagtatcaatctatcacacatcaggttcagactggcaatgaaagcacaaaataaaactcttgatgaacttgagtttgtcagcgccgttggtatttggggttcagcttactccgcacttatcaatgtcctgattttaatcgcacaattttacatttccttgtggccaattggagggtggactgatagtagtcaaagagcaaagaaattttttcaaagttatttatgtgctttgattatgcttctaatcttctgtattcacaaagtatattatagagtaagctttggtaaatggtgggacgtaaaaccattaaaagatatcgatttagaaactggtcgtaagaatgttgatatcgacgttataaaagctgagatcgccgaaagaaagatgtacttgaagaagaaaccatggattgttagatggtaccatttctggtgctga

SEQ ID NO: 8305 - protein, 577 aa, Candida glabrata CBS 138
MSTKEFKEEIHTSTSEFTKYDSQKPYYSSGESPEPVVTKRNIFQRCVDSFKPPVDGSFDTSNLKRTLKSRHLIMIAIGGSIGTGLFIGSGQALATGGPLAVIIGWTIAGSQIVGTIHGLGEITVRFPVVGAFADYSTRFLDPSISFVVSTIYVIQWFFVLPLEIIASAITIQYWNSSIDPVVWVAIFYGVIVSINLFGARGFGEAEFVFSTIKAITICGFIILCIVLICGGGPDHEFIGAKYWHDPGALAHGFPGVLSVLVVASYSLGGTEMTCLASGETDPKELPSAIKQVFWRILFFFLASLTLVGFLVPYTNENLLGGSSVDNSPFVIAIKLHHIKALPSIVNAVILISILSVGNSCIFASSRTLCSMAHQGLIPRFFGYIDRAGRPLAGIVTNSLFGLLAFLVKSSSVSEVFDWLMAIAGLATCIVWLSINLSHIRFRLAMKAQNKTLDELEFVSAVGIWGSAYSALINVLILIAQFYISLWPIGGWTDSSQRAKKFFQSYLCALIMLLIFCIHKVYYRVSFGKWWDVKPLKDIDLETGRKNVDIDVIKAEIAERKMYLKKKPWIVRWYHFWC

SEQ ID NO: 8306 - DNA, 1839 bp, Candida glabrata CBS 138
  CDS (1)..(1839)
atgaactctaacgatctattgtccgaggttaaagtgtcttcttcggaagactctcaaatcctctccaagagtaacgactatgtacacgaacagaaccatatcatagaaggtgactacgatgatgacgataagtcgtcgtcatcgcataacctgaggtctaggttcgatgttcaagtcaagaacagacacttacagggattcatcgattctttcaagagggccgacgactctccagaccacaatgacctcgagaagaccaccaccgcacaccaggagcagaagaagaccatgaagtccaggcacgtcatcatgatgtccctgggtaccggtatcggtacgggtctgttggtctccaacggtaaaggtctgtccctggctggtcccgcctctttggtcatcgcatatggtctcgtctccttcgtcacttacttcatgatccaggcagccggtgagatggctgttacttacccaactctgcccggttccttcaacgcttacacttccttcttcatctcaaagcccttcggtttcgctacaacttggctgttctgcatccagtggctcaccgtgctgcctttggaattgatcacagcagctatgaccatcaagtactggaacacctccatcgacccagacgtcttcgtcattatcttctacgtgttcctgatgttcatccacttcttcggtgtgcaggcctatggtgaaacagaattcatcttcaacgcttgcaaaatcctcatgatcggtggcttcatcatcttcgctatcgtcgtcaactgcggtggtgccggtaaggacggctacatcggtggcaagtactggcacgacccaggtgccttcgcatcctcaaacggcgcatccagattcaaaggtatctgctacaacttggtcaacgcatacttctcctacggtggtaacgaactgttcgtcttgtccgtgaatgaccagaagaacccaagaaagtccaccccagcagcagccaagagtaacgtctaccgtatcgtggtcatctacttactaacaatgatcttgatcggtttcgttgtcccacacaacagctctgaactgctaggtgccagcggcggtaacggcttgcacgcatccccatacgtcttggcagcctccattcacggtatcaaagtcgtcccacatatcatcaacgcagtcatcttgatcgcattgatctcagtggccaactcctccttatacgccggccctagattactgagctccttggctcaacagggctacgccccaaggttcttgagttacgtcgacagaagaggcagacctttgaccgctttgctactttccgctttggtcggtgtcatcggtttcgcagctacctccccaagagaagaagaagtctttacgtggctcgctgccatctcaggtttaagtgaactgttcacatggacctccattatgttctcacacattagattcagaagagcaatgaagttgcaaaacaaatcgctagacacattgggatacaaagctaacactggcctgtggggttcttacttcggtgtaggtttcaatatccttgtgtttgctgctcaattctgggtcgccctatctccaccaaactccggtggtaaatgtgatgccaactccttcttcgcaagttacctagccatgccaatttggttggtgttctatttcggctacatgtgctggtacaaggacttcactgtcttgactgatttgaatcaagtggacttggataaccacagaaaagtttatgacccagaattcttgagacaggaagacctggaaaacaaagaaagattgagaaactcatcgttcttggtgaaaatctatgagttctggtgttaa

SEQ ID NO: 8307 - protein, 612 aa, Candida glabrata CBS 138
MNSNDLLSEVKVSSSEDSQILSKSNDYVHEQNHIIEGDYDDDDKSSSSHNLRSRFDVQVKNRHLQGFIDSFKRADDSPDHNDLEKTTTAHQEQKKTMKSRHVIMMSLGTGIGTGLLVSNGKGLSLAGPASLVIAYGLVSFVTYFMIQAAGEMAVTYPTLPGSFNAYTSFFISKPFGFATTWLFCIQWLTVLPLELITAAMTIKYWNTSIDPDVFVIIFYVFLMFIHFFGVQAYGETEFIFNACKILMIGGFIIFAIVVNCGGAGKDGYIGGKYWHDPGAFASSNGASRFKGICYNLVNAYFSYGGNELFVLSVNDQKNPRKSTPAAAKSNVYRIVVIYLLTMILIGFVVPHNSSELLGASGGNGLHASPYVLAASIHGIKVVPHIINAVILIALISVANSSLYAGPRLLSSLAQQGYAPRFLSYVDRRGRPLTALLLSALVGVIGFAATSPREEEVFTWLAAISGLSELFTWTSIMFSHIRFRRAMKLQNKSLDTLGYKANTGLWGSYFGVGFNILVFAAQFWVALSPPNSGGKCDANSFFASYLAMPIWLVFYFGYMCWYKDFTVLTDLNQVDLDNHRKVYDPEFLRQEDLENKERLRNSSFLVKIYEFWC

SEQ ID NO: 8308 - DNA, 1794 bp, Candida glabrata CBS 138
  CDS (1)..(1794)
atgaagttcaggaatatattgaagaatgagaagaatgagaagaacgaggcttccgcctcgacttctcatgcttccgaagacatagaaattataccatcccgctacgataacgagaagttctactccgccacagaggccacacataagaagaaaaccggctctacagggttcgacgataccatctcgctgacacatacgctctctaggtcgcgcatacccacgtctatggaggacgaggatgccgaagaagcagaggtgcacgacactcgtgtcaagcgtgcgttgaaacagagacacatcggtatgatcgccctgggtggtactatcggtactggtctgttcgtcggtatctccacgccgctgtccaactcgggccccgtgggcgctctgatcgcgtacatcttcatgggtaccatcatctacttcgtcacacagtccctgggtgaaatggccactttcatccccgtcacttcctccatcacagtcttctcaaagagattcctgtcgcctgcattcggtgtcgctaacggctacatgtactggttcaactgggccatcacctacgcagtagaagtctccgtcatcggccaggtcatccagtactggacttttaaagtgcctctggccgcctggatcggtatcttctgggtcctgatcacactgatgaacttcttcccagtgaaaatatacggtgaattcgagttctgggtcgcatccatcaaagtcatcgccatcgtcggctacttgatatacgccctgatcatcgtgtgcggtggatcccaccagggccctatcggcttccgttactggcgtaaccctggtgccatgggcgccggtatcatctcgtcagacctgggagaagccagattcttgggctgggtctcgtcattgatcaacgctgcgttcacttaccaaggtactgaactggtcggtatcaccgccggtgaagccgcaaacccaagaaagtccgtgccaagagccatcaacaaagtggtcttcagaatcgtgctcttctacatcatgtccttgttcttcgtcggcctgttggttccatacaacgaccctcgtctgtcagcaagctccgccgtcatcgcatcttcgccatttgtcatctctatccaaaacgcaggtacaaaagtactaccagatatcttcaacgcggtcgtcttagtcaccgtcatctcagcagctaactccaacgtctacgtcggctcccgtgtcctttacgccttggcccaaagcggcaacgctccaaagcaatttgcctacgtgacccgccacggtgtcccatacctgggtgtgatctgcacagctttgctgggtctactggctttcttggttgttaaccacaacgccaacaccgctttcaactggctgatcaatatctccactctggctggtctatgtgcttggttattcatctccttggctcacatcagattcatgcaagcattgaagttccgtggtatctccagagatgacctaccattcaaggctaagttcatgccttggggtgcctactacgcttctttcttcgttaccgttattatcttcatccaaggtttccaagccttcgctcctaagtttgacgtgtcagaattctttaccgcttacatctccttgatactgctggtcgtgttattcgctggttgccaattgtactacagatgcagattcttatggaagttagaagacatcgacattgatagtgatagaagagaaattgatgctattgtgtgggaagacgacgaacctcagaacctgtgggagaagttctgggccgcagtcgcttaa

SEQ ID NO: 8309 - protein, 597 aa, Candida glabrata CBS 138
MKFRNILKNEKNEKNEASASTSHASEDIEIIPSRYDNEKFYSATEATHKKKTGSTGFDDTISLTHTLSRSRIPTSMEDEDAEEAEVHDTRVKRALKQRHIGMIALGGTIGTGLFVGISTPLSNSGPVGALIAYIFMGTIIYFVTQSLGEMATFIPVTSSITVFSKRFLSPAFGVANGYMYWFNWAITYAVEVSVIGQVIQYWTFKVPLAAWIGIFWVLITLMNFFPVKIYGEFEFWVASIKVIAIVGYLIYALIIVCGGSHQGPIGFRYWRNPGAMGAGIISSDLGEARFLGWVSSLINAAFTYQGTELVGITAGEAANPRKSVPRAINKVVFRIVLFYIMSLFFVGLLVPYNDPRLSASSAVIASSPFVISIQNAGTKVLPDIFNAVVLVTVISAANSNVYVGSRVLYALAQSGNAPKQFAYVTRHGVPYLGVICTALLGLLAFLVVNHNANTAFNWLINISTLAGLCAWLFISLAHIRFMQALKFRGISRDDLPFKAKFMPWGAYYASFFVTVIIFIQGFQAFAPKFDVSEFFTAYISLILLVVLFAGCQLYYRCRFLWKLEDIDIDSDRREIDAIVWEDDEPQNLWEKFWAAVA

SEQ ID NO: 8310 - DNA, 1983 bp, Candida glabrata CBS 138
  CDS (1)..(1983)
atggtgtttggtggtagacgtcggaatgagaggtctcaatcaccggactcagaggaagccgatgtgagtaactatgagttgcacaacattgatgacagcaagaaaggatatgataacttaggtagtggtagcagaggtgctactacttctgccgttgaatattttgacaaagaaaatgttgatggcgtaaatatcgatgagaaattgcaatccactaccgaatttggcggtgatgagatgcctcgcggtaatatccgtcggttcatcgactctttcaaacgtgccgaacaacaacctaatcaacaacataatttggctgaggatttagaaaatgacttgaccactgcaatttccatgaactctttggatcgcgttcaaaataagccaaccggtaatggtcagatgaaattcgaggaagaagctttgaagaaatctattaagcctagacacgtcgtcatgatttccctaggtacaggtatcggtactggtctactggttggtaacgctaaagccctacataacgctggtccagctggtttagtcatcggttacgctattatgggttcttgtatctactgtattattcaagcagccggtgaaatggctgtcgtttactctaatttgctgggtggtttcaatacttacccatccatgttggttgaccctggttttggtttcgctgtcgcatgggtgtattgtctgcaatggttgtgtgtttgtcccttggaattggttactacttcgttgactatcaaatactggactacaacggtaaatccagacgcctttgtggtgatattttacgtggttattattttcattcaaatatttggtgccagaggttacgctgaagccgagttctttttcaactgttgtaagattcttatgattatcggtttctatatcttgggtattatcattaacgccggtggtgccggtaacgacggatacttgggtgctaagtactggcatgatccaggtgccttcagaggtacaaacggtattcaacgtttcaagggtattatggcgacttttgttagtgctgcttttgcttttggtgcaactgaatttattgcattgactgcagctgaacaatccaacccaagaaaggctatcccatctgcagctaagaaggtcctttaccgtgttatttgtatctttgttggtactatcgctttgctaggtttcttggtcccatgggattctgatcaattaatgggtgctggtggtagtgccactaaggcttctccttatgtcttagccatttctattcatggtgttagagttgttccacatttcattaacgctgttatcttaatctctgttttctctgtcgcaaattctgccttttactcaagttctcgtctattattgggtctagctcagcaaggctatgctccaaagtttttcgattacgttgacaggcaaggtagacctttcagagccatgtgttgtgctgctctttttggtgtcattgctttctgtgccgcatcaccaaaggaagaccaagtctttacttggttgctagccatttctggtttgtctcaattgtttacttggattgccatctgtgtttctcatattagatttagaagagctatgactgtccaaggtagatcattgggtgagattggtttcaaggcacaacttggtgtctatggttcatactacgccaccattatgatggtgctggctttgattgctcaattctgggttgccattgctccaattggtaacaacggtgacctggacgcagaaggtttctttgaaaactatttggctatgccaattttgattgcgttctactttggttacaaactttggaagagggactggcgtctgtttattagagcaaaggatattgatctagactcttacagacaggtatttgacgaagaactattgaaacaagaagatgaagaatacaaagagaaattaaagaatggccctatgtggaagagagtggtcgatttctggtgttag

SEQ ID NO: 8311 - protein, 660 aa, Candida glabrata CBS 138
MVFGGRRRNERSQSPDSEEADVSNYELHNIDDSKKGYDNLGSGSRGATTSAVEYFDKENVDGVNIDEKLQSTTEFGGDEMPRGNIRRFIDSFKRAEQQPNQQHNLAEDLENDLTTAISMNSLDRVQNKPTGNGQMKFEEEALKKSIKPRHVVMISLGTGIGTGLLVGNAKALHNAGPAGLVIGYAIMGSCIYCIIQAAGEMAVVYSNLLGGFNTYPSMLVDPGFGFAVAWVYCLQWLCVCPLELVTTSLTIKYWTTTVNPDAFVVIFYVVIIFIQIFGARGYAEAEFFFNCCKILMIIGFYILGIIINAGGAGNDGYLGAKYWHDPGAFRGTNGIQRFKGIMATFVSAAFAFGATEFIALTAAEQSNPRKAIPSAAKKVLYRVICIFVGTIALLGFLVPWDSDQLMGAGGSATKASPYVLAISIHGVRVVPHFINAVILISVFSVANSAFYSSSRLLLGLAQQGYAPKFFDYVDRQGRPFRAMCCAALFGVIAFCAASPKEDQVFTWLLAISGLSQLFTWIAICVSHIRFRRAMTVQGRSLGEIGFKAQLGVYGSYYATIMMVLALIAQFWVAIAPIGNNGDLDAEGFFENYLAMPILIAFYFGYKLWKRDWRLFIRAKDIDLDSYRQVFDEELLKQEDEEYKEKLKNGPMWKRVVDFWC

SEQ ID NO: 8312 - DNA, 1794 bp, Candida glabrata CBS 138
  CDS (1)..(1794)
atgagttccttggaaaagactgacttgccgaagaacgagttgcaaatcgactcggagttcctaagggaagaacccctggagataagtaacttcgaagagtcttcctcttcacaaggcccacagccaagtggttcacgttggaggaagtttaaagattctttcaaacccttggatgaagccgttgtcactgacgacatgagcgatatcgaaaagattgctcacagaaccgcgcatgcaccactgaagcatcatttaaagaacagacacttgcagatgatcgccatcggtggtgccattggtactggtctgtttgtcggttccggtaccgcgctaagaacagctggcccagctggtattctaattggttggggtctaacgggtaccatgatttactgtatggttatggccatgggtgaactatctgtggtcttcccaatctcaggtggtttcactacctatgccacgagattcattgacgaatcgtttggttttgccaacaacttcaactatatgttgcaatggctatgtgttctaccgttggaaatcgttgctgcttccattacagtcaactattggggtacggatcctaaatacagagatggttttgttgcattattctgggtggtcattgtcattatcaacttgttcggtgtgaaaggttacggtgaagccgagtttgtattttcaatcattaaagttttaacagtcattggtttcatcatcatgggtattgtgctaaactgtggtggtggcccagaaggtggctacatcggtggtaagtacttccacgaccccggtgcttttgtaggtgacactgcaggtgcgagattccaaggtgtttgttccgttttcgtcactgctgcattctcatttgctggtagtgaattgattggtattgccgctgctgaatctgctgagccaagaaagtctgttccaaaggccgcaaagcaagttttctggagaattactctattttacatgctgtcattgctaatggttggtcttttggttccatacactgatgaaagactgattggtgcttcctctgttgacgctgctgcatcacctttcgtcattgctatcacctctcatggtattagaggtttgccaagtgttgttaatgttgttattctaattgccgtcttatctgtcggaaactcagctgtctacggttgttccagaacgctatgtgctttggcccaacaaaacttccttccaaagattttcggttacattgacagatcaggtagacctctattcggtattgctttcacatccgcatttggtctagtcgcatttgtcgctcaaagtaagaaagaaggtgaagtgtttgcttggttgttagcgttgtctggtctatcctctttgttcacatggggtggtatctgtttctgtcacatccgtttccgtgcagcattgactgctcaaggcaggtccacggatgaacttccattcaaagcaccagctggtatctacggttccatgtggggcttgttcatgattgtcctaatgttcatggcacagttctacgtcgcactgttcccacctggaggcaagccgagcgccgaggtgttcttccagtcgtacttgtcattcccagttgtcctggcgttctacttcggtcacaaactgtacgctagaaactggaagttgttgatcccattgtcgaagctggacatcgacactggccgcagagagatggacctggatgtcctacgccaagagattgcggaagaaaaacagatgatgtctacaaggccatggtggtaccgttggtacagcttctggtgctaa

SEQ ID NO: 8313 - protein, 597 aa, Candida glabrata CBS 138
MSSLEKTDLPKNELQIDSEFLREEPLEISNFEESSSSQGPQPSGSRWRKFKDSFKPLDEAVVTDDMSDIEKIAHRTAHAPLKHHLKNRHLQMIAIGGAIGTGLFVGSGTALRTAGPAGILIGWGLTGTMIYCMVMAMGELSVVFPISGGFTTYATRFIDESFGFANNFNYMLQWLCVLPLEIVAASITVNYWGTDPKYRDGFVALFWVVIVIINLFGVKGYGEAEFVFSIIKVLTVIGFIIMGIVLNCGGGPEGGYIGGKYFHDPGAFVGDTAGARFQGVCSVFVTAAFSFAGSELIGIAAAESAEPRKSVPKAAKQVFWRITLFYMLSLLMVGLLVPYTDERLIGASSVDAAASPFVIAITSHGIRGLPSVVNVVILIAVLSVGNSAVYGCSRTLCALAQQNFLPKIFGYIDRSGRPLFGIAFTSAFGLVAFVAQSKKEGEVFAWLLALSGLSSLFTWGGICFCHIRFRAALTAQGRSTDELPFKAPAGIYGSMWGLFMIVLMFMAQFYVALFPPGGKPSAEVFFQSYLSFPVVLAFYFGHKLYARNWKLLIPLSKLDIDTGRREMDLDVLRQEIAEEKQMMSTRPWWYRWYSFWC

SEQ ID NO: 8314 - DNA, 1905 bp, Candida glabrata CBS 138
  CDS (1)..(1905)
atgttttccaaggtgaagaattatgggtcttcatctaagaaggaatccacagcggaggagttcaccataccggagtactccagggatgacggcgagaagtacgctggaaatagtaatgactacagccagcgcgacagcgataatacatctatagagtcagaaccaagaactaagcttgtacataggtttgtcgactctttcaagagagcacaggatgtgcccacaggccgtaagagcaaagaaatcggcaacaatggcggatccaagactaaaggtggctttgaagaggattctcttgacctagaaggttctgaccatgactccataataactaacacacatttgaagaaagcgatgaagtccagacatgttatgatgatgtctttaggtacgggtatcggtactggtctgttggtcgctaacgctaagggtctgcacttcggtgggcccgctgcgttggtcatcggttatgttctagtttcctttgtcacatatttcatgattcaagcagcaggtgaaatggctgtcacatacccaactcttcctggtaatttcaatgcatacagttccatttttgtctcaaatgcgttcggttttgccacagtctggattttctgtatccaatggttaactgtcctaccgctagaattgattactgcctccttgactataaagtattggaacgacaaaataaacgctgatgttttcatcgtgattttctatgtcttcctgttgtgtatccatctattcggtggtgttatcgcctacggtgaaactgaattcctgttcaacctatgtaaaattctcatggtcattggttttattatcatgtccattgttattaacgcaggtggtgcaggtaacagggagtacatcggtggcaaattctggcacgatccaggtgcttttgccggtaaaactgcaggttcaaggttcaaaggtatttgttacgttttggtcagtggttacttctcttacggtggtactgaactgtttgccctatctgtcaatgaacaatcaaatccaagaagatctactccacaagcttctaagagtagtttataccgtattttgattatttacttattgacaatgattttgatcggcttcaatgtgccttatgacagtgacgaattgatgggttcaggtggctctgctactcacgcttctccatatgtcttggctgcatcattgaatggagttaaaattgctcctcattttatcaatgccgtcatcttgatctccgttatttctgttgccaattcatctctatacgctgcaccaagattgatgtgttctttggctcagcaaggttacgctcctaaatttttggattatgtggacagacaaggtagacctttgcttgcgttgatcgcttgtttgcttgttggtgtcattggtttcgttgccgcctctcctaaggaagaagaagtctttacttggttggctgccattgcaggtttaagtgaacttttcacctggtcatccatcatgttgtctcatgttagatttagaatggcaatgaagttacagaacagaagtttggaagaattaggatataaagccactactggtatctatggttccatatatggtgtttgcttcaacttgttagtcttcgcagcccagttttggaccgctctgttcccatttggtggcgatggtaaagctaatgctaactctttctttgctaactatctagctatgccaatctggctagtcttttacttcggttacatgctgtggacacgtgatttccaattattaaaaccacttgataaaatagatcttgactttcatagaagaatttatgatccagaactaatgagacaagaggatgaagaatctaaggaaagactaaggaatggctcttttatgatgagaatgtatcatttctggtgttaa

SEQ ID NO: 8315 - protein, 634 aa, Candida glabrata CBS 138
MFSKVKNYGSSSKKESTAEEFTIPEYSRDDGEKYAGNSNDYSQRDSDNTSIESEPRTKLVHRFVDSFKRAQDVPTGRKSKEIGNNGGSKTKGGFEEDSLDLEGSDHDSIITNTHLKKAMKSRHVMMMSLGTGIGTGLLVANAKGLHFGGPAALVIGYVLVSFVTYFMIQAAGEMAVTYPTLPGNFNAYSSIFVSNAFGFATVWIFCIQWLTVLPLELITASLTIKYWNDKINADVFIVIFYVFLLCIHLFGGVIAYGETEFLFNLCKILMVIGFIIMSIVINAGGAGNREYIGGKFWHDPGAFAGKTAGSRFKGICYVLVSGYFSYGGTELFALSVNEQSNPRRSTPQASKSSLYRILIIYLLTMILIGFNVPYDSDELMGSGGSATHASPYVLAASLNGVKIAPHFINAVILISVISVANSSLYAAPRLMCSLAQQGYAPKFLDYVDRQGRPLLALIACLLVGVIGFVAASPKEEEVFTWLAAIAGLSELFTWSSIMLSHVRFRMAMKLQNRSLEELGYKATTGIYGSIYGVCFNLLVFAAQFWTALFPFGGDGKANANSFFANYLAMPIWLVFYFGYMLWTRDFQLLKPLDKIDLDFHRRIYDPELMRQEDEESKERLRNGSFMMRMYHFWC

SEQ ID NO: 8316 - DNA, 1764 bp, Kluyveromyces lactis NRRL Y-1140
  CDS (1)..(1764)
atgagtcaagagaagaagttagattactccattgaccaggagactcaactggaatctggtgaattccacgaacaaaacagctatgtttcgcaatctgatgcttctccagtcgagggtaccaggtgggaacggttcagggactcgttcaagcgagctgatactcaggatttggatcctaatttaacggacgccgagaaaatggccattcttacagctaatgcgcctttgaaaagaactttgaaatcaagacatttgcagatgattgccatcggtggtgctattggtaccggtcttttcgttggttctggtaaggcattggctactgccggtcctgcaggtatcttgatcggttgggctcttaccggtactatgatttactgtatggttatggccatgggtgagttagctgtcactttccctatcgctggtgggttcaccacttatgcatccagatttgtcgatgaatccttcggtttcgcttttaacactatttatatgttgcaatggttagttgtgcttcccttggaaattgttgctgcttctattacggtgaattactggggtactccagataaatatagagatgggtttgttgcgttgttttatgtggtgattgtcgctatcaatttctttggtgttaagggttacggtgaagctgaatttatcttttccttcatcaaagttatcactgtcattggatatatcattcttggtgtcattcttgtatgtggtggtggcccacaaggtggttacatcggtggtaggctatggcataacccaggtgcctttgctaatgggttcaagggtgtctgttccgtgttcgttactgctgcattctcctttgctggttctgaattggtcggtttggccgcagccgaaactgcaaacccaagaaagtccttaccaagtgccgctaagcaagtgttctggagaattactcttttctatatccttgccttgttgatggtcggtctattggtcccatacaccagtgatagattgattggacaaagttctgtcgatgctgctgcatccccattcgttatttccattcaaaatgccggtattaaaggtttaccttctgtgatcaacgttgttatcttgattgctgttctatctgttggtaactctgctgtttttgcttgctcaagatccatggctgcattggctaaccaaggttctttaccaaagatttttggttacattgacagaaccggtagaccattggtcggtattattgtcacttgtgtctttggtttgttatccttcattgctgcatctccaaaggaaggtgaagtattcgactggttattggcgttgtctggtttgtcctctttgtttacatggggtggtatcatgctttgtcacatcagagttagaagagctttggccgcacaaaacagaaccactgctgaactcagtttcaccgcaccaactggtgtatggggttccgtatacggtttcgtattgattattttgatcttgatggcccaattctggatcgctttgttcccaattggtgataaaccaagtgcatctgccttcttcgaagcttacctatcgttcccaatcttgattgcgttctacatcggtcacaagatctggaagaaaaactggaagttgtttatcagagccaagaatattgatatcgatactggtagaagagaaactgacatcgaagctttgaaacaagaaattgccgaagaaaaggcttttatcgcttccaaaccattctactacagaatgtacaagttctggtgttga

SEQ ID NO: 8317 - protein, 587 aa, Kluyveromyces lactis NRRL Y-1140
MSQEKKLDYSIDQETQLESGEFHEQNSYVSQSDASPVEGTRWERFRDSFKRADTQDLDPNLTDAEKMAILTANAPLKRTLKSRHLQMIAIGGAIGTGLFVGSGKALATAGPAGILIGWALTGTMIYCMVMAMGELAVTFPIAGGFTTYASRFVDESFGFAFNTIYMLQWLVVLPLEIVAASITVNYWGTPDKYRDGFVALFYVVIVAINFFGVKGYGEAEFIFSFIKVITVIGYIILGVILVCGGGPQGGYIGGRLWHNPGAFANGFKGVCSVFVTAAFSFAGSELVGLAAAETANPRKSLPSAAKQVFWRITLFYILALLMVGLLVPYTSDRLIGQSSVDAAASPFVISIQNAGIKGLPSVINVVILIAVLSVGNSAVFACSRSMAALANQGSLPKIFGYIDRTGRPLVGIIVTCVFGLLSFIAASPKEGEVFDWLLALSGLSSLFTWGGIMLCHIRVRRALAAQNRTTAELSFTAPTGVWGSVYGFVLIILILMAQFWIALFPIGDKPSASAFFEAYLSFPILIAFYIGHKIWKKNWKLFIRAKNIDIDTGRRETDIEALKQEIAEEKAFIASKPFYYRMYKFWC

SEQ ID NO: 8318 - DNA, 1764 bp, Kluyveromyces lactis NRRL Y-1140
  CDS (1)..(1764)
atgactgaagagaaaaaattggattactccattgttcaagaaactcaattggaacctggcgagttcgatgaactaaacagctatgtttcgcaatccgatacttcccgagtcgggggtaccagatgggaacggttcaaagattctttcagggaagctgaaaccgtggacttggatccaagtctaacacctgctgagaagatggccattcttacagctaatgcccctttgaaaagaactttgaaatcaagacatttgcaaatgattggtataggtggtgccattggtaccggtcttttcgttggttctggtaagtccttggctactgctggtcctgcaggtatcttgatcggttgggctcttaccggtactatgatttactgtatggttatggccatgggtgagttagctgttaccttccctgttgcaggtgggtatacaacttatgcatcgagatttgtcgatgaatcttttggttttgcgtttaacactgtatacgcaatgggttggttaattacactacctctagaaatagtggctgcttctattacggtgaattactggggcactccagctaaatatagggatgcgttcgtcgccttgttttatgtggtgattgtcggtatcaatttatttggtgtcaagggttacggtgaagctgaatttatcttttcctttatcaaagttattgccgtcatcgggttcattatccttggtgtcatccttgtctgcggtggcggtccacaaggtggttacatcggtggtaggctatggcataacccaggtgcctttgccaatgggttcaagggtgtctgttccgtgttcgttactgctgcattctcctttgctggttctgaattggtcggtttggccgctgctgaaactgcaaacccaagaaaatccataccaagcgccgctaagcaagtgttctggagaattactcttttctatatccttgccttgttgatggtcggcctattggttccatacaccagtgatagattgattggacaaagttctgtcgatgctgctgcatccccattcgttatttccattcaaaatgccggtattaaaggtttaccttctgtgatcaacgttgttatcttgattgctgttctatctgttggtaattgcgctgtctttggttgttcaagatcaatggctgcattggctaaccaaggttctttaccaaagatttttggttacattgacagaaccggtagaccattggtcggtattgtggtgacttgcgtctttggtttgctatccttcattgctgcatctccaaaggaaggtgaagtattcgactggttattggcgttgtctggtttgtcctctttgtttacatggggtggtattttgctttgtcacatcagagttagaagagctttggctgcacaaaacagaaccactgctgaactcagtttcactgcaccaactgatgtatggggttccgtgtacagcttgatcctaattatattaattttaatagcccaattctggatcgctttgttcccaattggtggtaaaccgagtgctgcagcattcttcgaagcttacttatctttcccaatttacatcgtattctacatcggtcataagatctggaagaaaaactggaagttgttcatcaaagcttcggatattgatattgattctggtagaagagaaactgacatcgaagctttgaagcaagaaattgccgaagaaaaggcttttatcgcttccaaaccattctactacagaatgtacaagttctggtgttga

SEQ ID NO: 8319 - protein, 587 aa, Kluyveromyces lactis NRRL Y-1140
MTEEKKLDYSIVQETQLEPGEFDELNSYVSQSDTSRVGGTRWERFKDSFREAETVDLDPSLTPAEKMAILTANAPLKRTLKSRHLQMIGIGGAIGTGLFVGSGKSLATAGPAGILIGWALTGTMIYCMVMAMGELAVTFPVAGGYTTYASRFVDESFGFAFNTVYAMGWLITLPLEIVAASITVNYWGTPAKYRDAFVALFYVVIVGINLFGVKGYGEAEFIFSFIKVIAVIGFIILGVILVCGGGPQGGYIGGRLWHNPGAFANGFKGVCSVFVTAAFSFAGSELVGLAAAETANPRKSIPSAAKQVFWRITLFYILALLMVGLLVPYTSDRLIGQSSVDAAASPFVISIQNAGIKGLPSVINVVILIAVLSVGNCAVFGCSRSMAALANQGSLPKIFGYIDRTGRPLVGIVVTCVFGLLSFIAASPKEGEVFDWLLALSGLSSLFTWGGILLCHIRVRRALAAQNRTTAELSFTAPTDVWGSVYSLILIILILIAQFWIALFPIGGKPSAAAFFEAYLSFPIYIVFYIGHKIWKKNWKLFIKASDIDIDSGRRETDIEALKQEIAEEKAFIASKPFYYRMYKFWC

SEQ ID NO: 8320 - DNA, 1755 bp, Kluyveromyces lactis NRRL Y-1140
  CDS (1)..(1755)
atgaaggaagatgaatatgacatgtcaaaaatggacaaccttctgtcacctagcagcggtgatttagagatgaagtttagcgatgggattatgagcaaagagacagaaattgacttggataagaaagaggataagaataaaaatatagtgcgaagaatgatagattctttcaaacctccattggatggttcttaccattctgataatttgaaacggaagttgaaatcaagacatttgatcatgattgccattggcggttccattggtacaggtctcttcgttggttcaggtaaagctttggccactggtgggcctttagctatgatcatcggttggtcgattgcaggttcgcagatggtgggtacaattcatggccttggtgaaattaccatgagatttcctgttgttggtgcgtttgctaactattcaactagacttcttgaccccagtatcagtttcatggttagttccatatacatctgtcaatggtacttcgtgctaccgattgaattgatcgctagtgccatgactgtgcagttttggactaccaaagtggatcctgtggtgtgggtagcaatattctacgttatcgtcgttagtgtaaaccttttcggtgtcaaagtctttggtgaagcagagttcgctttttcgttggtgaaagttatcacgattatcgggtttatcatcctttctattattctcatctgtggtgggggacctgatcatcgtttcatcggtactgagtattggcatcatcctggtgcgttggcaaatggattcaaaggtgtagctagtgttttcgtcaccgcatcatacagtcttggagggtctgaaatggtatgcttatgttctgcagagaccgatccaaaggaattacctcatgctatcaaacaagtgttttggagaatcgttttcttcttcttggtctctttaactttggttgggttcttggttccatacacaaacgagaatttgttaggtggatccagtgtcaacaattccccatttgtcattgccattaaactaagtgggatccgtgtgctaccttccatcatcaatgctgtcattttaatcagtatcctaagtgtcggtaattcatgtatctttgcatcaagtcgtactctttgttcaatggctcatcagggcctcattccaagagtgttcggttacgttgatagagcaggaagaccacttgtgggaatcatcgttaactctttgtttggtctcttagctttcctagtaaaatctgcatcgatgggggtcgttttcgattggttaatggcaattgctgggttggctacatgtgtcgtatggctgagtatcaatatttcccacataagattcagacttgcaatgaaggcacaaaatagatcccttgatgaattggaattcaaaagttcagtcggcgtatacggttctatttactcagctaccgtcaacatattaattctcattgcgcaattctacatctctttatggccagtaggtggttggacgtcaagccaacaaagaacagagtcattcttcaagaactacttatgtgccctggttttggtgtttgtcttcgtcacccataagatctatttcaaatgttcaactggaaaatggtttgatttcaaaccacttgcagaaatcgatttagaaactgatagaaaaaatatcgatatcgaaatcgtcaagcaagaggtcagggaaagagaaatgtatctggcaagcaagccttggtatatcagattctacaacttctggtgttga

SEQ ID NO: 8321 - protein, 584 aa, Kluyveromyces lactis NRRL Y-1140
MKEDEYDMSKMDNLLSPSSGDLEMKFSDGIMSKETEIDLDKKEDKNKNIVRRMIDSFKPPLDGSYHSDNLKRKLKSRHLIMIAIGGSIGTGLFVGSGKALATGGPLAMIIGWSIAGSQMVGTIHGLGEITMRFPVVGAFANYSTRLLDPSISFMVSSIYICQWYFVLPIELIASAMTVQFWTTKVDPVVWVAIFYVIVVSVNLFGVKVFGEAEFAFSLVKVITIIGFIILSIILICGGGPDHRFIGTEYWHHPGALANGFKGVASVFVTASYSLGGSEMVCLCSAETDPKELPHAIKQVFWRIVFFFLVSLTLVGFLVPYTNENLLGGSSVNNSPFVIAIKLSGIRVLPSIINAVILISILSVGNSCIFASSRTLCSMAHQGLIPRVFGYVDRAGRPLVGIIVNSLFGLLAFLVKSASMGVVFDWLMAIAGLATCVVWLSINISHIRFRLAMKAQNRSLDELEFKSSVGVYGSIYSATVNILILIAQFYISLWPVGGWTSSQQRTESFFKNYLCALVLVFVFVTHKIYFKCSTGKWFDFKPLAEIDLETDRKNIDIEIVKQEVREREMYLASKPWYIRFYNFWC

SEQ ID NO: 8322 - DNA, 1746 bp, Kluyveromyces lactis NRRL Y-1140
  CDS (1)..(1746)
atgacacacttctccaaaaacatggacaccaaacagcaggacttatcttctttgtccgaagttggacaaagttttgcgaaagaggaaacatggtctgtcgagaaacaactcaaaccattggcagaagagaaagattatgctgatatgaacgatgttgaaaaggctatttataacactaaggactcaaaattgaataaagatttatccattcgtcatcttttgactttggcagtcggtggtgccattggtacaggtttgtttgtcaattcgggcgattcgttgagtaccggtggccctgcctctttagtcattgcgtggaccatcatttcaacatgtttgtttacaatagtcaactccttaggtgaattgagtgctacttttcctgttgttggtggattcaatgtgtacgtcacaagatttgtagaaccatcttttggttttgcggtgaatttcaattatctagctcaatgggcaattcttctaccattggaactatgtgctgcatcgattactatcagatactggaacaaatcaattaatccagatgcttgggtcagtatattctacgttgctatcgcttttgccaacatgctggatgttaaatcattcggtgaaactgaatttgtcttgtctatggtgaaaattcttgccatcattgggttcactattctggggatcgttttaatctgtggaggtggtccatccggtggctttataggtgggaagtactggaatgatcctggcgcctttgtgggtgatactccagctcagcgtttcaagggattgtctgcagtgttcatcacagctgctttctcctattcgggattggaattggtcggtgtttcagctgcagaatccagaaatccaagagtaactttgccaaaagctgctaagagaacattctggttgatcactatgagttatttggtcatcttgactttgatcgggtgtcttgttccatccaacgatcctttattgttgaacggtacctcatccgttgatgctgctgcgtcaccattagttattgccattcagaatggtggtattaaagggttaccatccttgatgaatgccattattttgattgcactcttgtctgtagctaacagtgccgtttacgcatgttcaagatgtattatctcaatggcagaaattggtaatttacctcgttctttggcccatgttgacaagaaaggtagaccattgtacgcaattgctattactctcttggttggtttattgtcgttcattgctgctagtaataagcgtgacgaagttttcacttggttgagtgcgttatctggtttatctactctattctgttggtttgccataaatttggctcatttaagattccgtcacgccatgaaacaccaaaatagatcccttgaagaactgccgtatgtttcaatgactggagaatgggggtcttggtacggctgtatcgttatcgggctggttttaattgcctccttctggacctctctattcccggctggtgggaacggtgctgatgcaacttcattctttgaaagttatctctccctaccgattttcattgcttgctaccttggtcacaagatttggaaacgcaatttaaggttgtacatcaaactatccgaggttgatgtcgattccggcaggaccgatactgacgcagctactcttaaacaagaaaaggaagctgaagctgaattaatgaaaactaaacctttctatatcagactgtggaacttctggtgttaa

SEQ ID NO: 8323 - protein, 581 aa, Kluyveromyces lactis NRRL Y-1140
MTHFSKNMDTKQQDLSSLSEVGQSFAKEETWSVEKQLKPLAEEKDYADMNDVEKAIYNTKDSKLNKDLSIRHLLTLAVGGAIGTGLFVNSGDSLSTGGPASLVIAWTIISTCLFTIVNSLGELSATFPVVGGFNVYVTRFVEPSFGFAVNFNYLAQWAILLPLELCAASITIRYWNKSINPDAWVSIFYVAIAFANMLDVKSFGETEFVLSMVKILAIIGFTILGIVLICGGGPSGGFIGGKYWNDPGAFVGDTPAQRFKGLSAVFITAAFSYSGLELVGVSAAESRNPRVTLPKAAKRTFWLITMSYLVILTLIGCLVPSNDPLLLNGTSSVDAAASPLVIAIQNGGIKGLPSLMNAIILIALLSVANSAVYACSRCIISMAEIGNLPRSLAHVDKKGRPLYAIAITLLVGLLSFIAASNKRDEVFTWLSALSGLSTLFCWFAINLAHLRFRHAMKHQNRSLEELPYVSMTGEWGSWYGCIVIGLVLIASFWTSLFPAGGNGADATSFFESYLSLPIFIACYLGHKIWKRNLRLYIKLSEVDVDSGRTDTDAATLKQEKEAEAELMKTKPFYIRLWNFWC

SEQ ID NO: 8324 - DNA, 1767 bp, Kluyveromyces lactis NRRL Y-1140
  CDS (1)..(1767)
atgactgatttggcaaaagatttggctaaagatccaacccaggtatctgagaatttcacacaatctttatataccgatgaagatggctctagatcgttgttcaccagagtcaaggattctttcaagagacaagaacttgtagaaactgagggcatagatttagacacttacagtatgacagattaccaaaggactaattatcttttagctaagcaaccatatcagaaaaatttgtcacagagacatttgacgatgattgctattggggggacgttgggaacaggtctcttcatcggtatcggttggtcattagcatcgggacctggtaatttattgattggatttttgcttactgggttggctatcttttgtgttgttcagtgtgctgcagaattatcatgtcaatatcctgtttcagggtcctttgcatctcacgtatcaagatttgtagacccatcctggggtttcaccgtcactacgaattattgtttggcatggtccatctctttcccgtctgaacttattggttgtgcaatgaccattggttattgggatagctccgttaaccccgtagtatgggtcatcatattttggttattcatcatggcattgaatctatttggtgttagaggtttcgcagaaactgaatatgtcttgtctatctttaaaatccttgccatcataatatttttgatcattggagtagtccttatatgtggtggtggacctaactccaacggatacattggaaccaagtactggcatgatcctgggtctttcaaggcgccagttttcaaatcactatgtaacacattcgtgtctgcagccttttcctttggtggtactgaattagtggttttaactgcagcagaatcaaggaaagtggaatcaatatctagagcagcaaagggaaccttctggagagtgatagtcttttacgtgtcaactgttgttgttatcggttgtttagtaccttacactgatgagagattactcggaggtgacacctcagaggatatcgctgcatcacccttcgtcatcgcattggcaaacacaggaaaattcggtgaaagagtgtcaaacttcatgaatgctgtcattcttattgctgtgctctccgtttgtaactcatgtgtctatgctgcatcacgtgtgatacaatctttgggagcttctgggcaattaccatcgatttgtggatatgtcgatcgtaagggtagacctttgtttggtattcttgtcgtgggtcttttcgggtttttgcccttcattgtggcttcgaacaaagttagcgaggtatttgattggttgtttgccttatgttctatttcttcgatgttcatttggttctccatttgctattcttatttgcgttatagatgggcattaaagaaacagaacagaagtgccgacgaaattgcgtacaaatcgatgcttggaatttggggggcttatttgggcttacttttgagtgccctgttgatcgtaggtgaaatttacgtctcacttttccctctcggcgaatcacccagtgcagaagctttcttcaaatattgtctatcaatccccataatgatcgccgtttacattggtcacaagtcctatacagggaattggaaatcatttgttatcccactctctggtatcgacctcgatacaggattgtcacatagtgatgttgaaataatgaaacatgaattagaaattcaaagagtcaaacttgcatctaaaccactttattatagaattttcagattttggtgctag

SEQ ID NO: 8325 - protein, 588 aa, Kluyveromyces lactis NRRL Y-1140
MTDLAKDLAKDPTQVSENFTQSLYTDEDGSRSLFTRVKDSFKRQELVETEGIDLDTYSMTDYQRTNYLLAKQPYQKNLSQRHLTMIAIGGTLGTGLFIGIGWSLASGPGNLLIGFLLTGLAIFCVVQCAAELSCQYPVSGSFASHVSRFVDPSWGFTVTTNYCLAWSISFPSELIGCAMTIGYWDSSVNPVVWVIIFWLFIMALNLFGVRGFAETEYVLSIFKILAIIIFLIIGVVLICGGGPNSNGYIGTKYWHDPGSFKAPVFKSLCNTFVSAAFSFGGTELVVLTAAESRKVESISRAAKGTFWRVIVFYVSTVVVIGCLVPYTDERLLGGDTSEDIAASPFVIALANTGKFGERVSNFMNAVILIAVLSVCNSCVYAASRVIQSLGASGQLPSICGYVDRKGRPLFGILVVGLFGFLPFIVASNKVSEVFDWLFALCSISSMFIWFSICYSYLRYRWALKKQNRSADEIAYKSMLGIWGAYLGLLLSALLIVGEIYVSLFPLGESPSAEAFFKYCLSIPIMIAVYIGHKSYTGNWKSFVIPLSGIDLDTGLSHSDVEIMKHELEIQRVKLASKPLYYRIFRFWC

SEQ ID NO: 8326 - DNA, 1863 bp, Kluyveromyces lactis NRRL Y-1140
  CDS (1)..(1863)
atgactggtgctactggatcttctaattcagactttataagtcctgttggcagtgacgttaaacataatgataaatcagatactataatacaatcagaagggttcccaagtattgaaggtgaagctgaatactatgagaaaacgttctctcaatcggacgaggagtacgctgcaaaatcaagtgtttggcataggtttaaggattccttcaagagagccgatcatattaatacgaatatacatggaaatgcggaattggaattgaatccatcacagagtctcttacctgagaagggtgctagcttaaagcgagatattaaaccaaggcatgttgttatgatgtctttagctacaggtatcggtactggtctacttgttggtaacggtaaggcattggctaccggtggaccggctggtttgaccattggttatgctattatgggttcttgcttgtacagtattattcaagctgctggtgaactagcagttgcatacccaactttaactggtaatttcaataactatccttcctttttggtggaccctgctatgtgtttcgctaccgctgccctttactgtattcaatggttatgtgtgttcccattagaagtgatttctgcggccattaccatcaaatattggaataccagcataaatcctaatgtttggtgtgttatattttacgttatgatcatcggaattaacatgtgtggttccgctggttatgctgaagccgatttctttttcaacacttgtaaaattttaatgtttgcaggtttcttcatcttgggtatcatcatcaactgtggtggtgcaggtgactcagtttatatcggtggtaaatattggaacgaccctggtgccttcaacggtgacactggtattagtagattcaaggctattgtttctactttggttactgctgcatttgcttttggtgcatcagaagccgttgctttaactgccagtgaacaagctaacccaagaaaagctattccaagtgctgctaagcaagtgttgtacagaattattgccatctacttggctagtatcattctagttgggtttttagttccttataactcccctgaattgatgggttcaggtagttcttctgtccattcttctccttatgtgattgctgttgcatcgcatggtgtcaaagttgtcccatcattcatcaatgcagtcatcttaatctcagtgttatctgtaggtaacttttctttctactcaagttcccgtattcttctatgtttatccgaaatcggttatgctccaaagtttttccaatacgttgatagacaaggtagaccactatatgccatgattgtgggtgctcttgttggttgtatttgctttgttagtgcttcatccgcagaagaaagtgtctttacatggttgatggccgtttccggtttgtcccaattgttcacatggactaacatttgtatttctcatgtcagattcagaaaagccatgcaagttcaaaatagatccataggtgaattaggtttcaggtcccaagttggtgtatggggttcttactatggtatcttcatgatgatattggttttcatcggtcaattctgggtcgcacttttcccagtaggaggtaccgatggtgccgatgccgaaaatttctttgctaattatcttgcaatgccagtcttccttgcactatacttcggtttcaagatatggaagaaggattggagactatatattccagcatctgaaatcgatctcatttctcacagaaagattttcgatgaagaaatactaaaacaagaagatgaggaatataagataaaaatgaaacatgcttccatatgggtaaaattatccaacttctggtgttaa

SEQ ID NO: 8327 - protein, 620 aa, Kluyveromyces lactis NRRL Y-1140
MTGATGSSNSDFISPVGSDVKHNDKSDTIIQSEGFPSIEGEAEYYEKTFSQSDEEYAAKSSVWHRFKDSFKRADHINTNIHGNAELELNPSQSLLPEKGASLKRDIKPRHVVMMSLATGIGTGLLVGNGKALATGGPAGLTIGYAIMGSCLYSIIQAAGELAVAYPTLTGNFNNYPSFLVDPAMCFATAALYCIQWLCVFPLEVISAAITIKYWNTSINPNVWCVIFYVMIIGINMCGSAGYAEADFFFNTCKILMFAGFFILGIIINCGGAGDSVYIGGKYWNDPGAFNGDTGISRFKAIVSTLVTAAFAFGASEAVALTASEQANPRKAIPSAAKQVLYRIIAIYLASIILVGFLVPYNSPELMGSGSSSVHSSPYVIAVASHGVKVVPSFINAVILISVLSVGNFSFYSSSRILLCLSEIGYAPKFFQYVDRQGRPLYAMIVGALVGCICFVSASSAEESVFTWLMAVSGLSQLFTWTNICISHVRFRKAMQVQNRSIGELGFRSQVGVWGSYYGIFMMILVFIGQFWVALFPVGGTDGADAENFFANYLAMPVFLALYFGFKIWKKDWRLYIPASEIDLISHRKIFDEEILKQEDEEYKIKMKHASIWVKLSNFWC

SEQ ID NO: 8328 - DNA, 1719 bp, Debaryomyces hansenii CBS767
  CDS (1)..(1719)
atggtactaggcagtgaaaagaaattgaagccagtgatttcagaaaccagaagaggttcttctgcatcggggtcagagtgtgataatattccaagcgtcggcgttactaagtgggatagatttgtcgatagtttcagaaggcaacacgtacagcacggggacgaagggaagagtttacagaagggtattagttcaagacatttaatccttatggcccttgtgaccgggatgggtacggggcttttcgttggtacaggaaatattctaagtacagcaggtccattatttttgattgttggttatattatagttggatcattcttgtatccaactttgcaagctgccggggagttggcagttaactatagtgagctttcaggtggatataacaactatcccctgaaattcattgatgaatcagttgcatttgcagtaacttggatttactgtatcgagtggttatcgacgttcgcattagaactagtcactgcctccataaccatcagatattgggatggtgatcagaaaattaatccagatgtttgggtcactatcatattcgtgatagtagttctgcttcattttgtcggctccaaagcttacggtgaaggagaatttgttattggatgccttaaagttcttatggtcactggatttcttattatgtccattgttgttaatgttggtggcggtcctgaaggaaaatttattgggggacaatactggcatgatcctggatattatactaacttcaaaggtttatgtacggtatttgtcactggtgcgtttgctttcagtcaatctgaattcgttgcattatcggcggctgaacaaccaaaccccagaagggccattcctactgcgtgtaaattggtattctggagaatattgatattatttttgggttctttgattatggtcggtcttttggttccaatgaattcccctgaattgatgggtgcatctggtggtggttcaaatgcttctccatttgttcttgctgcaactttacatggggttaccgtagtaccacatataatcaatgctgttatcttgctttctgtttgctccgttgcttcatcatcattatatgcatcatctagaactttgcaatcgttagctgatcaaggatacgcaccaaaatatttcaattatattgacagatcaggtagacccttgcgctcattaattgcgtgttctattgttggattattttcttatattgcagcctatgaaaaacaagaaacagtctttaattggttgttatccatctctggattggcgcaactttttacatgggatgttatttgcatttcgcatattagatttagacaagcacttaaatacaatgggatttcaacagactccttaggatatacttcttcaactggtatctggggttcggtatatgccattgtaatacactggttgattttaattgctctgttttatactgccttgtttccggttggatctagtactccagatgcacaaagcttctttcaaaactatctcggcgcaatcgtcttagtattcttttatgtttgtcataaactttggtcgagaaattggaagttctatgtcaatatatgtgatattgacattaatactgatagaactatatttgatgaagaaatattgaacttagaaaaacaagaatttcaagagaaatataataatgatccttggtataagaaacttacgactatactcctttaa

SEQ ID NO: 8329 - protein, 572 aa, Debaryomyces hansenii CBS767
MVLGSEKKLKPVISETRRGSSASGSECDNIPSVGVTKWDRFVDSFRRQHVQHGDEGKSLQKGISSRHLILMALVTGMGTGLFVGTGNILSTAGPLFLIVGYIIVGSFLYPTLQAAGELAVNYSELSGGYNNYPLKFIDESVAFAVTWIYCIEWLSTFALELVTASITIRYWDGDQKINPDVWVTIIFVIVVLLHFVGSKAYGEGEFVIGCLKVLMVTGFLIMSIVVNVGGGPEGKFIGGQYWHDPGYYTNFKGLCTVFVTGAFAFSQSEFVALSAAEQPNPRRAIPTACKLVFWRILILFLGSLIMVGLLVPMNSPELMGASGGGSNASPFVLAATLHGVTVVPHIINAVILLSVCSVASSSLYASSRTLQSLADQGYAPKYFNYIDRSGRPLRSLIACSIVGLFSYIAAYEKQETVFNWLLSISGLAQLFTWDVICISHIRFRQALKYNGISTDSLGYTSSTGIWGSVYAIVIHWLILIALFYTALFPVGSSTPDAQSFFQNYLGAIVLVFFYVCHKLWSRNWKFYVNICDIDINTDRTIFDEEILNLEKQEFQEKYNNDPWYKKLTTILL

SEQ ID NO: 8330 - DNA, 1758 bp, Debaryomyces hansenii CBS767
  CDS (1)..(1758)
atggaacctaaagaagttgaatctacaaacagcgagagcatccctctctctaatggggtatcaagtcgatcatcaacttttgatgataaaaaagagcacacgaaatggcaatcttttaaagactcatttaagagatacgaaggatacgaagaagaagaagaagttgacttagaaaagttggatgacattcagaaaggtaacataaggaccgcaaaatctccattaaaaagaaaattgaaatcgagacatttgcaaatgattgctattgggtcttcgattggaacaggacttttcattgggtcaggatccgctttaaacacaggtggtcctttgggtattttgattgcttgggctttgacaggttcagctattttctgtacgattcaggcgatgggcgagttagcggtaactttcccaatttctggttcgtttaacgtttatgcgagtagattcattgatccatctgttggttttgcagttgcatggaactatttttttcaattcttggttttattacctttagaattagtcgctggttctattacaatgacatactggatcacatcggtcaatcctgatgtctgggtacttattttttacctcgttgttatatctataaatttctttggcgtaaaagcttacggtgaggcagaatttgtattttcatcaattaaagttcttgcagttgttggattcataatagtttctattgttattgctgcaggaggagctccaaatggacattacgtaggagacagatattggcatgatccaggtttgtttgcgaatggatttaagggtgttagttcagtatttgtcacatctgcattctcttttggaggtactgagttagttggtttgacagcagctgagactgataacccaagggtgacattaccaagggcaacaaaacaagtgttctggagaatattgatgttttatatgatatctttaactttgatttgtttcttagtgccttataattctgacagcttgttgggtgccagttcggtcgatgtcaccgcatctccatttgtcattgccatcaacaacgggggtatcggtggcttaccatctgttatgaatgccgttattttgatttccgttatttcggtaggatcttcctcggtatatgcaacatcaaggacattgacggctttagctgaacaaggattggcaccaaaaatctgtggatatattgacagagcaggtagaccactagttgcgatcataattacaaacattttcggtttattgagttttatcgcagcaagtggtaaacaagaagaagtatttaactggttactactgattagtggtttaagttccatcttcacttggtggtctatttgtgtagcccacataagatttagaagggccttatatgtcaaaggaagatcaagcgacgagttgagcttcaaatcccaaactggtgtaattgggtcgatttatggggccaccttaaacactttagtattaattgcagaattttgggtttctttatttccgttaggagaatcacccagcgctgaaggatttttccaaaactatttggggtttgttgttttacttgtattctacgtaggccataaaatatggaagaataattggattctttgcattagagccaagaacattgatgttgacgttggacgtagagaaacagacttagaagcattgaaacaagagttagaggaggaaagagcaatactacgtaccaagccattgtattatagagtttaccgtttctggtgttag

SEQ ID NO: 8331 - protein, 585 aa, Debaryomyces hansenii CBS767
MEPKEVESTNSESIPLSNGVSSRSSTFDDKKEHTKWQSFKDSFKRYEGYEEEEEVDLEKLDDIQKGNIRTAKSPLKRKLKSRHLQMIAIGSSIGTGLFIGSGSALNTGGPLGILIAWALTGSAIFCTIQAMGELAVTFPISGSFNVYASRFIDPSVGFAVAWNYFFQFLVLLPLELVAGSITMTYWITSVNPDVWVLIFYLVVISINFFGVKAYGEAEFVFSSIKVLAVVGFIIVSIVIAAGGAPNGHYVGDRYWHDPGLFANGFKGVSSVFVTSAFSFGGTELVGLTAAETDNPRVTLPRATKQVFWRILMFYMISLTLICFLVPYNSDSLLGASSVDVTASPFVIAINNGGIGGLPSVMNAVILISVISVGSSSVYATSRTLTALAEQGLAPKICGYIDRAGRPLVAIIITNIFGLLSFIAASGKQEEVFNWLLLISGLSSIFTWWSICVAHIRFRRALYVKGRSSDELSFKSQTGVIGSIYGATLNTLVLIAEFWVSLFPLGESPSAEGFFQNYLGFVVLLVFYVGHKIWKNNWILCIRAKNIDVDVGRRETDLEALKQELEEERAILRTKPLYYRVYRFWC

SEQ ID NO: 8332 - DNA, 1764 bp, Debaryomyces hansenii CBS767
  CDS (1)..(1764)
atgcctgaaaaagaacttaattatataaggtcagcagatgctgctacgtccaacgagaaggatggtggagtttttgtcgatgcttttgaagccagtgataacaaggcccctatgggcaaatttgagaaattccgtgactcttttaggagattcgacgatactgaattaggaattgaccctaacttatcggaagtggaaagagctgctatcatcactgctaactccccattgtcgaggtctttgaagaacagacacttacagatgatcgccattggcgggtccattggtacaggtctttttgtgggttctggtactactttgagaaccgggggtccagcagggattttgattgcttatattatcattggggttatgatttattgtactgtccaggcgttaggagaattggctgtgacattcccggtttctggtgctttcgttacttacaatactcgttttatttgtccatcatgggggtttgctatggcttggaactatgctttgcaatggttggttgtgtttccgttagaattggtggcggcgtctattactattgagtattggaacctgtcaattaattcggcggcgtttgtggctattttctatgttttgattgttagtattaatttttttggtgtcaaaggttacggtgaagcagaatttattttctccctcattaaagtcaccgcagtaatgggctttattatattaggtataattattgccgcaggaggtgtaggtcctcaaggttaccttggtggtagatactggcaacatccaggtgcctttgctaatggattcaaaggtgtctgtactgttttcgtcaccgctgcttttgcttttgctggtactgaattagtagggttagcttctgcagaatctgctaatccaagaaagtctttaccaaaggcgaccaagcaagttttctggagaattgttttattttatgttatctctttaaccttggttggtttattggttagatacgatgacgagagattactttctgactcttctgtggacgctaaagcctctcctttcgttattgctatcaaaaatgctgagattagtggattaccatcggtcatgaatgttgtcattatgatttctgttttatctgtcggtaattcgtctgtttttgcttcttcaagaactctagccgcattagcagctgcaagacaagcgccaaagatttttggctatattgataaaaagggtcgtccattagttggtattatcgtccaatgcacctttgggttactttgttttgtctctgcgtctgataagcaaggtgaggttttcaattggttgatggccttgtccggtctttcttccatctttacctggggttcgattaacttctgtcatattagattcagaagggctttgaaagtacaaggaagagatacctccgagattgcatacacttctcaggtcggccttattggctcatatattggtatgactttaaacatcttggtcttaattgcccaattctgggtcgcattgtttccattgggcagttctccagatccaagtgcattcttccaaagttatcttggtttcccagttgttttattcttctatatctgtcacaagctttatagaaggaactggagactctatattagggccaaagatattgatattgatactggtagaagagacttagatttggatttattaaggcaagaacttgccgaagaacgagcatttattgccgcaaaacctttctacgctagggtttggaacttctggtgttaa

SEQ ID NO: 8333 - protein, 587 aa, Debaryomyces hansenii CBS767
MPEKELNYIRSADAATSNEKDGGVFVDAFEASDNKAPMGKFEKFRDSFRRFDDTELGIDPNLSEVERAAIITANSPLSRSLKNRHLQMIAIGGSIGTGLFVGSGTTLRTGGPAGILIAYIIIGVMIYCTVQALGELAVTFPVSGAFVTYNTRFICPSWGFAMAWNYALQWLVVFPLELVAASITIEYWNLSINSAAFVAIFYVLIVSINFFGVKGYGEAEFIFSLIKVTAVMGFIILGIIIAAGGVGPQGYLGGRYWQHPGAFANGFKGVCTVFVTAAFAFAGTELVGLASAESANPRKSLPKATKQVFWRIVLFYVISLTLVGLLVRYDDERLLSDSSVDAKASPFVIAIKNAEISGLPSVMNVVIMISVLSVGNSSVFASSRTLAALAAARQAPKIFGYIDKKGRPLVGIIVQCTFGLLCFVSASDKQGEVFNWLMALSGLSSIFTWGSINFCHIRFRRALKVQGRDTSEIAYTSQVGLIGSYIGMTLNILVLIAQFWVALFPLGSSPDPSAFFQSYLGFPVVLFFYICHKLYRRNWRLYIRAKDIDIDTGRRDLDLDLLRQELAEERAFIAAKPFYARVWNFWC

SEQ ID NO: 8334 - DNA, 1842 bp, Debaryomyces hansenii CBS767
  CDS (1)..(1842)
atgcaaaagtctaagtttaccagaaatagatcgaatagttgtaataatacctctctgtcagatcttcaaatagatcctaaaattcgctctcacagtctttcattaccaacttcgaatgcatctagtattcgaaataaaaattcagaaactgaaaaacacagaatcaagaataatgttacaatcaataagagatcgaagaatccaatagttaaaatcatacattctttcaagcgaacagaagatgttgatcttgagactggtgagacaaaattgaaatctgagctaaatgggttttcgttgcaaatgatagctattggggggtcaattggtacagggttactcttaggtagtggtaaatccttgagtgaaggtggggctgtacccttgttgcttggatacatactagtagcaacatttatatattgtatgtgtcaagcattaggcgagctctcggtagctatgccagtgactggatcttttaccaaatactcagttatgttgatagacaaaagttggggatttgcaatgggttggaattattgcttacagtggctaattttattaccaatggaattagttgcagcttcaatgacaattaaattttggccagttattgcagactacttaccagattatatggttattaccatattttatgcgatgatcatttgtatgaatttacttagtgtaaagtattatgggttgtttgaagttatattttcattattaaaagttgttgctattgtaatatttctaattgttgggttatttatagacattggtgtaatcggggacgagagaattggatttaaatattggaaagatcctggtattttctctggaaatggattcaatggattcattggggttgtcgttactgctgcattcagtttctctggaagtgaattggttggcataacagcatctgaatcaagaaacccagataaggaagttccaaaagccattaagcaagttttctggagaatatgtggattttatttgttttcgttattcatagtagggctattggtaccatttactcatccaaatttagttggagatcataaatcggatgtcaatgcatccccatttgtattggctttgacaaatacaaagaataatgcatttgcgaatataatgaatgtcgtgatattaatatccatcctatctgtggggaacagttccatctatgcatcttcgagaaccttaattgcactctccgaaaataagcaagcacctagtctattaaactacattgataagaagaaacggcctttaattgcaattgcaatatccatcagttttggttctttagcctatatatcggtactttctccaacggggtcagaaataatgtttctttggctaatgtccatatctggaatatcagtattatgtacgtatggaaccattacactctgccatataagattcaggaaagcattgagacttaatgatatctcctataaagaagaattgcctttctgttctcagataggactcacaggctcgtggtatggattggtagtaagcattgtgatagccatctctcagatatatattgcaatcacaccagttaatggccactttgctattgccgatttctttcaaaaagtcttgggattattagttatatcaatattttactttgttcacaagatctacttgtacgcaagatatggagagttccagttattagttgatttgaaaactgttgatatgaaatttggacgattcgccaatgatcaaatcagacaggaatttagagaaaagtttcaacaagaacggattattatgaatcaaaagccctggtatatcaagacgtacaatgtttggtgttga

SEQ ID NO: 8335 - protein, 613 aa, Debaryomyces hansenii CBS767
MQKSKFTRNRSNSCNNTSLSDLQIDPKIRSHSLSLPTSNASSIRNKNSETEKHRIKNNVTINKRSKNPIVKIIHSFKRTEDVDLETGETKLKSELNGFSLQMIAIGGSIGTGLLLGSGKSLSEGGAVPLLLGYILVATFIYCMCQALGELSVAMPVTGSFTKYSVMLIDKSWGFAMGWNYCLQWLILLPMELVAASMTIKFWPVIADYLPDYMVITIFYAMIICMNLLSVKYYGLFEVIFSLLKVVAIVIFLIVGLFIDIGVIGDERIGFKYWKDPGIFSGNGFNGFIGVVVTAAFSFSGSELVGITASESRNPDKEVPKAIKQVFWRICGFYLFSLFIVGLLVPFTHPNLVGDHKSDVNASPFVLALTNTKNNAFANIMNVVILISILSVGNSSIYASSRTLIALSENKQAPSLLNYIDKKKRPLIAIAISISFGSLAYISVLSPTGSEIMFLWLMSISGISVLCTYGTITLCHIRFRKALRLNDISYKEELPFCSQIGLTGSWYGLVVSIVIAISQIYIAITPVNGHFAIADFFQKVLGLLVISIFYFVHKIYLYARYGEFQLLVDLKTVDMKFGRFANDQIRQEFREKFQQERIIMNQKPWYIKTYNVWC

SEQ ID NO: 8336 - DNA, 1752 bp, Debaryomyces hansenii CBS767
  CDS (1)..(1752)
atgagtaagacgatgtctggcgaaagtatggatataaactcgaaatcgagtgactcgaacaatgtttatgtcaactatgtgtcaagccatgatggtggatctagatggcaccattttagagattcattcaagagagccgaaagagataatacatttgatgaccaggaattgaacggtttagaaaaagcgattcagaagacatcgaagacagatttaacacaaaacttgaaaaaacgtcaattgcaaatgatcgcaatcggaggatgtgtaggactgggtttattcattggggttggaccagctttagttaacgggccagccagtttgcttattgcctggggcttggtgtcgacttttctttactgtaccatgcagtcattagcagaactagcagcattatttccaatctcggggtcgttttcgacgtatgctactcgtttcgtagacccatcgtgggggtttgcagttggatggaactacgctattttctgggtggtggtgctaccattggaattggtagcctcatccatgactattaatttctggaattcgaacattaactcggtagcatgggtggctatcttttatgtattaatcatagggttaaacttatgtggaaataagggatttggggaggcagaatttattgcttctttgatcaaggtccttggtatcattggatttaatattttggcgatcgtgcttatctgtggtggtggtcaaaaaggtggttttattggtgcaaaatactggcataatccgggggcttttgctgctggattcaaaggtgttgtgagtgttttgattacagcaacatactctcttgcaggcacagaattggttggattaactgccgcggaaacagccggtaatccaagaattgtcttgccatctgccattaagcaagtgttttggagaattttacttttctacatgattaccttaaccttggtggggttcttagttccatataattcacctgaattgctcagaggctcaagttcatctgattcatctgcctctccatttgttattgccatcgaggcaggtggtattactgcattaccgtccattttcaatgtggttgttttaatttcattattatccattggtaactcttcagtttatggattcagcagaacaattctttcgttggcagaacaaggtttagcaccaaaatgctttgacttcgttgatagaaagggacgtccattagttggaattttagcctctgctattgttggtttgttatcgtttgtcgcagcatctccaaagcaaactgatgtgtttgcttggttaatggcattatcaggcctttctactcttttcacatggttctcagtgaatttatctcatatcagatttagaatggcgatgaagaaacaaggaagatctcttgatgaattaccttaccgtgcattgactggattttgggggtcagtttacgcagcagtgcttttatttgttgtcttatgtttacagttttggatatctttattcccattaggagaagcccctaatgcggctaaattttttgaaaattatctaggtgctgttgttgtgttagttttctttgttgcacataaattgtattctagaaagcttaacacaatagttcctttagacaccatggatgttgatacaggtagaagggaaactgatatcgacaaattgaaacaagagcttaaagaagagaaagacatcaggagcgcttacccaatgtacaggaagatttggaacttcttattctaa

SEQ ID NO: 8337 - protein, 583 aa, Debaryomyces hansenii CBS767
MSKTMSGESMDINSKSSDSNNVYVNYVSSHDGGSRWHHFRDSFKRAERDNTFDDQELNGLEKAIQKTSKTDLTQNLKKRQLQMIAIGGCVGLGLFIGVGPALVNGPASLLIAWGLVSTFLYCTMQSLAELAALFPISGSFSTYATRFVDPSWGFAVGWNYAIFWVVVLPLELVASSMTINFWNSNINSVAWVAIFYVLIIGLNLCGNKGFGEAEFIASLIKVLGIIGFNILAIVLICGGGQKGGFIGAKYWHNPGAFAAGFKGVVSVLITATYSLAGTELVGLTAAETAGNPRIVLPSAIKQVFWRILLFYMITLTLVGFLVPYNSPELLRGSSSSDSSASPFVIAIEAGGITALPSIFNVVVLISLLSIGNSSVYGFSRTILSLAEQGLAPKCFDFVDRKGRPLVGILASAIVGLLSFVAASPKQTDVFAWLMALSGLSTLFTWFSVNLSHIRFRMAMKKQGRSLDELPYRALTGFWGSVYAAVLLFVVLCLQFWISLFPLGEAPNAAKFFENYLGAVVVLVFFVAHKLYSRKLNTIVPLDTMDVDTGRRETDIDKLKQELKEEKDIRSAYPMYRKIWNFLF

SEQ ID NO: 8338 - DNA, 1749 bp, Debaryomyces hansenii CBS767
  CDS (1)..(1749)
atgtcggataaggaagatgctagaagcgtcgtcgaaagtgctattggaggatccagttctaatgacactgggtcaaatgaaaaggcatcgtcgaaatggcagaatttcagagattccttcaagagaccagcagaagagaaagagatagaatatggccaaaatgataatttgaatgacatagagaaggccaatattggtgcttcaaagtctccattaatgagagacttgaaaaatagacatttgcaaatgattgcaattggtggaagtgtggggactggtttgttgatcggtagtggttcctccttgagaactggtggtccagccgcattacttatagcctgggggcttgttggtacgatggtcttttgtactattcatgcattaggagagatgtgtgttgcttttcctgttagtggtgctttttcaagttatgcaacaagatttgttgatccttcatgggggtttgcagtaggatggaattatgctattatgtggttaattgtgcttccactagaattagtggccgcagctatgtcgattcaatattgggatagtacaatcaatccagttgcatgggttgccatcttttacatattcatcttcgttataaatttatttggggttaagggttacggtgaagccgaattttacttggctatagtcaagataatcgcaattattggctttataatattgggtattgtattagtctgtgggggtggtccaacccacgaatttattggtggtaaaaattttcataaccccggagcatttgcaaatgggttcaaaggtgtttgtactgtctttgtaactgcctcatacagtttggcaggatcggaaatggtgggtcttgcagcagctgaaaccgctaacccaaagaaaacattaccaaaagccatcaagcaagttttttggagaatttttcttttctatattttatcgttaacgttcattggtctcattgtaccgtatgattcagaagaattattaggatcgtctagcacaggatctgcatctccgtttgttattgcaattaaaattggtggcatcaacgcattaccttcaatcttcaacgctgtgattttaatttcggtcctttccgtgggtaattcagctgtttatgggtgctctcgtacaattcaaagtttaggagcacaaggattaggacctaaaatactcaattatgttgatcgtcgtggtagaccattggcaggattagcaatttcaggaatttttggattattatgtttccttagtgcgtatgagaatgaaggtgaagtatttacatggttgttaagtgtgagtggtttagccacaattttttcatggtttagtattggattgtgccacttgagatttagggccgcattgagatatcagggcagatctactgatgaattatcattcacgtctatcgcaggtatttggggctccatttattccatgattttccttatagttgtgttgggggtccaattctgggttgcattatttccaattggtagcgatggaaagccaaacgtaacgagtttcttccaaaattatttaggggtgtttgttatattgttattttacgtttgtcataaagtctactcgagaaattggaagttctacatcaagttaagcgagatagatttagatacaggtagacgagaaacggatgttgatttaatgaattatgaaatggaggaagatacaatcaaagagggggtacctatgtatttaagactttggaggagtttagtttaa

SEQ ID NO: 8339 - protein, 582 aa, Debaryomyces hansenii CBS767
MSDKEDARSVVESAIGGSSSNDTGSNEKASSKWQNFRDSFKRPAEEKEIEYGQNDNLNDIEKANIGASKSPLMRDLKNRHLQMIAIGGSVGTGLLIGSGSSLRTGGPAALLIAWGLVGTMVFCTIHALGEMCVAFPVSGAFSSYATRFVDPSWGFAVGWNYAIMWLIVLPLELVAAAMSIQYWDSTINPVAWVAIFYIFIFVINLFGVKGYGEAEFYLAIVKIIAIIGFIILGIVLVCGGGPTHEFIGGKNFHNPGAFANGFKGVCTVFVTASYSLAGSEMVGLAAAETANPKKTLPKAIKQVFWRIFLFYILSLTFIGLIVPYDSEELLGSSSTGSASPFVIAIKIGGINALPSIFNAVILISVLSVGNSAVYGCSRTIQSLGAQGLGPKILNYVDRRGRPLAGLAISGIFGLLCFLSAYENEGEVFTWLLSVSGLATIFSWFSIGLCHLRFRAALRYQGRSTDELSFTSIAGIWGSIYSMIFLIVVLGVQFWVALFPIGSDGKPNVTSFFQNYLGVFVILLFYVCHKVYSRNWKFYIKLSEIDLDTGRRETDVDLMNYEMEEDTIKEGVPMYLRLWRSLV

SEQ ID NO: 8340 - DNA, 1719 bp, Debaryomyces hansenii CBS767
  CDS (1)..(1719)
atgtcagcaaaagatttagaaatgaagccagtggtttctgagctcagaggagatttttccggttcagtatcggactccgaaacacctgctaacaataatgacatgggtaaatgggatcgctttaaagattcgtttaagagacaagaagtttcgcatggtgatgaaggtaaaaaattgcaaaaagggatcagtaagagacacttaacacttatggcccttgttactggtgttggtaccgggttgcttgtgggttcaggtaaggtattgcatgtttctggtccattatttttgatagttggttacgccatcgttgggtcgttcttatatcctactttacaagcggccggggagttggctgtgaattacagtagtctttctggtgggtacaataactatcctcgtaagttcctcgatgaatccattgcatttgcggttacttggaattactgtattcaatggttgtcagttattgctgtggaattagtcactgctgccatgaccattcagtactgggatcagaacacaaaatacaaccctgatatctgggtgtcaattttctttgtggtcattttactcatcaactttgttggttccaagggatatggtgaaggtgagttcgttttcggaagtatcaagttatgtatgatttgtggtttcattctcatggctattatcgtcaattgtggtggtgggcctgttggttttattggtggtagatattggcacaatcctgggtactataccaacttcaaggggttgtgtaatgttttcgtgactggtgccttttcgttgggtcaatctgaattcgttgctttatctgcggctgaacagcctaaccctagaaaggctatccctgctgcctgtaagttaattttctggagaattttaatcttattcttgggttcgttaacaatggttggtcttatggttccatacacttcagacaaattaatgggttctgctggtggtgctaaccatgcttctccatttgtacttgctgctgaattacacagtgttaaagttgctccagatattattaatgccgtcattttgttgtccgtcacttctgttgcatcatccgctttgtactcgtcctcaagaactttacagtccttagctgaacaaggttttgcgccaagttatttcaactatattgacaaggctggtagacctttaagagcattagttgtttgttctattgttggtttattctcattcatagctgcctacaaaaaagaagaagaagttttcacctggttgttatctatctctggtttatcgcaaatcttcacttggaatatcattgttgtatcccatgttagatttagacaagtcttgaagcataacggtatctcacttgattcgttaggttatgttgcgtctacgggtgtatggggttcggtttacgcaattgtatggcattggttgattttaattgcgcaattctacattgcgttgttccctgttggatctagtaccccagacgcccaaaacttcttcgagaattatcttggtgcttgtgttttaatctttttctatgttggtcataaactttggactagaaattggaagttgtacattaagaccagcgacgtcgatattaatgccgatagagttatatttgatgaagaagtattgaacttggaaaagcaagaatatcaagatcaattgaaaagaggtcctttctatgcgagagttatagatttccttttcaaataa

SEQ ID NO: 8341 - protein, 572 aa, Debaryomyces hansenii CBS767
MSAKDLEMKPVVSELRGDFSGSVSDSETPANNNDMGKWDRFKDSFKRQEVSHGDEGKKLQKGISKRHLTLMALVTGVGTGLLVGSGKVLHVSGPLFLIVGYAIVGSFLYPTLQAAGELAVNYSSLSGGYNNYPRKFLDESIAFAVTWNYCIQWLSVIAVELVTAAMTIQYWDQNTKYNPDIWVSIFFVVILLINFVGSKGYGEGEFVFGSIKLCMICGFILMAIIVNCGGGPVGFIGGRYWHNPGYYTNFKGLCNVFVTGAFSLGQSEFVALSAAEQPNPRKAIPAACKLIFWRILILFLGSLTMVGLMVPYTSDKLMGSAGGANHASPFVLAAELHSVKVAPDIINAVILLSVTSVASSALYSSSRTLQSLAEQGFAPSYFNYIDKAGRPLRALVVCSIVGLFSFIAAYKKEEEVFTWLLSISGLSQIFTWNIIVVSHVRFRQVLKHNGISLDSLGYVASTGVWGSVYAIVWHWLILIAQFYIALFPVGSSTPDAQNFFENYLGACVLIFFYVGHKLWTRNWKLYIKTSDVDINADRVIFDEEVLNLEKQEYQDQLKRGPFYARVIDFLFK

SEQ ID NO: 8342 - DNA, 1770 bp, Debaryomyces hansenii CBS767
  CDS (1)..(1770)
atgagcgttaacagcaaagtatctcgtgagaagtcacatagtttctccgaggttgatcatattagaagtggatcactcgaaagcacaggcaatggaggaatatggcagtcattcaagaactcgttcaaaccagctgaacaatctcgtaccttgacactgaaagacatctcggaagaagaggaagcgaaacttactaatgtggagagagcagctttgagatcggctaattcccaattatctcgttctttaaaatccagacacttgcaaatgatcgcgattgggtcttcaattggaacaggtttattcgtaggatctggaggtgctctcagagacggtggtccagccgggttaattattgcatggactgtcatttctacaggtgtgtttgctactgttcaaggtttaggtgagttatcagttgcgttacctgtaagtggtggttttaacatttatgctactagatttatcgaaccagctgttggatttgctattggatggaattatttcatgcaattttttgtgctattgcctttggagttagtagcggcctcgataacaattaaatattggaactcagatttaaattcagatatttttgtggcaatattttgggtgtctgtagtgtttatcacaatgttaggtgtcaaaggatacggtgaggctgaattcgtgttttcattggttaaagtagttgcaattattgggttcataatattaagtattgtcttgatatgtggtggtggcccaactcatgaatttgtcggaggcagtaattggagagagcctggtccatttgccaatggattcaaaggtgtttgttccgttttcgtaactgctgcctttagttttggtggaactgagatgattggcttaactgcagctgaaacagcaaatccaagaaaaacattgccaaaggctattaaacaggtcttctggagaatttgtttgttttacttgttatcattgactatgataggtacgttagtttcatataaggatgaaagcttaattggggcttcagatgtcgacgcgacagcatctccatttgttattgcaattcgtaatggtggtattggcggtttacctagcgttatcaatgctgttattttaatcgccgttttgtcagttggaaattcttcagtatatgctacatcgcgttcattgaattcattggccgaacaaggtatggctcctaaatggacgggttatgtcgatagagctggtagaccacttgttgctattttaattactaatgtgtttggtctttttgcattcattgctgcatctgacaaacaagttgaagctttcgattggttattagcattatcaggtttaagttctattttcacatggatctcaattaatgtagctcatattcgtttcagaagggccatgtcatatcaaggtagaaccactgctgaattaccatacgtatcacaatgtggtgtctggggatcatattatgcgttattactcaattgtttagtattgattgctcaattttggattgcattatttcctcttggaggtagtccaaatgcttatgattttttcctttcctacttaggattaccagtgatccttatgtcctggttgggttataaactttggaagaaggattggacattattcattagagctaaaaatttggacattgacaccggtagaattaacattgatatcgatgttcttcagcaagaaattgctgaggagaaagcacaacttgctgagaagccattctttgtaagattttacaagttctggtgttaa

SEQ ID NO: 8343 - protein, 589 aa, Debaryomyces hansenii CBS767
MSVNSKVSREKSHSFSEVDHIRSGSLESTGNGGIWQSFKNSFKPAEQSRTLTLKDISEEEEAKLTNVERAALRSANSQLSRSLKSRHLQMIAIGSSIGTGLFVGSGGALRDGGPAGLIIAWTVISTGVFATVQGLGELSVALPVSGGFNIYATRFIEPAVGFAIGWNYFMQFFVLLPLELVAASITIKYWNSDLNSDIFVAIFWVSVVFITMLGVKGYGEAEFVFSLVKVVAIIGFIILSIVLICGGGPTHEFVGGSNWREPGPFANGFKGVCSVFVTAAFSFGGTEMIGLTAAETANPRKTLPKAIKQVFWRICLFYLLSLTMIGTLVSYKDESLIGASDVDATASPFVIAIRNGGIGGLPSVINAVILIAVLSVGNSSVYATSRSLNSLAEQGMAPKWTGYVDRAGRPLVAILITNVFGLFAFIAASDKQVEAFDWLLALSGLSSIFTWISINVAHIRFRRAMSYQGRTTAELPYVSQCGVWGSYYALLLNCLVLIAQFWIALFPLGGSPNAYDFFLSYLGLPVILMSWLGYKLWKKDWTLFIRAKNLDIDTGRINIDIDVLQQEIAEEKAQLAEKPFFVRFYKFWC

SEQ ID NO: 8344 - DNA, 1707 bp, Debaryomyces hansenii CBS767
  CDS (1)..(1707)
atgtctaagttgagaacagagaaatcaaataaattagaggcggtggtctcggagatcgaaccgtactactctgattcatcaagagaaggaagtcgttgggcgaacttcaaggattcgttcaaaaggcaagtaccctccgatgaggccaacggatccagtggaattcaaatgcagaagtccattagcaaaaggcatttaagattaatggcattatcgactggtctcggtactgggttattggtggcagcgggagcaaaattagctacagccggtccgttatttcttcttgttggatacgctgtggtgggttatttaatgttaattccctgtataaatgcggttggagagttgtcggtcgcttataacaatttaccaggtggatttcagtcatactatagaaagtttatggacgaaagtattgcattcgcggtcggttggaattattgtttccagtgggctacagtcatctcgttggaacttgtgactgccggaatgaccataaggttttggaccacatctattaatcccgacattttcgtgttgatattcctcatagtggttgtgctcattaacttggccggagccaaaggttacggggaagcggaattctacatgaatagcgtcaagttgctcatgttgggaggtttcattatctttggtattatcattgattgtggtggtggacctgcagggtacattgggggtagatactggcataatccgggtgcatacaccagttttaaaggattatgtagtgttttcgtcacctctgcattctcattaggtgggaccgaattcatctcgttgtcagctgcagaacaggaaaacccaagacaatctattcctgctgcttgtaaattggtttttttcagaatcaccgttttcttccttggttcgttggcattggttgggttgctagttccatataactccgacaagttaatgggttctggtgaatctggtacatctccatatgtaattgcagcccaaatgcacggagtcaaagttattcctcatatcttcaatgcggttatattggtgtcggtcacgtctgtggccactgccgcaatgtattcgtccacgcggttgttacaatcgttggccgagcaaggttacgctccccaatacctcaactacatcgatcgtgccggtagaccattgagatgttggattgtcactatcttgtcatctttttttgcatttattgctacctacaaggaccaagaatccgtcttcacctggttgttgtcgatctcagccttgagtttcattttcacctgggccagtattgatatatgtcacattagattcagagccgctttgaagtacaacaacataccgttgagctcattaggttacgtatctagtaccggtaccatcggctcctacatttccttcatcctcaacattttaattcttatttgtcagttctgggtctcgttgttccccattgggggcgacgggtctcctaacgctctctcattctttcaaaattacttgggtgctgttgttttggtaatcttctacgttggtcacaagctttacactagaaactggagcttatatatcaaggtgcaagatattgatatcgacgccgataggaccatctacgatcccgaaattttggaattggaaaatcttgaaagcaaacagcgctttaacaaggcgcccttctggaagaagatcttgatttactgcttcgattag

SEQ ID NO: 8345 - protein, 568 aa, Debaryomyces hansenii CBS767
MSKLRTEKSNKLEAVVSEIEPYYSDSSREGSRWANFKDSFKRQVPSDEANGSSGIQMQKSISKRHLRLMALSTGLGTGLLVAAGAKLATAGPLFLLVGYAVVGYLMLIPCINAVGELSVAYNNLPGGFQSYYRKFMDESIAFAVGWNYCFQWATVISLELVTAGMTIRFWTTSINPDIFVLIFLIVVVLINLAGAKGYGEAEFYMNSVKLLMLGGFIIFGIIIDCGGGPAGYIGGRYWHNPGAYTSFKGLCSVFVTSAFSLGGTEFISLSAAEQENPRQSIPAACKLVFFRITVFFLGSLALVGLLVPYNSDKLMGSGESGTSPYVIAAQMHGVKVIPHIFNAVILVSVTSVATAAMYSSTRLLQSLAEQGYAPQYLNYIDRAGRPLRCWIVTILSSFFAFIATYKDQESVFTWLLSISALSFIFTWASIDICHIRFRAALKYNNIPLSSLGYVSSTGTIGSYISFILNILILICQFWVSLFPIGGDGSPNALSFFQNYLGAVVLVIFYVGHKLYTRNWSLYIKVQDIDIDADRTIYDPEILELENLESKQRFNKAPFWKKILIYCFD

SEQ ID NO: 8346 - DNA, 1761 bp, Debaryomyces hansenii CBS767
  CDS (1)..(1761)
atgaagaataatcttgacgttgagagaaatggagtcagagaatataccacttctctggaaaaaaatgacaacatcattattgaagttgaaagcaagaccgatatttgcaaaccagatgggttgaatggggtacttggttcattcatgccaatggaaaacgcagagttagacattaattcttcgctcacagaaaaccagaagattgatattaaaatgtcccaagaccctttacaaagatcgctatcgaaaaagtatagcacgatccttgcaacaggcgcgtgggtagctacggggtttttagttgttcttggtattccatttagggcagcagggcctttggggtctctattggcctatattatcattgcaagtatcgtattttgtacagttcaagctttaggggaactttctgcggcttatcctactggtggtgcatttataaaatacaacattagattcatcgataagtcctggggtttcgctatgagttggaattattatattcaatatttgatgatgtttccattggagttatatgccttgtcaattactatccagtattgggatcagaaaacaaacccatcaacatatatagcggtattttacacgttgataatattgatcaatatatttggatttaaaggttatggcaatgcagaattgatcttagccgctattaaacttattaccattgctggtttcgtcgtttgttctcttgtctttgtctgtggtggtggccccacaggagaatattttgggggatcatactggaatgatcctggttcattttctcatggcttcaaaggaatttgttttgcattcgcaacttctgcttttgcgtttgcgcgaactgaattggttggtgtggctgctgcctcatcactgaacccaagagaagctttacgtagagtagcgaaacattttctatggagaactcttctcatatatttgattccgttgatctttgttgggtttctagtcagctacgacgacgaaatgctcttaggagctggtccattaaaagcttcttgtgcgccatttacacttgccataaagcgcgctggggttcaaggattgacatccgtcatgaatgctgtcatccttatttccgtctttttcataggaatcaactcaatcaattattctggtcgtacattagcttcattggctgcatgtggtcaggcaccaaaagtttgtggatatattgataaggaaggaagacccatcgttgcgatccttatacaagcagtggttggaacaatcgcattctcgcgatccactctcatcggagacattgcagttgatttctgtttattattgtcttcggtatcatccatttttacgtggatgtcgattaacttctcttatattagatttaggagagctatgtcagttcaagctcgtgatcctaataatctcccttgtacatcattattgggggtatggggtgccgtttacgcgtgtgtaattagtttcttggtattggctggttacttctggaccgcattattcccattgggtaaagatccagatgccgaggagttctttaaagcaggtttatgttatgctatggtattcgtcttttactttggtcataagttaactacgaaggactggagattattttatagggcctctgatatcgatcttgatactgagatgactaaagcggatgtacaaaaaattgaagatatggacaggcatgtaacgttaatgcggaaggagtcattttttgcgaggttgtccagcttctggtgctaa

SEQ ID NO: 8347 - protein, 586 aa, Debaryomyces hansenii CBS767
MKNNLDVERNGVREYTTSLEKNDNIIIEVESKTDICKPDGLNGVLGSFMPMENAELDINSSLTENQKIDIKMSQDPLQRSLSKKYSTILATGAWVATGFLVVLGIPFRAAGPLGSLLAYIIIASIVFCTVQALGELSAAYPTGGAFIKYNIRFIDKSWGFAMSWNYYIQYLMMFPLELYALSITIQYWDQKTNPSTYIAVFYTLIILINIFGFKGYGNAELILAAIKLITIAGFVVCSLVFVCGGGPTGEYFGGSYWNDPGSFSHGFKGICFAFATSAFAFARTELVGVAAASSLNPREALRRVAKHFLWRTLLIYLIPLIFVGFLVSYDDEMLLGAGPLKASCAPFTLAIKRAGVQGLTSVMNAVILISVFFIGINSINYSGRTLASLAACGQAPKVCGYIDKEGRPIVAILIQAVVGTIAFSRSTLIGDIAVDFCLLLSSVSSIFTWMSINFSYIRFRRAMSVQARDPNNLPCTSLLGVWGAVYACVISFLVLAGYFWTALFPLGKDPDAEEFFKAGLCYAMVFVFYFGHKLTTKDWRLFYRASDIDLDTEMTKADVQKIEDMDRHVTLMRKESFFARLSSFWC

SEQ ID NO: 8348 - DNA, 1734 bp, Yarrowia lipolytica CLIB122
  CDS (1)..(1734)
atggaaaaaaacgaagtggtatcaaccaactctccccacgaggagggatctgtcactgaggccaacaacggacgatgggccaacttcaaggactccttccgacgagccgatctgagcgaatacgacaccgagggtctttctgatctcgaaaaggccgctctggcaaccgctaactcccctctcagtcgatccctcaagggacgacatctccagatgattgccatcggaggatccattggaactggtctgtttgttggcagtggaaccaccctggccactggaggaccggcagccattctcatcgcctactccatcattggaactatgttgttttgcaccatgcactctctgggagaactgtgtgcttgcttccccgtctccggcgcgtttgcctcttactctactcgattcatcgaccccgcctggggcttcgccatgggatggaactacactctcaactggtttattgtgttccccctggagctcgtagccgcaagtctgacggtcaactactggaatgaagctaacggaaccaactacaatgctggctgctgggtcgctatcttctgggtgctaattgtctccatcaattttttcggagtcaagggctacggagaagccgagttttacttttcgcttattaaagtcattgctgtggtcggattcatcattctcgctattgttctgacctgtggaggaggacccaaccacgactacatcggaggccgatactggcacaaccccggcgctttctctgctggtgccaagggagtctgtgccgtcttcgtgtctgctgcctttgctttcaacggaactgagctggctggcctggctgctgccgagaccgccaatccccgaaagtccatccccactgctaccaagcaagtcttctggcgaattaccctcttctatattgtgtctttgactctggtcggcttccttgttccctgggaccacccccagctgctcaacaagagctcttctgctgacgcttccgcctctccgttcgtcattgccatcaaggctgccggcatcaagggccttccatctgtcatgaacgtcgtcattatgatttccgttctgtccgtcggcaactcctctatctttggtttctctcgaactatcgctgctctcgcccagcaaggtcaggctccttccttcttcgcttacattgatcgaaagggacgacctctgtttggcatcatcacagtctcgctctttggactgtttgcattcatctgtgccggtcctatcgaaacccagaacaccgtcttctactggctcatggccatctgtggcctctcctccatcttcacatggggctccatcaacctgtgccacttccgattccgaatggccatgaaggtccagggtcgatctctccgagaaatgcctttcttgtctcacgtcggaactatcggatccatgtacggcttcctgctcaacgtaaccgtgcttggattgcagttctggatcgctctcttccccgtgggaggtgccaagcctaaggctgacgtcttcttccaggcctacctggctgtacctgttgtcctggccttctatatctttttcaagctgtggaaacggcccagcttcgtggctctaaaggacatggacctcgacactggacgacgagaaactgacttcgagctgctcatgcatgagatggacgaagaggctgcctacattgcctccaagcccttctactaccgagtttacaagttctggtgctaa

SEQ ID NO: 8349 - protein, 577 aa, Yarrowia lipolytica CLIB122
MEKNEVVSTNSPHEEGSVTEANNGRWANFKDSFRRADLSEYDTEGLSDLEKAALATANSPLSRSLKGRHLQMIAIGGSIGTGLFVGSGTTLATGGPAAILIAYSIIGTMLFCTMHSLGELCACFPVSGAFASYSTRFIDPAWGFAMGWNYTLNWFIVFPLELVAASLTVNYWNEANGTNYNAGCWVAIFWVLIVSINFFGVKGYGEAEFYFSLIKVIAVVGFIILAIVLTCGGGPNHDYIGGRYWHNPGAFSAGAKGVCAVFVSAAFAFNGTELAGLAAAETANPRKSIPTATKQVFWRITLFYIVSLTLVGFLVPWDHPQLLNKSSSADASASPFVIAIKAAGIKGLPSVMNVVIMISVLSVGNSSIFGFSRTIAALAQQGQAPSFFAYIDRKGRPLFGIITVSLFGLFAFICAGPIETQNTVFYWLMAICGLSSIFTWGSINLCHFRFRMAMKVQGRSLREMPFLSHVGTIGSMYGFLLNVTVLGLQFWIALFPVGGAKPKADVFFQAYLAVPVVLAFYIFFKLWKRPSFVALKDMDLDTGRRETDFELLMHEMDEEAAYIASKPFYYRVYKFWC

SEQ ID NO: 8350 - DNA, 1761 bp, Yarrowia lipolytica CLIB122
  CDS (1)..(1761)
atggaaaccgaaaaaacatttacaacgaccacggtcgactccgatcccgacacccatggagaggtcgtggtcaacacaaagaagatgaacgcgtggcagcggttcaaggacggctttggcccagctgatgtgtcccacattgacactgagggcttgactcctatggagattgccgctctcaaaaccgccaatgctcctcttaatagaggtctcaagggccgtcatctgcagatgattgccattggaggttcgattggaaccggtctgttcgtcggatcgggagcttcacttgccactggcggccccgcagctctcctcatcgcctacggtatcattggatgcatgttgttgtgcaccgtccatgccctgggagagctggctgttgccttccccgtctctggtgccttctccacttatttcacacgatttattgatcctgcttggggattcgccatgggctggaactacaccctgctgtggtttgccattctgcctctggaacttgtagctgcctccattaccgtggagtattggaacgagcagaacggcaccaatatcaaccctgccgcgtggatcagtctcttctgggccctcattgcaggaatcaacctctttggagtcaagggatatggagaagccgagtttgttttctccatcatcaaggtggccgccgtcattggcttcatcatcatgggtatcgtctttgtgtgtggaggtggacccaaggggtacgattacgacaaatacattggaggtagcatgtggcagaatcccggagccttcgcccatggcttcaagggtgtgtgttctgtctttgtcactgccgccttcgcctttgccggtactgaactggttggtctggctgctgctgagactgaagacccccgaaaaatgctccccaccgccaccaagcaggtcttctggcgaatctgtctcttctacctcatttctctgactctggtcggtcttctggtgcgattcgacgacccccggctcctcaacggaacctccaacgtcgacatcaaggcttctccttttgtcattgccattctgaatgccggagtcaagggcctgccctccgtcatgaatgtggtcattatgattgccgtgctttctgtcggaaatgcctcggtgtacggcttctctagaacaattgccgccatggctctgcgaggagaagcccctgccttctggggttacattgacaagaacggccgtcccatttacggcatttttgccgtgctggcctttggtctgttcgccttcattgcggctgcttctgccgatattcgaaacaaggtctttatgtggctgctggctctgtctggcctgtcttcgattcttgtctggggctccattaaccttgcccacattcggttccgacaggctctcaagttccgaggccgagatacttccgagctgacttttgtggccggctttggtgtctggggttccgtcttcggccttaccctcaactgcttggtactcgtagcccagttctggatcgccctgtatcctattggaggcgagcccaacgctgaggccttctttgccgcctacctggctgctcccatcgtcattgttttctggatcttctggaaggtgtggaagcgacctcccttcctcaaggtctcggatctggacattgacactggtcgaagagacacggatctggatcgggttcgagccgagactaccgctgagcgggagtacattgcatccagaaacttcttctaccgggtctacaagttctggtgttaa

SEQ ID NO: 8351 - protein, 586 aa, Yarrowia lipolytica CLIB122
METEKTFTTTTVDSDPDTHGEVVVNTKKMNAWQRFKDGFGPADVSHIDTEGLTPMEIAALKTANAPLNRGLKGRHLQMIAIGGSIGTGLFVGSGASLATGGPAALLIAYGIIGCMLLCTVHALGELAVAFPVSGAFSTYFTRFIDPAWGFAMGWNYTLLWFAILPLELVAASITVEYWNEQNGTNINPAAWISLFWALIAGINLFGVKGYGEAEFVFSIIKVAAVIGFIIMGIVFVCGGGPKGYDYDKYIGGSMWQNPGAFAHGFKGVCSVFVTAAFAFAGTELVGLAAAETEDPRKMLPTATKQVFWRICLFYLISLTLVGLLVRFDDPRLLNGTSNVDIKASPFVIAILNAGVKGLPSVMNVVIMIAVLSVGNASVYGFSRTIAAMALRGEAPAFWGYIDKNGRPIYGIFAVLAFGLFAFIAAASADIRNKVFMWLLALSGLSSILVWGSINLAHIRFRQALKFRGRDTSELTFVAGFGVWGSVFGLTLNCLVLVAQFWIALYPIGGEPNAEAFFAAYLAAPIVIVFWIFWKVWKRPPFLKVSDLDIDTGRRDTDLDRVRAETTAEREYIASRNFFYRVYKFWC

SEQ ID NO: 8352 - DNA, 1809 bp, Yarrowia lipolytica CLIB122
  CDS (1)..(1809)
atgaacgacattgaaaaaaaccaagacgccgcatcggtggcttcctactccaagcaggatgctccggcttatgacgatgagccctcagccatcggctctgtgcacgagcacaaggctggcaagtggcagaacttcaaggattcgttcaagcccgctgatctgtcgcaatacgacaccacaggcatgaccgaggtcgagaaggccgcccttgctactgccaactctcccctgtctcgaggtctcaagccccgacatcttcagatgattgctatcggtggttctatcggtaccggtctttttgtcggttctggaacttccctggccaccggtggccctgccgctcttctgattgcttacggtatcattggagtcatgctgttttgcactgtccacgctctcggtgagcttgcttgtaccttccctgttgctggttctttcgctacttactctactcgatttatccaccccgcttggggctttgccatgggctggaattataccatgtcctggtttgttgtgcttcctctcgaacttgtcgccgcatccatcacagtcaacttctggcaggacatgaaccacacagatattaacaacgccgcttggatcgccatcttctgggccttgattgtctgcatcaacttatttggagttaagggatacggagaagccgaatttgtcttttctcttaccaaggttgttgccattctcggtttctgcattctcggaatcgtgctggtcgcaggaggaggaccccatcagggctacattggaggtaagtggtggcaccgacttcccgagggaaccgtcggaccccgaggaggagcctttgcccacgcgtttaagggtgtctgtgctaccttcgtgtctgctgccttcgccttcactggaactgagctggtaggtctggctgccgccgagaccgagaacccccgaaagatgcttccctccgccaccaagcaggtcttctggcgaattctcatcttctacatcgtctctcttacactggtcggtctccttgttcctttcgatgaaccccatcttctcaagggttcttcttccgtcgatgccactgcctcccccttcgtcattgccatccgaaacgctggaatttctggtcttccttccgttatgaatgttgttatcatgattgctgttctttctgtcggtaactccgctgtctacggtttctctcgaaccattgctggtctggctgctatgggccatgcccccaagtggttcgcctacattgaccgacagggacggcccattgtcggtattctcgttgtttcattttggggtctgtttgccttcatttgtgccgctcctgtcgctacccagaacgccgtttttggctggctcatggctttgtctggtctcgcctctatcttcacttggggttctatcaatctctgtcatatccgattccgactggctcttaagaaacaaggacgaaccacccgagagcttgtcttcactgctgcacttggtatctggggttccgttcttggtcttactctcaactgtctggttctgatcgcccagttctggatcgctttgttccctattggagcccccaagcctactgctgaggctttcttcaacgcttacctcgctgcccctgtcgtcctcttctttgctctcgtttggctcgtctggaagcgagacccttggctctccattgaccagctcgatatcgatactggacgacgtgacaccgatctggtcaagctggaggccgagcttgagcaggagcgatacgagctttcccagcgcaagtggttctaccgagtctacaaggcctggtgttag

SEQ ID NO: 8353 - protein, 602 aa, Yarrowia lipolytica CLIB122
MNDIEKNQDAASVASYSKQDAPAYDDEPSAIGSVHEHKAGKWQNFKDSFKPADLSQYDTTGMTEVEKAALATANSPLSRGLKPRHLQMIAIGGSIGTGLFVGSGTSLATGGPAALLIAYGIIGVMLFCTVHALGELACTFPVAGSFATYSTRFIHPAWGFAMGWNYTMSWFVVLPLELVAASITVNFWQDMNHTDINNAAWIAIFWALIVCINLFGVKGYGEAEFVFSLTKVVAILGFCILGIVLVAGGGPHQGYIGGKWWHRLPEGTVGPRGGAFAHAFKGVCATFVSAAFAFTGTELVGLAAAETENPRKMLPSATKQVFWRILIFYIVSLTLVGLLVPFDEPHLLKGSSSVDATASPFVIAIRNAGISGLPSVMNVVIMIAVLSVGNSAVYGFSRTIAGLAAMGHAPKWFAYIDRQGRPIVGILVVSFWGLFAFICAAPVATQNAVFGWLMALSGLASIFTWGSINLCHIRFRLALKKQGRTTRELVFTAALGIWGSVLGLTLNCLVLIAQFWIALFPIGAPKPTAEAFFNAYLAAPVVLFFALVWLVWKRDPWLSIDQLDIDTGRRDTDLVKLEAELEQERYELSQRKWFYRVYKAWC

SEQ ID NO: 8354 - DNA, 1848 bp, Yarrowia lipolytica CLIB122
  CDS (1)..(1848)
atgtccactgggagagcgtatatgaccagcagaattgccaactcccctacccgtccgaaatcacccactcaaacatcttctgttatgtcagaaacaaaaccagttcaggccgagtccatttcgatcacttccgaggccggccaggtgaccggccaggtggaagtaatgccctccaatgcctggcaacggttcaaatacggctttgggccggccgacaccaccgacatggacttcaccggtctgactcccatggaaatcaccgctctcaagacagccaattcgcccctacaacgaaacctcaagggccggcatctgcagatgattgccattggtgggtccattggcaccgggttgtttatcgggtcaggaagcacgcttagtcagggtggtcctgcggcgttgctgatcgcctatggtatcattggagtcatgttgctgctgacgatgcacgcgctgggagaactggcggtctgcttccccgtttccggtgggtttttcaccctctttacccgcttcatcgaccccggctggggctttgccatggcgtggaactacgtcatgagctggtttgtcattttgccactggagctggtggcggcagccatgacggtcaacttctggaacgaaatcaatggcacatccatcaacaccgccgcgtggatcatcattttctggaccctgattgtctgcatcaatctgtttggcgtccgcggctacggcgaggccgagtttgtcttttccatcattaaaatcgccgccatttgtgggttcatcatctttggaatcatcatggccgccggtggaggaccttcagacggcgctttttcgtcttatcagggcggaaaactgtggaaaagtcccggaactctggccaacggattcaaaggcgtttgctctgtgtttgtaactgcagcgtttgcgtttgccggcaccgaattggcgggactggcagcagcagagacggaaaacccccgcaaaatgctgcccaaggccaccaaacaggtcttctggcgaatctgtctcttctatattgtcgccctgacggtggtggggctgctggtgccctacgacaacgagatgctgctgaacggcagctcgtcggcagacgccacggcctcgccctttgtcattgccattcggctggccggagtcaagggcctcccctcggtaatgaacgtggtcatcatgatcgccgtgctgtcggtcggaaacgctggagtgtacgccttttcccggactatcgccggaatggccgaagccggccaggcgcccaaaatgtttgcctacattgaccgacagggccggccgattgtcggcattgcggtggtgctgatattttcgctgtttgccttcatttcggccgccggagccgaagttcgaagcgccgtcttcaactggctgctggcgctctccggcctctcgtcggtcgtggtctggggctccatcaacctcgcccacatccggttccgacaggccctcaagtaccgaggtcgagataccggcgagctgacgttttccgccgggtttggcgtctacgggtcgtacgtgggtctgtcactcaacattctcgtgctcattgcccagttctggatcgcgctgttcccgctgggtggcaagcccaacgccgaggactttttcatggcttatctggctgctccggtgattctggcctttgtaattggctacaaactcgtcaaaagagacggaattctcaaaatcagcgagattgacatcgacacgggccgacgagagaaggatctggagaagctcaaggcggaaatcgcccaggaggagtacgacttgagccagaggggatttgcgtacagagtgtacaacttttggtgttga

SEQ ID NO: 8355 - protein, 615 aa, Yarrowia lipolytica CLIB122
MSTGRAYMTSRIANSPTRPKSPTQTSSVMSETKPVQAESISITSEAGQVTGQVEVMPSNAWQRFKYGFGPADTTDMDFTGLTPMEITALKTANSPLQRNLKGRHLQMIAIGGSIGTGLFIGSGSTLSQGGPAALLIAYGIIGVMLLLTMHALGELAVCFPVSGGFFTLFTRFIDPGWGFAMAWNYVMSWFVILPLELVAAAMTVNFWNEINGTSINTAAWIIIFWTLIVCINLFGVRGYGEAEFVFSIIKIAAICGFIIFGIIMAAGGGPSDGAFSSYQGGKLWKSPGTLANGFKGVCSVFVTAAFAFAGTELAGLAAAETENPRKMLPKATKQVFWRICLFYIVALTVVGLLVPYDNEMLLNGSSSADATASPFVIAIRLAGVKGLPSVMNVVIMIAVLSVGNAGVYAFSRTIAGMAEAGQAPKMFAYIDRQGRPIVGIAVVLIFSLFAFISAAGAEVRSAVFNWLLALSGLSSVVVWGSINLAHIRFRQALKYRGRDTGELTFSAGFGVYGSYVGLSLNILVLIAQFWIALFPLGGKPNAEDFFMAYLAAPVILAFVIGYKLVKRDGILKISEIDIDTGRREKDLEKLKAEIAQEEYDLSQRGFAYRVYNFWC

SEQ ID NO: 8356 - DNA, 1881 bp, Yarrowia lipolytica CLIB122
  CDS (1)..(1881)
atgcaaatgctcaaccgaacaaggaagggatccgggctgcacggctctgatcggtggcttgtatataagtcgaagctgggggaccgttgtgggcagtcactgcgtcttcattactccatcagcatggaaaaagactattcagatacgccagaaagtgccgagttcaccgagactcataccgggcaggtggagacggcccatatgagcaaatggcagcggttcaagtacggatttggccctgcggacatcagccatattgacaccgagggtctgactccgatggagatcacagctctcaagacagccaactctcctcttcaacggggactcaagggcagacatctccagatgattgctattggcgggtctattggcacgggtttgtttgttggttcgggcagcacacttgccaacggtggtcctgccgctcttctcattgcctacggcattatcggaatcatgttgctgctgaccatgcacgctctaggagagctggcggtgtgtttccccgtgtcgggagggttctgcacctactttacgcggttcatcgacacggcgtggggctttgccatggcgtggaactacgtcatgaactggtttgtggtgctacctctggagctggtggctgcgtcaatgacggtcaacttctggaacgagatgaacggcacccacatcaacgccgccgcctgggtctccgtgttttgggccgtcatcacctgcattaatctgtttggagtcaagggctatggagaggccgagttcgtcttctccatcatcaaggtggtggctatcgtgggctttgtcattttcggaatcgtcatggcctgtggaggaggacctgaacgcggagacttccatcattacatgggcggaaccctatggcaacaccccggtgcctttgcccacggatttaaaggcgtttgtgccgtgtttgtcactgctgcctttgcttttgccggcaccgaactgtgcggtctggcggcggcggagaccgaaaacccccggaaaatgctgccccgagccaccaaacaggtcttctggcgaatctgtctcttctacattgtgtctctgaccattgtgggtctgttggtgccgtggaacaacgaccagctgctcaacggctcttcttctgccgacgccgccgcctcgccatttgtcattgccattcggctggccggagtcaagggtctgccgtcggtgatgaacgtggtaatcatgatttcggtcctgtcggtcggaaacgcctccgtctacggcttttcgcgaaccatggccgccatgggcgagtccggacaggcccccaagatcttcgcttacattgaccgcgagggccggcccatcttcggtattctggtggtcctggcgttcggactcttctccttcattgccgccgccggcgccgaaaccagaaacgaggtcttcaactggctgctggcgctctcgggtctctcctccgtgtttgtgtggggctccatctgtctcgcccacatccggttccgcttggccctcaaataccggggccgaggaaccgacgaactcaccttccgcgcagcgtttggagtctggggaagcgtgttgggcctgattctcaactgtctagtgctcatggcccagttttggatcgccctgtatcccctgggagcaaagacccccaacgcgtccgacttcttccaggcctacctggcagcgccggtggtcattgccttctggatcttctggaaggtgtggaagcgcgacggctttctgggtctcaaggacctggacattgacaccggccggcgcgaaatggatctcgacaaggtgcgagccgaaatggccatcgaggacgaggagctgtcccgacgctccttcctttatcgaacatacaatttctggtgttag

SEQ ID NO: 8357 - protein, 626 aa, Yarrowia lipolytica CLIB122
MQMLNRTRKGSGLHGSDRWLVYKSKLGDRCGQSLRLHYSISMEKDYSDTPESAEFTETHTGQVETAHMSKWQRFKYGFGPADISHIDTEGLTPMEITALKTANSPLQRGLKGRHLQMIAIGGSIGTGLFVGSGSTLANGGPAALLIAYGIIGIMLLLTMHALGELAVCFPVSGGFCTYFTRFIDTAWGFAMAWNYVMNWFVVLPLELVAASMTVNFWNEMNGTHINAAAWVSVFWAVITCINLFGVKGYGEAEFVFSIIKVVAIVGFVIFGIVMACGGGPERGDFHHYMGGTLWQHPGAFAHGFKGVCAVFVTAAFAFAGTELCGLAAAETENPRKMLPRATKQVFWRICLFYIVSLTIVGLLVPWNNDQLLNGSSSADAAASPFVIAIRLAGVKGLPSVMNVVIMISVLSVGNASVYGFSRTMAAMGESGQAPKIFAYIDREGRPIFGILVVLAFGLFSFIAAAGAETRNEVFNWLLALSGLSSVFVWGSICLAHIRFRLALKYRGRGTDELTFRAAFGVWGSVLGLILNCLVLMAQFWIALYPLGAKTPNASDFFQAYLAAPVVIAFWIFWKVWKRDGFLGLKDLDIDTGRREMDLDKVRAEMAIEDEELSRRSFLYRTYNFWC

SEQ ID NO: 8358 - DNA, 1782 bp, Yarrowia lipolytica CLIB122
  CDS (1)..(1782)
atgagcgagcgaaaatcctttacggaaaacgtcgagtccgacaactctgtgggcgagatccacgaggtcaaggccgagggaccccccgacacttctcacctcagctactggggtcgattcaagcacggttttggtccggcagatgtggcacacctcgatcttgagggtctgacacccatggagatcactgctctcaagactgccaatgcacctcttcaacgaaacctcaagggtcgacatttgcaaatgattgcaattggaggatccattggtacgggtctgtttgttggatctggaagtactcttgccaacggaggtcctgccgcccttctcattgcttatggagtcattggtatcatgttgctgctgaccatgcatgctcttggagagctggctgtctgtttccctgtctctggaggtttctgcacttacttcactcgatttcttgatcccggatggggctttgccatgtcctggaactacattatgggctggtttgtcattcttcctctagaactggtggcagcgtccatgacagttaacttctggaacgaaatgaacggtactcacatcaatgcagcggcctgggtgtccatcttctggatcatcatctgcgccatcaacctgtttggagtcaagggatacggagaagccgagtttgtcttttccatcatcaaggttgctgccattgtcggtttcattctgtttggaatcgtcatggctgccggaggaggacccaagggaggagccttccacgagtaccagggaggtaaactgtggcagcatccgggagcctttgcccatggtttcaagggtgtgtgttccgtctttgtcactgccgcctttgcctttgctggtaccgagctgtgtggtcttgctgctgccgagaccgagaacccccgagtcatgctgcccaaggccaccaagcaggttttctggcgaatctgtctcttctatctcgtttccctgaccatcgttggcctgctcgtgccctggaacaacgaccagctgctcaacggatcctcttctgccgacgcagctgcctctcccttcgttattgccatccgagtggctggtgttaagggtctgccttcggtcatgaacgtggtcatcatgatttcggttctctccgtcggtaacgctgccgtctacggtttctctcgaactattgctgccatgggagagtccggacaggcccccaagatcttcgcctacattgaccgagaaggtcgacctatcttcggcatcctggtcgttctggcgtttggtctgttctctttcattgctgcagccggtgctgaaacccgaaacgaagtcttcaactggctgctggctctgtctggtttgtcttccgtcttcatctggggctccatctgtgctgcccatattcgattccgaatggctctcaagtaccgaggccgaggaaccgacgagttgtcatttgtggctggttttggagtctggggatctgtcattggtgtagttctcaactgcctggtcctcatggcccagttctggatcgctctctaccccctgggagtcaagactcccaatgcctctgacttcttccaggcctacctggctgctcctgtcattctcggattctggatcttctggaaaatctggaaacgagatggcctgttcttgcttctgaaggacttggacattgacactggaagacgagagcccgatctcgagagagtcaaggccgagatggctgaggagagatacgccctcagccagaagaacttcatgtacagactttacaacttttggtgttag

SEQ ID NO: 8359 - protein, 593 aa, Yarrowia lipolytica CLIB122
MSERKSFTENVESDNSVGEIHEVKAEGPPDTSHLSYWGRFKHGFGPADVAHLDLEGLTPMEITALKTANAPLQRNLKGRHLQMIAIGGSIGTGLFVGSGSTLANGGPAALLIAYGVIGIMLLLTMHALGELAVCFPVSGGFCTYFTRFLDPGWGFAMSWNYIMGWFVILPLELVAASMTVNFWNEMNGTHINAAAWVSIFWIIICAINLFGVKGYGEAEFVFSIIKVAAIVGFILFGIVMAAGGGPKGGAFHEYQGGKLWQHPGAFAHGFKGVCSVFVTAAFAFAGTELCGLAAAETENPRVMLPKATKQVFWRICLFYLVSLTIVGLLVPWNNDQLLNGSSSADAAASPFVIAIRVAGVKGLPSVMNVVIMISVLSVGNAAVYGFSRTIAAMGESGQAPKIFAYIDREGRPIFGILVVLAFGLFSFIAAAGAETRNEVFNWLLALSGLSSVFIWGSICAAHIRFRMALKYRGRGTDELSFVAGFGVWGSVIGVVLNCLVLMAQFWIALYPLGVKTPNASDFFQAYLAAPVILGFWIFWKIWKRDGLFLLLKDLDIDTGRREPDLERVKAEMAEERYALSQKNFMYRLYNFWC

SEQ ID NO: 8360 - DNA, 1818 bp, Yarrowia lipolytica CLIB122
  CDS (1)..(1818)
atgccctggaaaactttgctgagcctggtatatatgtcgagagcgtgccaggtgcatggaaaacaacacgtttgcaccatgaccgaagaaaaaacgcattcgctgtcgcccaatgactctgtcagcagcggcattggcgagatcaagaccacctccaagtggcgtaactttgtcgattccttcaaggaggccgacctccacgatgtcgacaccgagggcatgaccgagctcgaaatctcgcagctcaaggccgctaactcgcccctgcagcggtccctcaaggacagacacgtcaagatgattgccattggaggttccattggaaccggtttgtttgtgggatcgggaggagctctggcccagggtggacccgccgccctgctcattgcatacactcttgtcggttctcttctcttctgcacaatcaactctctcggagagcttgctgtcgcgttccctgtctcaggagcctttgctaccttttcgtccaactttattgaccctgcctggggttttgccatgggctggaactacactctcaactggtttatcactttccctctcgaactagtcgccgcgtctattaccgtcgacctgtggcgtgaatttaacaattccaacatctcgcctgcagcctgggttgccatcttctatgtggcgattgtgtccatcaacttctttggcgccaagggctacggagaggccgagttcattttctccatcatcaaggttgtagccgtggtcggattcattctgttctctctcattctcgtctgcggaggagtccctggaaacggatatattggaggtaagcacttccacgaccccggtgcctttgcaaacagcttcaagggtgtggctgccaccttcatcaatgcagccttcgcgtttggaggaactgagctggtcggtctagctgctgccgagactgagaacccccgacgagccatcccctctgccaccaagcaggtcttctggcgatgtttcatcttctacttcctgtctttgcttttcatcggccttattgtgccctacaattctcccgagctgcttgctcagggctctgttctgggctctgcctctccctttgtcattgctatcaagaacgctggtgtcaagggactgccctccgtcatgaacgtggtcatcatggtcgccgttttgtctgtcggaaactccgctatctacggctgctctcgaaccgtggctgctctggctgcccagggaatggcccccaagatttttggctacattgatcgaaccggccgacctcttgtgggtatcattgcctgctccatctttggtctgttggcctttgtctgtgccgcccccaaggaggttgagaacgaggtcttcttctggcttctgtcggtcgcaggtctgtctggaaccttcacctggggctccgtcaacctgtgccatatccgatggcgactggccatcaagaagcagggccgagagctcaagcgagaagtcaccttcaagtcgcgagtcggcatctggggctccatctactcctttgttttctgcattgtcattctggccttccagttctgggtggctctcttccccgttggaggagccgaccctactccccgggtcttcttccaggcctatctgtgtgtgcctgtcattctcgttttctactttgtttacaagatctggaagcgaactaagatctggaagctcgcggacatcaacctcgacgtgggccgacgggagttcgactacgacgccttgcagcgacagctggaggccgagaaaatcgagatggctacccgaccctggtacgtgcgatggggcaactactggtgctaa

SEQ ID NO: 8361 - protein, 605 aa, Yarrowia lipolytica CLIB122
MPWKTLLSLVYMSRACQVHGKQHVCTMTEEKTHSLSPNDSVSSGIGEIKTTSKWRNFVDSFKEADLHDVDTEGMTELEISQLKAANSPLQRSLKDRHVKMIAIGGSIGTGLFVGSGGALAQGGPAALLIAYTLVGSLLFCTINSLGELAVAFPVSGAFATFSSNFIDPAWGFAMGWNYTLNWFITFPLELVAASITVDLWREFNNSNISPAAWVAIFYVAIVSINFFGAKGYGEAEFIFSIIKVVAVVGFILFSLILVCGGVPGNGYIGGKHFHDPGAFANSFKGVAATFINAAFAFGGTELVGLAAAETENPRRAIPSATKQVFWRCFIFYFLSLLFIGLIVPYNSPELLAQGSVLGSASPFVIAIKNAGVKGLPSVMNVVIMVAVLSVGNSAIYGCSRTVAALAAQGMAPKIFGYIDRTGRPLVGIIACSIFGLLAFVCAAPKEVENEVFFWLLSVAGLSGTFTWGSVNLCHIRWRLAIKKQGRELKREVTFKSRVGIWGSIYSFVFCIVILAFQFWVALFPVGGADPTPRVFFQAYLCVPVILVFYFVYKIWKRTKIWKLADINLDVGRREFDYDALQRQLEAEKIEMATRPWYVRWGNYWC

SEQ ID NO: 8362 - DNA, 1758 bp, Aspergillus nidulans FGSC A4
  CDS (1)..(1758)
atggacaaagactttttgaagggcaaccctgaacgctcaacatcatctgactctaccccagtctatggcgagtctacatccagacgcgcaagcctgggacagcgggttttaggaagctttcaaagagacccaaatgcccatgtcactgctttcgcgtcattttcggatggcaaaacatatgacatcgaaaatgcgacagaaaaggcagccaactctccgctacatcgtagcctaagaggtcgccatctgcagatgattgctatcggaggctccatcggtaccggcctgttcgtcagctcggggagggtccttgctacgggaggcccggcttcgctcctcatcgcatatgcattgattggatgcatgctctactgtgctgtacatgcccttggggagatggccgtgatattccccgtggctggttcgttcgcccactactcgactcgctttattgatccggcctggggtttcgctatgggttggaactatgctctccaatggctagcaattttacccttagagatcgtggcggctgcaatcaccgttgattactgggaatcgaacatatccagcgccgtatgggttgccctattctgggcggcgattgtctccatcaatctctttggcgtaaaaggttatggtgaagcagagtttgtgttctcctccatcaaagttatagctgtgattgctttcataatactcggcgttatcttgaactgtgccggaggtcaaaatgggagttacataggtgtcaaatactggcatgatcctggggcattccaccatggcttcaaagggctgtgtgatgtatttgttaatgctgggtttgcatttgcgggaaccgagttggttggccttgctgcagccgaaactgccaaccctcgcaagtctttaccgacggccatcaaacaggttttctggcggattacgctcttttacattgtttccctcacgctagtggggcttttgattccctataccgaaccccgacttatcaacggaacctccactgtcgacaccaaggcatccccatttgtgatcgccatcaaaaatgctgggatcgaagtgctagattccgtgatgaacgttgtcatcatgattgccgttttgtctgtcgggaactcagctgtgtatggctcttctcggactcttgctgcgcttgcagagcagcagcaagcccctcggttcctaggctatattgaccgtaagggccgacctttgtgggccatctgtattgcctcggcgatgggcttgctgggctttttagccgccactgacaagcaagaggtcgcttttgagtggatgatcgcgatatctggcctttcgtctatatttacctggggttccatttgtctagcccacatacgctttcgtcgcgcatggaaggtacagggcaacagcctgcatgacctggcgttccgctcccaacccggaattataggctcgtggataggctttgcttttaactgccttgttctggttgcccaattctgggtcggatttgcgccgatcgactatgaaaccatgtcggcgagtatgcttgcccgcaatttcttttcaaaatacctggcggcaccagttgttcttctcttctatataccatacaaactgcggttcaaaaccaagatcctccgggcgaaagacatggatttgcgaacgggtcggcgggagttgaacatccagtggcttatgaaagaggagcgagcgcaacaagctgcatggcctgcttggaagaaaatctataaattcttttgctga

SEQ ID NO: 8363 - protein, 585 aa, Aspergillus nidulans FGSC A4
MDKDFLKGNPERSTSSDSTPVYGESTSRRASLGQRVLGSFQRDPNAHVTAFASFSDGKTYDIENATEKAANSPLHRSLRGRHLQMIAIGGSIGTGLFVSSGRVLATGGPASLLIAYALIGCMLYCAVHALGEMAVIFPVAGSFAHYSTRFIDPAWGFAMGWNYALQWLAILPLEIVAAAITVDYWESNISSAVWVALFWAAIVSINLFGVKGYGEAEFVFSSIKVIAVIAFIILGVILNCAGGQNGSYIGVKYWHDPGAFHHGFKGLCDVFVNAGFAFAGTELVGLAAAETANPRKSLPTAIKQVFWRITLFYIVSLTLVGLLIPYTEPRLINGTSTVDTKASPFVIAIKNAGIEVLDSVMNVVIMIAVLSVGNSAVYGSSRTLAALAEQQQAPRFLGYIDRKGRPLWAICIASAMGLLGFLAATDKQEVAFEWMIAISGLSSIFTWGSICLAHIRFRRAWKVQGNSLHDLAFRSQPGIIGSWIGFAFNCLVLVAQFWVGFAPIDYETMSASMLARNFFSKYLAAPVVLLFYIPYKLRFKTKILRAKDMDLRTGRRELNIQWLMKEERAQQAAWPAWKKIYKFFC

SEQ ID NO: 8364 - DNA, 1947 bp, Candida albicans SC5314
  CDS (1)..(1947): transl_table=12
atgtcaaatcctgaaaaattacagtctcttcagatgatatctatagataacgcaaacactgggagaagatctactttatcatccaccatttcctcgtttgatgcagataggtcattgtacaattcaacaacatcaagtactgggtctaccagctcttctccatatcccagatcttatcatccacgagacctcctcaacagttttatagattcatttaaagaattcgattactcaactttaccaccagtttataacaatatcaccgaccaggaaagtcaacttcaactcaatcctgctaatccaaatttcgactattctcatttcacacaattagaaagagatgcattgattactgcaagctcaccgttgtccaaacgattgaaaacaagacatttgacatggatatcattaggtgcatcaattggaagcggtctacttatatcttctggtagctcattggcccatgctggacccttgggtttattgattgtatggatttttgttgggtcggttatatttgcaaccatgtctagtttggcagaactagccactgcattcccagtgagtggttcatttacaacatatgttactttattcgttgataaatcaataagttttgccatagcatggaattacgcactacagtggctagtaacatttccgttacaattagttgctgcttctcttgccattgagtattggacaatcaaaattcacccagcaatatttgtcaccatcttttatgtctgtattgtttttatcaatttatttggagtctacggctatgcagaaattgaaatggtagtcagtattataaaagtaattgctgtgattggattcaatattttggcaatcataattgttactggtggcgtccctggacaaccatatattggtgccaaaaattggcagggtccacaagggggactattcaatacaattgaaccattcaaacaaatgtgtcatatagtatccaatgttgcgtttgcctatggtggtgtggaattgttcggattggcagctgtggaaacggcatcgcctaaaaaatcaatcaatcgtgccagaaaacaaattttttatcgactcatggtgttttatattttgtccattgttatgattggatttgctgtatcttataaaacccctgaattacaagatagtggtgcttttggtactgatatcaatgcttcaccttttgttattgccatcaagcaagcgaaaataaaggcattgccgtcaataatgaatggggcagttattcttacagtgctttctgtcggaaatgcctctgtatatgcatctacaagagtcctttgcgctattggggcattacaacagggcccaaagtttttgagctttatcgatagaagtggacgtccaatggggtgtttgatagttcaatttgtcttcggattattagcttacttgatttgtataccaggcaaaaatgttccagcacagatttttgattggctattgagtttgtctggcttaagtgctttattcacttatatatcaatgaatgtttgtcaattgcgattcaattgtgctttgaaacatcgagcaaggatacccaaagacgaattgttgtacgtgtcaccattatggtgctcgtggtatggaatattcgccataatagcaatattggcattacaattctgggccgctttgtttccacctggcgcaggaaaagctgacgtcgaaagctttttcaagatatatcttggtggtcctatattattcttgtgctggttaggtcataaattgtactcttattggtatttgaatgtgcctttaaccaagttctggttgaccgttgacgagatagacattgatactggtagaagacaaatcgatttggaaactataaaacaagaaatcgcagaagaaaaaatcgtcatggaaagcaaaccgtggtggtatagattatataaaactttttgttag

SEQ ID NO: 8365 - protein, 648 aa, Candida albicans SC5314
MSNPEKLQSLQMISIDNANTGRRSTLSSTISSFDADRSLYNSTTSSTGSTSSSPYPRSYHPRDLLNSFIDSFKEFDYSTLPPVYNNITDQESQLQLNPANPNFDYSHFTQLERDALITASSPLSKRLKTRHLTWISLGASIGSGLLISSGSSLAHAGPLGLLIVWIFVGSVIFATMSSLAELATAFPVSGSFTTYVTLFVDKSISFAIAWNYALQWLVTFPLQLVAASLAIEYWTIKIHPAIFVTIFYVCIVFINLFGVYGYAEIEMVVSIIKVIAVIGFNILAIIIVTGGVPGQPYIGAKNWQGPQGGLFNTIEPFKQMCHIVSNVAFAYGGVELFGLAAVETASPKKSINRARKQIFYRLMVFYILSIVMIGFAVSYKTPELQDSGAFGTDINASPFVIAIKQAKIKALPSIMNGAVILTVLSVGNASVYASTRVLCAIGALQQGPKFLSFIDRSGRPMGCLIVQFVFGLLAYLICIPGKNVPAQIFDWLLSLSGLSALFTYISMNVCQLRFNCALKHRARIPKDELLYVSPLWCSWYGIFAIIAILALQFWAALFPPGAGKADVESFFKIYLGGPILFLCWLGHKLYSYWYLNVPLTKFWLTVDEIDIDTGRRQIDLETIKQEIAEEKIVMESKPWWYRLYKTFC

SEQ ID NO: 8366 - DNA, 1731 bp, Candida albicans SC5314
  CDS (1)..(1731): transl_table=12
atgagtaggaagtcttctattgatatgcctaaagaggcatctagccccgagtgctacacaacatcgacatccagtaatgaaataagtgaaaaaccaggcatgtggcgaaacttcaaagattcattcaaacctcctgtgcccatcgatgatattgagaatggatcgatatcttcaactcaattaaaaggtggacagaatgttccattacaacaaagtttgaaaaaaagacaactacagatgattgcattaggtggatgtgtgggatcagggttattagtggcgtccggagctgctttgcgtaacggtccagcaagtttgttaattgcttggttcatcgtttctacatttttgtattgtacgatgcaatgtttagccgaattatcgagtactttccctgtgtcgggatcctttgcagtctattctataaagtttattgatccaagttggggtactgccatgggttataattatgcattattttgggttgttgtcatgccattggagttggttgcaagttcaatgactataaagttctggccatcaaatataaatacatctgtttgggtggcagtcttctatgttttgattattggtacaaatttgtttggaggaacaagagcttttggtgagacagagtttgttgcatctgttataaagttgttaggaattgttggtttcaacattttggcaattgttttgatttgtggtggtggtgaccaaggctatattggaggtaaaaactggcatcctccattcaccactggtgtcaaaggtgtgatatccgttttattgacagcaacgtattctttagctggtacagagttggtggggttgacatctgctgaagccgctggtgatgctcgaaaagttttaccaaaggcaatcaaacaagtattgtggagaattttgattttttacttgttgactttgacattagttgggtttttagttccggcctcagacccacaattaattggtggtggtagcggggcatctgcttctccatttgttattgcaattagagaaggtggaatcaaagggttgccttctgtatttaatgttgtcgtcttggtagctttattggctattgctaactctgcggtttacggattttcaagaaccattttggctttggctgaacaaggtgttgcccctagtatatttaaatacgttgacagacagggaagaccacttgctggtatagccacttctgccattgttgggttgttgtcttttgtttctgcctccaaacagcaagaacaagttttcgactggttagtcgctttgtctggtttgtctaccttcttcacctggggaagtattaatgctgcacatattagattcagaattgcaatgaaagttcaaggaagatcattagatgaattgccatacaaggcaaacacaggtgtattgggagcttactacggtttaatcatgaacgttgctgtattggcattacaattttggctcgcagtgtggccaattggaggtaaaccagatgccacatacttttttaaacaatatttggctgctgtcttggtgcttgccgtttacgtaattcacaaagttgctaccagaaactggaaatttatggtcgattacaaggatatggatcttgactccggaagaagtgatatagatattgatatacttaaacaagagctcgaagaagaaagagaagcttataagagacagccatggtattacaagttttatcaattctggtgttaa

SEQ ID NO: 8367 - protein, 576 aa, Candida albicans SC5314
MSRKSSIDMPKEASSPECYTTSTSSNEISEKPGMWRNFKDSFKPPVPIDDIENGSISSTQLKGGQNVPLQQSLKKRQLQMIALGGCVGSGLLVASGAALRNGPASLLIAWFIVSTFLYCTMQCLAELSSTFPVSGSFAVYSIKFIDPSWGTAMGYNYALFWVVVMPLELVASSMTIKFWPSNINTSVWVAVFYVLIIGTNLFGGTRAFGETEFVASVIKLLGIVGFNILAIVLICGGGDQGYIGGKNWHPPFTTGVKGVISVLLTATYSLAGTELVGLTSAEAAGDARKVLPKAIKQVLWRILIFYLLTLTLVGFLVPASDPQLIGGGSGASASPFVIAIREGGIKGLPSVFNVVVLVALLAIANSAVYGFSRTILALAEQGVAPSIFKYVDRQGRPLAGIATSAIVGLLSFVSASKQQEQVFDWLVALSGLSTFFTWGSINAAHIRFRIAMKVQGRSLDELPYKANTGVLGAYYGLIMNVAVLALQFWLAVWPIGGKPDATYFFKQYLAAVLVLAVYVIHKVATRNWKFMVDYKDMDLDSGRSDIDIDILKQELEEEREAYKRQPWYYKFYQFWC

SEQ ID NO: 8368 - DNA, 1824 bp, Candida albicans SC5314
  CDS (1)..(1824): transl_table=12
atgtcttataaaggaaatgatattgaaaagcagcagtctgcttctactgctactggtttcaacgacaaacagattgcttcaacctcagaggacgctaccgacagaagtcacaatatccatggcgataccagctcattggattctcgatacacctatgaaactgtcgaccaagaaaagaattatttcaaaagagtgtataactctttcaaaccaatgaacttggaagaacaaggtattgatacttcgcaattaactccagttgaaagaaccattattgcctctgccaaacatccattagctagaagattaaaggctagacatttgcaaatgattgctattggtggtagtattggtactgggttattcgttggttccgggtacgctttggctaatgggggtcccggtgcagtattaattggttatgttatcgttgggtatgctttgttgactgtggtcaatgctttgggtgaattatcagtgcaattccccgtcagtggttcattcaatgccttcttctcaagatttcttgaaccatcttttggaggtacatttggtattttatatgctgcctcgtggtgtatttccttgccctcagaattaatcgcagctgctatgactatccagtattggaacacagaagtgaatccagctgtgtgggttgcagttttttgggtagttattgttgttatcaatctttttggtgttaaaggttatggtgaaatggaatatttcctttccattattaaagtattggctgtcgttggatttatcattcttggtatttgtattacatgtggtgttggtgatcaaggttatattggtggcaaatactggcacaacccaggtgcatttaatcatggattaaaaggtgtgacctcagtattcatctcggctgcattctcgtttggtggtattgaattggttgcattggctgctagtgaaactgctaaccctagaatctccttacctgctgctgttaaatctacattttggagaatctttattttctacatcttaactgctatcattattggttgcttggttccttataccaatgatgatttacttaatggtacaggtattgccgcttctccatttgttattgccgtcagtcaaggaggaatcagagttgtccctcatatcatgaatgcagtggtcgttattgctgttatttcagtcggtaactcttccgtctatggatgttcacgtactttagcatcattggctgtccagggattattgccaaaatccatggggtacattgatcgtggtggtcgtccattgattgccatccttttcacatctgccattggtttattaggattccttgtcgtcgttgacaatgaaggagacgttttcacctggttcttctcgatttgttcgttgtcatcgtttttcacttggggtgcaattaacgttgttcatttgcgttggagatttgccttggctgcacaaggtcgttccactgatgaaatcattttcagatctcccttggggacttttgggtcttggactggtattcttgtcttaatccttattgttattggtgaagtttgggtgtcaatttggccaattggaagtcctgctgatgtacagcaattctggaaaaactgtttatccttacctttgatgattgtgatgtgggcaggattcaagacttatcaccgctcatggaatatgctttgggtcaaattagaagatattgatttggataccggtagaagagaaattgacgttgaattattaaaacaagagttggcagaggaaagacaaatcataaagagtaagccatttgtctatcgtatctataaatttttcttctaa

SEQ ID NO: 8369 - protein, 607 aa, Candida albicans SC5314
MSYKGNDIEKQQSASTATGFNDKQIASTSEDATDRSHNIHGDTSSLDSRYTYETVDQEKNYFKRVYNSFKPMNLEEQGIDTSQLTPVERTIIASAKHPLARRLKARHLQMIAIGGSIGTGLFVGSGYALANGGPGAVLIGYVIVGYALLTVVNALGELSVQFPVSGSFNAFFSRFLEPSFGGTFGILYAASWCISLPSELIAAAMTIQYWNTEVNPAVWVAVFWVVIVVINLFGVKGYGEMEYFLSIIKVLAVVGFIILGICITCGVGDQGYIGGKYWHNPGAFNHGLKGVTSVFISAAFSFGGIELVALAASETANPRISLPAAVKSTFWRIFIFYILTAIIIGCLVPYTNDDLLNGTGIAASPFVIAVSQGGIRVVPHIMNAVVVIAVISVGNSSVYGCSRTLASLAVQGLLPKSMGYIDRGGRPLIAILFTSAIGLLGFLVVVDNEGDVFTWFFSICSLSSFFTWGAINVVHLRWRFALAAQGRSTDEIIFRSPLGTFGSWTGILVLILIVIGEVWVSIWPIGSPADVQQFWKNCLSLPLMIVMWAGFKTYHRSWNMLWVKLEDIDLDTGRREIDVELLKQELAEERQIIKSKPFVYRIYKFFF

SEQ ID NO: 8370 - DNA, 1698 bp, Candida albicans SC5314
  CDS (1)..(1698): transl_table=12
atggagaaaagtaataatcaaatagtcacaagtgaaaaagctcaagataatatttcatgttcagctgtaacaacaaactccaaacaacatcttgggtttgttgatagttttattgattcatttagaagagcaccagaatcaaatacttctgctgagaataaacgacaaacaatttctaaaaatgagttaagattaatggccatttccactgggttgggtaccggtttgcttgtggccacgggtggtagacttagagcagctggtcctgctggaatggttatcgcttatgccatcactggtcttgtcatgttggcaccaacagtcaactcagtagctgaattagcaattgcctaccctggattaccaggtgggttccagtcatactatgggaaatttattgatgaaagtcttggattcgctttagggtggaattatggtttccaatggatgtgtattttggcattagagtttgttactgtatctatgacttttaaattttggactacatctgtacacgctgatgtatttgttgcaatttttttcattattgttactttggtcaacttgggcggagctaaagtgtatgcagtcactgaagctgcattgaattcaattaaaattgtgtttttggtagggtttattatttttggaattattattgatgttggtggtggtccaaatggattcattggtgggaaatattatcacagcccaggtgccttcacttcttttaaaggtttggcttcagtgtttgtttccggggctttcagtttaggtggatctgaattcattagtttatctgcaagtgaaaccaaacaccctaaaactgcaattagagctgcttccaaattggtgtatttcagagtaattgttcttttccttggatcattgaccttggttggattattggtgcctcgtgattctgataacttgatgcatggtagtggctccagtgtgtcaccttatgttcttgctgccaaattgaatggagttaaagttataccccacattataaacactgtcattttactttctgttacttcagttgcatgtgctgctatgtacagttcccctagattgatccaatcattagctgaacaagggttaggacctaaatggttagattatattgataagaagggaagacctacaagagcctggtttatcacaatactagctggtgcctttggatttattgctgctttcaaagatcacgaaactgtgtttatgtggttgttgtcgatatctggtatttcgtttgttatgtgttggttgttcatttgcgtttgccatttacgtttccgttctgctttgaagcttaatggaattgatgttaagactttagaatatgtttctcctactggtatctggggttcatatatttccatcattatcaatagtcttattcttgttgcccaattctggatttctttgtggccattgggtggtgatggcaaaccaaatgctctttcgtttttcgaaaactttttaggtggaccagttttccttatttgttacattggtcacaaactctggactaaaaattggaaattatacaaaaaagtagaagatattgatgtaaacaaagatagagttgtcaaggataccgaaatattacatttagaaaacttggaagataaagagagatacgaaaaggcaccattgtggaaaaaaatattgattatttgtttcgattaa

SEQ ID NO: 8371 - protein, 565 aa, Candida albicans SC5314
MEKSNNQIVTSEKAQDNISCSAVTTNSKQHLGFVDSFIDSFRRAPESNTSAENKRQTISKNELRLMAISTGLGTGLLVATGGRLRAAGPAGMVIAYAITGLVMLAPTVNSVAELAIAYPGLPGGFQSYYGKFIDESLGFALGWNYGFQWMCILALEFVTVSMTFKFWTTSVHADVFVAIFFIIVTLVNLGGAKVYAVTEAALNSIKIVFLVGFIIFGIIIDVGGGPNGFIGGKYYHSPGAFTSFKGLASVFVSGAFSLGGSEFISLSASETKHPKTAIRAASKLVYFRVIVLFLGSLTLVGLLVPRDSDNLMHGSGSSVSPYVLAAKLNGVKVIPHIINTVILLSVTSVACAAMYSSPRLIQSLAEQGLGPKWLDYIDKKGRPTRAWFITILAGAFGFIAAFKDHETVFMWLLSISGISFVMCWLFICVCHLRFRSALKLNGIDVKTLEYVSPTGIWGSYISIIINSLILVAQFWISLWPLGGDGKPNALSFFENFLGGPVFLICYIGHKLWTKNWKLYKKVEDIDVNKDRVVKDTEILHLENLEDKERYEKAPLWKKILIICFD

SEQ ID NO: 8372 - DNA, 1716 bp, Candida albicans SC5314
  CDS (1)..(1716): transl_table=12
atgtcttcatcatcaacggcatcagaagttcacaaggccccagtggtcaaaaatattgaaaagcaggacatggacatgtactcagcatcaagttcatcagcaccaaaaacaacatggaataattttattgattctttccatagagcagacggtaagacttctgctgaaagtaaagaccagcgtatatccaagactgaattgcgtattatgtcattatctactgggttaggtactggtttacttgttgcatccggtagtaaacttagagctgctggtcctgccggtgttcttgttgcttattttatcaccggtatttgtatgttggcgccgaccattaattctgtttctgaattggccattgcttatccgggtttgcctggtgggttccaatcttattatgccaagtttattgatgaaagtcttgggtttgccttgggttggaattatgctttccaatggatgtgtgttttggctttggaattggtcacaagctcaatgataatcaaattttggacaaccacagttaatccagatgtgtttgttgccatattctttgtttttgtcactttgatcaatatgggtggggccaaagtgtatgccgttttcgaagcaagttttaactgttgtaaaattctacttttagttgggtttgttatttttgggttaatcatcgacgttggtggtggtccacaaggttttattggtggtagatattatcatgaccctggtgccttcacatctttcaaaggtttagcttcagtgtttgtcactggtgccttcagtttgggtgggtcagagtttattagtttatcggccagtgaaacaagacatccacgtgcttctatccgtgctgcttcaaaattggtttatttcaaagtcattgttcttttccttggttctttgacttttgttgggttattagttgcttataacaatgatcgtttgatgggaagtggtgatgcagcaagtcatgcttcaccatacgttcttgccgctgaaatgaacggtatcagagtcttgcctcatattatcaatgctgttattttgatttcagttgtttcagttgccactgctgccatgtatagttctccaagattggttcaatcgttggctgaacaaggattgggtcctaaatggttagactacattgacaaaaagggaagaccaaccagagcttggtttattaccgttttggctggattgtttggtttcattgctgcttatgaaaaacaagaaactgttttcgtctggttattgtcgatttcaggtatttcattcatcatgtgttggttatttatttgtgtgagtcacattcgtttcagagctgctttgaaatacagaggtatcacattggaccaattggcttacgtttcaccaactggtgtttggggttcatatctttcagttcttattaattctcttattcttattgctcaattctggatctcattgtggccattaggaggtgacggcaaaccaaacgctaattcattttttgaaaattacttgggtgctcctgtgttcttggtttgttacattggtcataagctctggactagaaattggaaattgttcaagaaagttgaagatattgatattgatacccatagaatgatttgcgatccagaacttttggctttggaagatttggaagacaaagaaagatatcaaaaagctccaatttggaaaaagattttgatcaaatgttttgattag

SEQ ID NO: 8373 - protein, 571 aa, Candida albicans SC5314
MSSSSTASEVHKAPVVKNIEKQDMDMYSASSSSAPKTTWNNFIDSFHRADGKTSAESKDQRISKTELRIMSLSTGLGTGLLVASGSKLRAAGPAGVLVAYFITGICMLAPTINSVSELAIAYPGLPGGFQSYYAKFIDESLGFALGWNYAFQWMCVLALELVTSSMIIKFWTTTVNPDVFVAIFFVFVTLINMGGAKVYAVFEASFNCCKILLLVGFVIFGLIIDVGGGPQGFIGGRYYHDPGAFTSFKGLASVFVTGAFSLGGSEFISLSASETRHPRASIRAASKLVYFKVIVLFLGSLTFVGLLVAYNNDRLMGSGDAASHASPYVLAAEMNGIRVLPHIINAVILISVVSVATAAMYSSPRLVQSLAEQGLGPKWLDYIDKKGRPTRAWFITVLAGLFGFIAAYEKQETVFVWLLSISGISFIMCWLFICVSHIRFRAALKYRGITLDQLAYVSPTGVWGSYLSVLINSLILIAQFWISLWPLGGDGKPNANSFFENYLGAPVFLVCYIGHKLWTRNWKLFKKVEDIDIDTHRMICDPELLALEDLEDKERYQKAPIWKKILIKCFD

SEQ ID NO: 8374 - DNA, 1749 bp, Candida albicans SC5314
  CDS (1)..(1749): transl_table=12
atgctacataaaaaagaaactaacgatacatttgttcaattaaatagaagtccatctacgggagaacaaaaatcttccggcatttggtcatcaattaaagattcattcaaaccagccttaccacaagataaactcacgggtgtagatgatatccctgatagagaacttaccgatattgaaagaatcaacatcaatgctgccaattccaatttacaaagaaaattgaaaacaagacatttacaaatgatcgctattggatcatctataggaaccggtcttttcgttggtactggtggtgcattaagtactggtggaccagctgccattgttctagcatgggccataagtgctatatcggtatttatgacaatgcaaggattaggtgaattggccgttgcattcccagtttctggtggattcaatttatacgcaagtaaatttttagaaccaggtattggatttgctgttggttggaattatttcttacaattctttgtattattgccattagaattagttgctggtgctataactatcaaatattggaatgctagtataaattctgatgtgtttgttattatattttggtttgtggtgcttgtgatcaccatgttgggtgtaagatggtatggtgaagctgaacttgtattttgtaccatcaaagtcattgctgttattggatttatcattttagggattgtgttaatttgtggtggtggaccaaatcatgaatttattggaggtaaatattggagagaaccgggtccttttgctaattcttttaaaggttttgctagttcacttatcaccgctgcattctcttttggtggtacagaaatgattgccttaacagcaagtgaaagttcaaatgttagacatgcattacccaaagccattaaacaagtgttttggagaattgttatattttatttgggatcaattattatgattgcaactttagttccttataatgataaaagattacttggaagttcatctgttgatgtcactgcatctccattcactattgccattgttaacggtggaatcaaaggtttacctagtgtcatcaatgccgtgattttgatatcggtattatcagttggtaatgcttcagtatatgcaacttcaagaactttaaactcacttgctgaacaaggaatggcacctaaatggacaggatatattgatagagccggaagaccattatttgctattcttatcaccaatgtatttggattatttgccttaattgctgctgataatgagaaacaggtggttgctttcaattggttattggctctttctggtctttcatcaattttcacctggatgagtattaacttgagccatatacgttttagaagagccatgaaagttcaaaatcgttcattaacggaattaccatttgttgctcaaagtggggtttggggatcatattttgggttaactttaaacattttgtatttaattgctcaattttatattggattattccctgttggtggtaaaccaaatgcttatgatttctttttggcatatttgggtgttccagtgattttagcatcatggataggttataaaatttggaaaagagattggacattatttatcagagcaaaagatattgaccttgatactggtagaatcaatgttgatttagatttgttacaacaagaaatagctgaagaaaaagctcaattagctgaaaaaccattctatattagaatttatagattttggtgctaa

SEQ ID NO: 8375 - protein, 582 aa, Candida albicans SC5314
MLHKKETNDTFVQLNRSPSTGEQKSSGIWSSIKDSFKPALPQDKLTGVDDIPDRELTDIERININAANSNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVLICGGGPNHEFIGGKYWREPGPFANSFKGFASSLITAAFSFGGTEMIALTASESSNVRHALPKAIKQVFWRIVIFYLGSIIMIATLVPYNDKRLLGSSSVDVTASPFTIAIVNGGIKGLPSVINAVILISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 8376 - DNA, 1701 bp, Ustilago maydis 521
  CDS (1)..(1701)
atgggtgcgtggacaaattttgttgacggcttcaagccagaggtcaccgacgagagcgcgtcggactcggttccagcttacgccgagaaggactccaaggacttcgagactaacgccgttgctggcttcaaggaccccaaagacgagactggtcttaagcgtaggctcactggtcgtcatgtccagttcattgccctgggtggttcgattggtaccggtctcttcatcggctctggaggcgctcttgccaccggtggccctggtttccttatgatcgactttattctcatcggtatcatgcttctcatggtcgttatggccctcggtgagcttggtgctattttccccgtcgccggatccttcgctgcctactctacacgtttcatcgatcccgccgtcggtttcgccatggcctacaactactggctccagtggctcattgtgcttcccctcgaacttgtcgccgcatccatcgtcattgtcttttgggatcccaatgagactgttcccaaaggtgtttggatcgctgtcttccttatcatcatcaccatcatcaacttgtttggcgtccgaggctacggtgaattcgaattctttggctcgctcgtcaaggttcttgccgtcatcggcttcatcattgctggtgtggtcatcaacgtcggcggcggtcccgacggcaagtactacggtaccgagacgtggcgcaaccctggtgcatttaacaacggtttcaaaggcttctcctctgtgtttgtcacggctgcctttgctttcgctggaaccgagctcatcggactcgctgccgccgagaccgccaacgcgcgcaaggagatccccaaggctgccaagcagatcttcatgcgtgtcaccatcttctacgtcgtatcgctcctcgtcgtctctttcctcgtcccttacaccaacccggctctgcttggtggctcctacgatgccagggcttccccattcgttatcgccgtcgcgaatgcgcgtatctcggtgttgccaagtattcttaatgccgtaatcctgatttcagtactttcggttggtaactcggcagtatatgctgcttcgcgaacgctgcaagccatgtcaaccatcggccaggctccccgatacttcagctacattgaccgacagggacgtcctctgcccgctgttattctctcgctcattttcggcctgctgggcttcctcatctacgctggtgatgacgcgcgtggtctcgtgttcagctggcttctcgccatctcgggtctctcaaccatcatcagctggctctgtatttgcatttcccatgcccgcttccgccaggcatggactcgtgctggccacactttggaggagctcccctggaagtcgcctttcggcatctggggttccctctacggtgctttcttcaacgttcttgtcattatcgtcacgttctacgtttcggccttccccatcggagagggcgagatgtcggccacggaacgcgccaatgccttcttccagagcttcctctcggtgcccgttgtcgtctttgtcttctacctgccttacaagtttttcatgcgaagcaagtatgtcgacattgacgacattgacattagcactggtcgccgcgaccctgtgcccgtcgaggtgctccgccgcgagcgcgaggaggcagctgcgttgcccatgtacaagaaggtttggcacttcttgttctaa

SEQ ID NO: 8377 - protein, 566 aa, Ustilago maydis 521
MGAWTNFVDGFKPEVTDESASDSVPAYAEKDSKDFETNAVAGFKDPKDETGLKRRLTGRHVQFIALGGSIGTGLFIGSGGALATGGPGFLMIDFILIGIMLLMVVMALGELGAIFPVAGSFAAYSTRFIDPAVGFAMAYNYWLQWLIVLPLELVAASIVIVFWDPNETVPKGVWIAVFLIIITIINLFGVRGYGEFEFFGSLVKVLAVIGFIIAGVVINVGGGPDGKYYGTETWRNPGAFNNGFKGFSSVFVTAAFAFAGTELIGLAAAETANARKEIPKAAKQIFMRVTIFYVVSLLVVSFLVPYTNPALLGGSYDARASPFVIAVANARISVLPSILNAVILISVLSVGNSAVYAASRTLQAMSTIGQAPRYFSYIDRQGRPLPAVILSLIFGLLGFLIYAGDDARGLVFSWLLAISGLSTIISWLCICISHARFRQAWTRAGHTLEELPWKSPFGIWGSLYGAFFNVLVIIVTFYVSAFPIGEGEMSATERANAFFQSFLSVPVVVFVFYLPYKFFMRSKYVDIDDIDISTGRRDPVPVEVLRREREEAAALPMYKKVWHFLF

SEQ ID NO: 8378 - DNA, 1536 bp, Burkholderia vietnamiensis G4
  CDS (1)..(1536): transl_table=11
atgtctgcaatcccgaattccgacccacccggttcgcccgcgaaccctcccacgcttcatcgcgcgctcaaggcgcgccatctgacgatgatcgccatcggcggctcgatcggcacgggcctgttcgtcgcgtccggcgcgtcgatctcgcaggccggccccggcggcgcgatggtcgcgtacatgctgatcggcctgatggtctacttcctgatgacgagcctcggcgaaatggccgcgttcatgccggtgtcgggctcgttcgcgacctacggcgcgaaatacgtcgatgaaggtttcggcttcgcgctcggctggaactactggtacaactgggcggtgacgatcgcggtcgaactcgtcgccgcgcagctcgtgatgcactactggttcccggacgtgccgggcgtgtggtggagcgccgcgttcctcgcggtgatgttcctgctcaacgcgctgacggtgcgcggctttggcgaggccgaatactggttcgcgctgatcaaggtcgtcacggtgctcgcgttcatcggcgtcggcctgctgatgatcttcggcattctgaagggcgcgccggccaacggctggggcaacctgacgatcggcgatgcgccgttcgccggcggcttgccggcgctgatgggcgtcgcgatgatcgcgggcttctcgttccagggcaccgagctgatcggcgtcgcggccggcgaatcggagcatccgcgcacgacgatcccgcgtgcggtccgccaggtgttctggcgcatcctgctgttctacgtgctggcgatcttcgtgatcggcgtgctgattccgtacaccgacccgaacctgctgaagagcgacgtgaccgacatcggcgtgagtccgtttacgctcgtgttccgtcatgcgggcctcgcgttcgcggccggcgtgatgaacgcggtgatcctgacggccgtgctgtcggccggcaactcggggatgtatgcgtcgacgcgcatgctctacaacctcgcgaccgaaggccgcgcgccgaagctgttcgcgaagctgtcgccgggcggcgtgccgcgcaacgcgctgtacgcgacgaccgccgtcggcgcgctgtgcttcttcacgtcgctgtacggcgacaagaccgtctacctgtggctgctgaacacgtcgggcatgacgggcttcatcgcgtggctcgggatcgcgatcagccattaccggttccgcaagggttacgtgacgcagggctacagcatcgatcagctgccgtaccagtcgaagtggttcccgttcggcccgctgttcgcgttcgtgctgtgcatggtgatcgcgctcgggcaggactatcaggcgtttctcgcgaaccgcatcgactgggcgggcgtggccgccacctatgtcggcatcccgctgttcgtcgtcgtctggctcggctaccggctcatgaaccggagccgcttcgtgcgctacgaggacatggaaatcgcgccgtggatcgccgcgaaccgcggcggcgctgcgccgcgcgtcgagaaccgcgagacggccggctga

SEQ ID NO: 8379 - protein, 511 aa, Burkholderia vietnamiensis G4
MSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 8380 - DNA, 1461 bp, Listeria monocytogenes str. 4b F2365
  CDS (1)..(1461): transl_table=11
atgaagaaagaaacacatggcgagattcgtcgtgacttaaaaacaaggcatttgtccatgattgccattggtggttcaatcgggacgggattatttttagcaagtggtaatgcgattcatacagcaggacctggtggcgctttagttgcttatatagcaatcgggattatggtgtactttttaatgacaagtttaggcgaaatggctacttacatgcctgtatctggttcatttagtacctatgctagtcgatttgttgacccagctttcggttttgcgcttggttggaattattggtttaactgggccattacacttgcggttgatatttccactgctgcaattatcgttcaattttggctgccgaatactcctgcttggctatggagcgcgattttcttaattttgattttcggcttaaacgcgctttcggtaaaagcatacggagaatcagagtattggttttcaattattaaagtggccacggttattattttccttatcgtcggcgtgcttactattgtcggaattcttggcggcgaagttattggcttttctaactttactgctggcgatgctccgtttaaaggtggattttttgccatcttaggtaccttcttaattgctggattttctttccaagggactgaaatggttggtattgcagctggtgaaagtgctactccagaaaccagcgtgccaaaagcgattaaacaagtattctggcggattttgctattttatatttttgcgattttcattattgggatgattattccttatactaacccgaatttacttagtgccgaggcaacagatgtggcaattagcccatttacactcgtatttgaaaaagctggtcttgcatttgcggcttccgtgatgaatgcggttatcctgacttctgttttatctgctggtaattcaggtctttatgcttccacaagaatgctttgggcaatggctcgtgataaaaaagcacctaaattcttgggtaaagtaaaccgtcgtggtattccgatggcagctttaattgttacgacgattgttggtgcaatgacattcattacaacgctaacagaaaacggcacagtgatttatacgtggttactttccgcctctggtttaaccggatttattgcttgggtcggcatcgctatcagtcattaccgtttccgaaaagcatttatcaaacaaggacatgacttaagtgaactaaaatataaagcaaaatttttcccattcggacctattttagcactaattttatgtattttagttattgtcggtcaagattacgcggcatttttgaaaccagaatttacgaatcctgcttggtggcaaaaaatcggtatttcttatatcggcctccctattttccttgttttctggctatcttttaaatttacaaataaaacaaaagttattccactggaagactgcaaatttgatcaaaaataa

SEQ ID NO: 8381 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 8382 - DNA, 1425 bp, Bacillus anthracis str. 'Ames Ancestor'
  CDS (1)..(1425): transl_table=11
atgtcgcaagtaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccacttgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 8383 - protein, 474 aa, Bacillus anthracis str. 'Ames Ancestor'
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 8384 - DNA, 1467 bp, Bacillus anthracis str. 'Ames Ancestor'
  CDS (1)..(1467): transl_table=11
atgaatagcgcaacgaatcaaactacctctcaaacagaaactacaaaaggaaaaggtgaattaagacgcggtctaaaatcaaagcaccttacgatgatttctctcggcggtacaattggtaccggactatttcttgccagcggtggtgtcattcattcagctggacctggcggcgcattaattgcatacgccgcaattggaattatggtttactttttaatgacaagcttagccgaactcgcagcttacatgcctgttactggatcttttagcacgtacgcaacaaaatttgttgatccatcacttggctttgcacttggatggaactattggtataactgggcaattactatcgctgctgaactagcggctgtaacattaattatgaaattttggtttccagatactccttccctcatttggagcggattatgtttagctattattttccttttaaactacttatctgttaaaggatttggtgaatctgaatattggttcgcacttattaaagtagctacgattattatctttttaattgtcgggtttatgatgattttcggaattatgggcggcgaaactgttggatttaaaaacttcactgttgcagatgcaccatttaacggcggcatcatggcaattatcggtgtatttatggcagctggtttctcattccaaggtactgaattattaggtgtagctgctggtgaaacatctgatccagagcgtaatattccaaaagcaattcgttcgatcttttggcgtatccttttattctatatccttgcgattctcgttatcggtttattaattccttatacaactgaaagtcttgccgcaagtgatgtaacagtaagtccatttacacttatttttgaaaaagcgggcgttgccttcgctgcttctgttatgaacgctgttattttaacggcagtactatctgctggtaactctggtatgtatgcatcaactcgtatgctttgggacttagctcgccaagggaaagcaccaaagtttcttggtaaattagatagccgcggcgtacctgttaacgcattaatcgtaacatcgattgtcggtagtatcgctttcattgcttctttattcggtgacggtgttgtatacatttggttactaaatgcatcaggaatgtctggctttatcgcatgggttggaatcgcaattagtcattaccgtttccgcaaagcatatatcgcacaaggaaaagatttaaatgacttaccttatagagcaaaatggttcccattcggaccaatcttcgcttttgcgctttgcgtcatcgtaattttaggtcaaaactacggcgcatttatgggcgaatcaatcgattggaacggcgtactcgtttcttacatcggtttaccactcttcttagtactttggttaggatacaaatttacgaaaaaaacaaaagtcattccacttgataaatgtgaactaaaataa

SEQ ID NO: 8385 - protein, 488 aa, Bacillus anthracis str. 'Ames Ancestor'
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 8386 - DNA, 1437 bp, Bacillus anthracis str. Sterne
  CDS (1)..(1437): transl_table=11
atgaggaaaacaatgtcgcaagtaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccacttgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 8387 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 8388 - DNA, 1455 bp, Staphylococcus aureus subsp. aureus MRSA252
  CDS (1)..(1455): transl_table=11
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatggcatcaattggagagttggcaacattttatccagtatcaggttcattcagctcttattcaacacgctttattgactcatctctaggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattaattaaagtgttaacaatcatcgtattcgttatttttggctttttaatgattttcggtatcttaggtggtcatgcatatggatttgaaaactatacaaaaggccaagcaccgtttgttggtggtatctctggtttcctaggcgtattattagtcgctggattctcagttggtggtactgaagtagtagcagtaactgctggcgaatcagatgatcctaaaaagtctatgcctaaagcaattaaacaagtgttttggcgtattcttttattctatgtattatcaattgcagtcattggtgcaattattccgtacacagatccatcattattaagagcaagtagttcaataagtcaaagcccatttacaattgtattcgatagagtaggcatagcctttgcagcatcagtaatcaatgcggttattttaacttcactattatccgctgcaaattcaggtgtttatacaacaggcagaatgttgtattccttaagttcagacaaaaaagcacctaaatttttaagtaaattaaacaagacaacaaaattaccattaagagcattattaactacatatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagatcctaataaggtcctaccatataaagcacctttttatccattaggaccaatcattgtcatcgctacgctattattcttgctatttggtggttcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaaataa

SEQ ID NO: 8389 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 8390 - DNA, 1464 bp, Acinetobacter sp. ADP1
  CDS (1)..(1464): transl_table=11
atgagcgaaaccactcaacctgatcagctccagcgcaagctcggtgctcgtcatcttaatatgattgccattggcggctccattggcacaggtttattccttgcatctggctcaaccatcgcaaatgcgggaccaggcggcgccctgctggcatacgtactcatcggcatcatgatttattttctcatgaccagtctcggtgaactagcgactcataatcccacttcaggggcattttttacgtatggcaatcgttatgtagaagagggattcgggttcgcattaggatggaactactggtataactgggccattactgtggcatttgagctagtggcagtccagtttattatgaaattctggtttccagatattccaggtttttactggagtgctattttcttggtggtgatttttgccatcaatgccatgaccgttaaaggttttggtgaaagtgaattctggttttcaatggtcaaggtcgttgccatcattgcctttattattattggtatggccatgattattaaaatcatgatgaccccaaatatggcaacctttggtaactggacctataaagatgcaccgtttgtaggggggttacaagctatgattggtgtggccatgattgcaggattctcatttcagggaacggaaatggtcggtgttgcggcaggtgagtctaaagatccaaaacgtacaattccgcttgcgattaaacagattttctggcgaattctgctattttatgtggtgtgtattttcatcattgggaccttggtcagctacgatgacccgcgtctacttcaagctgcacatagctcagatattgccttgtcaccttttaccctgctgtatgaaaaagcgggctttgcctttgctgcaagcctgatgaatgcggtgattttaacggcgattttatcggctggaaactcaggcatgtactcttctacccgtatgctttgggatatggcaaaagaaggacgtgcacctaaatggtttgcaaagcttgaccgtcgtggcgtgcccatgaacgccctatatgcaacaactgcaattgcagcactctgctttttaactacatttattggtgaacaggaagtctttaactggctactgaatatgtctgggatgtgtggttttattgtttggctagggattgcgatttcacattatcgcttccgcaaaggttatatcgcccaaggttataaacttgaagatctcgcctatcgagccaaattttttccttttgcaccctggtttgcctttattttatgttcgattattattctgggacaaaattatcaggcgatattaggcggtaaaatagactggactggattgttatccacctatatcagtattccactctttttaatcatttggcttggttataaatggaaatataaaaccaagctcattccttatcaagaaatgaatgtgaaagcaggtaaagaagattga

SEQ ID NO: 8391 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 8392 - DNA, 1476 bp, Erwinia carotovora subsp. atroseptica SCRI1043
  CDS (1)..(1476): transl_table=11
atggctcagcacgatattcaacaaactacacagggcgcaccgaccctgcgccgtgaactgaaagcgcggcatttaacgatgatcgccattggcggatcgattggtactggattatttgtcgcttctggtgcgacggtttcacaagcgggtcctggtggtgcactcctgtcttatgccctgattgggctgatggtttacttcctgatgacgagcctaggcgaactggcggcattcatgccagtttctggttcattttctacctacggatctcgctatgttgaggaaggtttcggcttcgcattgggctggaactattggtacaactgggcggtgaccattgcggtcgatctggtcgctgcgcaactggtgatgggatattggttccctgaagtctccggttggatctggagcgctttgtttctggcgctgatgttcctgcttaattacatttctgtgaaagggtttggcgaagccgagtattggttctcactgattaaagtgacgacggtcattattttcattgctgtgggtgtgatgatgattacgggcatcatgagcggtgcggaaaatgctggattccacaactgggagattggcgatgcaccgtttgctggtggcttctccgccatgatcggcgtggcgatgatcgtgggtttttctttccagggaacggaattgatcggtgtggctgctggggagtcccaggaaccgagcaaaaacattccgcgtgccatccgtcaggttttctggcgtatcctgctgttttacatcttcgcgattctgattattagcttaatcattccgtataccgatccgaacctgctgcgtaatgatgtgaaagacattacggtgagtccgttcacgctggtgtttgagaatgcgggtctgttgtctgccgctgcggtcatgaatgcggtcatcttgacggcggtgttgtcggcgggtaactccgggatgtacgcctctacacgtatgctgtttacgctggcatcggaaggtaaagcgccgcgtattttcgctaagctgtcaaaaggtggtgtgccacgtaatgcgctgtatgcaacaaccgtggtggctgcgctgtgtttcctgtcttctctgtatggtaaccaaacggtttatctgtggttgttgaatacctcgggtatgaccggctttattgcctggctagggatcgcgatcagccattaccgtttccgtcgcggctatgttatgcaaggccacgatctgaaccgtctgccttatcagtcgcgtttcttcccgttagggccaatcttcgcgtttgtgctctgcctgatcatcacactggggcagaattatcaggcgtttctgcaagacaacatcgactggtatgccgtcacggcaacgtacatcggcattcctttgttcctgctgatttggttcggctataagctgtatcgtggaacgggcttcatcaagtatcaggatatgacgttcccggatcataaagactaa

SEQ ID NO: 8393 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 8394 - DNA, 1425 bp, Propionibacterium acnes KPA171202
  CDS (1)..(1425): transl_table=11
atggacggcgaattgaagcgcgggctctcctcgcggcacatgaacatgatcgcaatcggcggggccattggtactggcctgttcgtggcatctggtgccaccatctcccaagctgggccgggtggagctctggttgcctacttcgctatggggcttatggtcttcttgcttatgcagtctctcggcgagatgagctcctatctcccggtgccaggcgcattcgaaacctatgccaccagattcgtctcgccttcctttggcttcgcattggggtggaattactggttcaactgggccatcacggtcgctgctgaattagctgctgcctccatcgttatggcctactggtggcccggtgtaccggcctggatgtggtcggtcggattcctggcgttgctcttcctcctgaacgtcttgtctgcccgcgcgtatggtgagagcgagttctggttcgccatcatcaaggtgacggcagttatcgtcttcctggtgcttgggatcctcatgatcgccggcgtgatggggacatctcctggtctatctcattggcgtcgcggtgacgcgcccttcgttcacgggttcggtggcatcctgactgtctttcttattgctggattctccttccagggcaccgagctcatcggcattgctgcaggagaatcgaaagacccccgaatgacgatccccaaggccactcgtcagattttctggcggatcatgatcttctacatcggtgccatcgccgttatcggtttgttgctgccttatactgacccgcacctgcttgcgggcgaggtcaccgatgttgctgtcagcccgtttacgttggtcctaaagcgggccggtgttgctgctgcggcggctgtcatgaatgcggtcatccttacctcggtgctttcggctggtaactctggtctttatgcgtccacccgaatgctttacgccctagcgcgtgagggcaaagctcctcgcatccttggccgtactagtcgacgaggtgtcccggtgccggctcttatcgtcactactcttgtcggcgcggcctgttttgctacatctctggtggggtcaggccaggcatacacctggttggtcaatatctctggtctgtgtggattcatcgcatggatcggtattgcgatatgccatatccagttccggcgcgcctttcaggctcaggggcacgacctgtccgagttgccgtatcgggcgcgctggtatcctgccggtcctatcgtcgccggggtgttgtgcgtcatcgttactctcggccagggacgtgacgcagttctcagcggtgatgtcaccgacatgatcgtcgcttacatcagcattccggtattcctggcgttgtgggtcggtcacaagattgtcaccaaggcgcctcatgccgacctttcaacggccgatcttcatcacgactga

SEQ ID NO: 8395 - protein, 474 aa, Propionibacterium acnes KPA171202
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 8396 - DNA, 1425 bp, Bacillus cereus E33L
  CDS (1)..(1425): transl_table=11
atggcgcaagtaaataatacaaacaatgaattaaaacgtacgatgaaaagtagacacttattcatgattgcacttggtggtgtgattggaacggggttatttaacggatctggttttattataagtcaggctggacctggtggatccgtacttgcctttatggccggtggattattaatgtatttcgttatgctatgtcttggtgaactcgctgtagccatgcccgtttcggggtctttccaggaatatgccactaagtttatcaatcctgcaactggctttacaatcggatggttgtattggttaagctgggcgaatacgaccggccttgaatttacaactgccggcattacaatgcagcgctggtttcctgatattcctgtttgggtttggtgtttaatatttggcgttacaatcttcacaattaacgcactatctgctcgtagttatgcagaaacagaattttggttttcaagtataaaagtatctgccattatcgcttttattattcttggcggcgccgctatgttcggtttaattgatttaaaaggcgacgaaccagctccgctattttcaaatttcgtaaatcatggtggtttattcccaaatggacttgcagctattctattaacaatggttacagtcaattattccttccaaggtacagaacttgtcggaatcgcagcaggtgaaagtgaagatccagcaaaaactttacctcgttctattagaaatattatatggcgcacgatgtttttcttcgtcttagcaatctttgttcttgttgctttaattccttgggaagaagcaggattaacaaaaagcccgttcgttgctgtttttgataatatcggtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctctaaacgctttaattatgacaattgctatttctgctttttctcttttaacaagcgttgtagcagctgaaactgtttacttatggttaatttctatttcgggcgtcataacaatcattgtttggatgtcaatttgtgtttctcaattctttttccgtaaacattatgtagcagacggtggaaagttagaagacttaaaatttaaaacgccactttatccacttgtacccatgcttggttttggattgtatggcattattttaatcagtcttatttttatcccagaacaacgacttggaatctattgcactgtaccatttattatcttttgctacacttactatcactttaaagtgaagaaaagaatttctactaacacttctagtgaaaataaaattagcgagactatataa

SEQ ID NO: 8397 - protein, 474 aa, Bacillus cereus E33L
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 8398 - DNA, 1449 bp, Staphylococcus epidermidis RP62A
  CDS (1)..(1449): transl_table=11
atggaagataataatatgaaacgtggtctcaattcgagacatatatctatgatagctataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttaactctgttgtttttaattaatattttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcgtttggtagtatcgcatctggtgatattttaggtgtcattcgaaactttacaccattatttattctagctatcatctatattgctcataaattaatcaaacggacacattttgtcaaactggaagaaatagatttaactccgcataattacaagaattaa

SEQ ID NO: 8399 - protein, 482 aa, Staphylococcus epidermidis RP62A
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 8400 - DNA, 1521 bp, Ralstonia eutropha JMP134
  CDS (1)..(1521): transl_table=11
atgtcttcccactcccatcctcatcctcaccagcatccggtcgtcgagcacgacgaccttcagcgcaagctcaaggcgcgccatctcaccatgatcgcaatcggcggcgcggttggcacggggttgttcgtcgcatccggcgcctccatcgcacaggctggtcccggcggcgcgcttctgatgtacgccctgcttggcttcatggtgtattgcctgatgaccagccttggcgaactggccgtccacatgcccgtggctggctcgttcgtcacctacagcgcgctctatgtcgaggaaggtttcggctttgcgctcggctggaattactggttcagcctggccgtgaccatcgcggtggaactcaccgccgcgcaactggtgatgcagttctggttccccggcatgcccggcatggtctggagcgcgggcttcctgctgctgatgttcgcgctcaacgcgttctcggtgcgcggcttcggcgaagccgagtactggttcgcgctgatcaaggtgatcacggtgatcgtgttcctgggcgtggggctgctgatgatcttcggcatcatgaagggcggcccgcaatccggctggcacaacttcacgaccggcgacgcgccgttcgtcggcggcatccctgccatgatcggcgtggcgatgatcgccgggttttcgttccaaggcaccgagaccgtgggcgtagctgccggcgaagcgcaggatccggccagaacgatcccgcgcgcgatccgccagaccttctggcgcatcctgctgttctacgtgatcgcgatcctgatcatcggcgtgctgattccctataccgatccgaacctgctgcgcaatgatgtgaccgacgtcggcgtgagcccgttcgccctggtgttccgccaggccgggctggcctttgccgccggcctgatgaacgccgtagtgctgaccgcgctgctgtcggcgggcacgtcgagcatgtacgtctccacgcgtattctctacggcctggctgtgagcggacgcgccccgcgctggctgggcaagctgaccgtgaacggcgtaccgttcaatgcgctgctggtcaccaccgccgtcggcgcgctgtgcttcttcagttcgctgttcggcgacaaggccgtgtacctgtggctgctgaacacatcggccatgacgggcttcttcgcatggttcggtatcgccctgagccactaccgcttccggcgcggactggtctatcaaggctatgacatcaacgcgctggcgtaccgctcgccgctctatccgttcggcccaatctttgcgggcgtgctgtgcctggtgatcgtggcgggacagaactaccaggcattcgcggacattccgaaccgctggccggaaatcattgcgacgtacatcggggtgccggtgttcctggcgctgtggctggggtaccgcatcgtcaggaagacgcggctgatcgactatgaggatatgccgttcgagttgccgaagacggcaaaagtcattgccgggcaagcggcacaagtgtga

SEQ ID NO: 8401 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 8402 - DNA, 1581 bp, Burkholderia sp. 383
  CDS (1)..(1581): transl_table=11
atgcattcagatgcccgccccgattcaccccgtccgtccggctcgccgcccgcgaagccgacccttcaccgtgcactgcaggcacgccatctgcgaatgatcgcgatcggcggttcgatcggcacgggcctgttcgtcgcgtccggcgcgtcgatctcgcaggccggccccggcggcgcgatgctcgcgtacatggtgatcggcctgatggtctatttcctgatgacgagcctgggcgaaatggccgcgttcatgccggtgtcgggttcattcgcgacctacggcgcgaagttcgtcgacgaaggcttcggcttcgcgctcggctggaactactggtacagctgggccgtgacattggctgtggagctcgtcgccgggcagctcgtgatgaactactggttcccgcatgtgcccggcgtctggtggagcgcgctgttcctcacgctgatcttcgcgctcaacgcgctgtcggtacgcggttttggcgaagccgaatactggttcgcgctgatcaaggtgctgacggtgctcgcgttcgtcggcgtcggcctgctgatgatcttcgggatcatgcagggcggcccgagcgcgggctggggcaacttcacgatcggcgacgcgccgttcgccggcggctgggcgacgatgctcggcgtcgcgatgatcgcgggattctcgttccaaggcaccgaaatgatcggtgtcgcggccggcgaatcggaaaacccgcgcacgacgatcccgcgcgcggtgagccagatcttctggcgcatcctgctgttctacgtgttcgcgatcttcgtgatcggcgtgctgattccctataccgatccgagcctgctgaagagcgacgtgaccgacatcggcgtgagcccgttcacgctcgtgttccgccacgcgggcctcgcattcgcggccggcgtgatgaacgcggtgatcctgacggccgtgctgtcggccggcaactcgggcatgtacgcgtccacgcggatgctctacaacctcgcggtcgaaggccgtgcgccgaagatcttcgcgaagctgtcgcgcggcggcgtgccgcgcaatgcgctgtatgcgacgacggccgtcggcgcgctgtgtttcctcacgtcgctgtacggcgacaagaccgtgtacctgtggctgctgaacacgtcgggaatggccggcttcatcacgtggctcggcatcgcggtcagccactaccgcttccgcaagggcttcctgaagcagggctaccggctcgaccagctgccgtaccggtcgaagtggttcccgttcggcccgctgttcgcgttcgcgctgtgcgcggtcgtcgcgctcggccaggattaccaggcgttcttctccgacaagatcgactgggtcgccgtcgccgcgacctacatcggcctgccgttcttcctcgcgatctggctcggctacgcgctcgtgcgcaaatgccgcctcgtgcgctacgaagacatggagatcgcgccgtggatcgaacgcaacgcgacgcccgaacccgccccgcaggctgaaaccggctacgcaggctacgtcgcccgcccggccaacccgacgccgggcgcctga

SEQ ID NO: 8403 - protein, 526 aa, Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 8404 - DNA, 1533 bp, Burkholderia sp. 383
  CDS (1)..(1533): transl_table=11
atggatgcattgcaagcggcagcggagacggccgcaccgtccggaacggcgctgaagcgccgtctgcagggccgccacatcgcgatgattgcgatcggcggctcgatcggtacggggctgttcgtcgcgtcgggggcgtcggtcgcgcaggcggggccgggcggagcgatcgccgcgtatatcgcgatcgggctgatggtgtacttcgtcgtcacgggcctcggcgagatggccgcgctgatgccggtatcgggctcgtttgcgatctacggcgagaagtacgtcgacgaaggcttcggcgtcgcgcttggctggacctactggtacagctgggccgtgacgatcgcgatcgagctggtcgccgcgcagatcgtgatgcgctactggtttccgaccatacccggcatctggtggggcgcgggcttcctcgtgctgatcttcctgctgaacacgctgtcggtacgcggtttcggcgaatcggaatactggttctcgctgatcaaggtcgtcaccgtggtcgcgttcatcgcagccgggctgctgatcgcggccggcctgatcgggaacgggcatccggtcggcatgcgcaacttcacgacgggtgacgcgccgttcgtcggcggtgtgcacgcgatgatgagcgtcgcgctgatcgcgggcttctcgtttctcggcaccgagctggtcgggatcaccgccggtgaatcggaaaacccgcgcaagacgatcccgcgcgcggtgaagcagatcttctggcggatcatgctgttctacgtgttcgcgatcttcgtgatcggcctgctggtgccgtacaccgacccgaacctgctgaagagcgacgtgaccgacatcggcgtgagcccgttcacgctggtgttcagccatgcgggtttccggctcgcggctggcgcaatgaatctcgtgatcctgacggccgtgctgtcggccggcaattccggcacctacgcggccacgcggatgctgtacaacctcgcggcggaagggcgcgcgccggcgatgttcgcgacgctgtcgccgggcggcgtgccgcgcaatgcgctgtacgcgacgatggccgtcggcgggctgtgcttcctcacgtcgctgaccaacaaccagagcatctatctgtggctgctgaatacggtcggtatcacgggcttcatcgcgtggctcggcatcgcggtctgccattaccggttccgcaaggggttcctgaagcagggctacaggctcgatcagctgccgtaccgtgcgaaatggtttccgttcgggccgctgttcgcgatcgcgatctgcatcgtgatctcgctcgggcaggattaccaggcgttcttcgcggcccgcatcgactggatggaagtgctgtcgatctacgtgtggattccgctgttcgtcgcgatctggtgggcgtatcgccgtgcgcgcaagagccggctcgtgcgctacgaggagatggacatcgggccgtggctgacgcgttcggtcgaggccgtcgatgcgacggtcacgcagcacgggcagccgcactga

SEQ ID NO: 8405 - protein, 510 aa, Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 8406 - DNA, 1536 bp, Burkholderia sp. 383
  CDS (1)..(1536): transl_table=11
atgtccgcaattccgaaatccgacccatccggttcgtcagcgaaccctcccaagcttcatcgcgcgctgaaggcgcgccacctgacgatgatcgccatcggcggctcgatcggcacgggcctgttcgtcgcgtccggcgcgtcgatctcgcaggccggccccggcggcgcgatggtcgcgtacatggcgatcggcctgatggtctacttcctgatgacgagcctcggcgaaatggccgcgttcatgccggtgtcgggttcgttcgcgacctacggcgcgaaatacgtcgacgaaggcttcggcttcgcgctcggctggaactactggtacaactgggccgtgacgatcgcggtggagctggtcgccgcgcagctcgtgatgcattactggtttcccgacgtgccgggcgtgtggtggagcgcggcgttcctcggcgtgatgttcctgctcaacgcgctgaccgtgcgcggctttggtgaagccgaatactggttcgcgctgatcaaggtcgtcaccgtggtcgcgttcatcggcgtcggcctgctgatgatcttcggcattctgaagggcgcgccgagcaacggctggggcaacctgacgatcggcgacgcaccgttcgcgggcggcctgccggcgctgatgggcgtcgcgatgatcgccggcttctcgttccagggcaccgagctgatcggcgtcgcggccggcgaatcggaaaacccgcgcacgacgatcccgcgcgcggtgcgccaggtgttctggcggatcctgctgttctacgtgttcgcgatcttcgtgatcggcgtgctgattccctataccgacccgaacctgctgaagacggacgtgaccgacatcggcgtgagcccgttcacgctcgtgttccgccacgcgggcctcgcctttgccgccggcgtgatgaacgcggtgatcctgacggccgtgctgtcggccggcaactcgggcatgtatgcgtccacgcggatgctctacaacctcgcaaccgaaggccgtgcaccgaagatcttcgcgaagctgtcgcgcggtggtgtgccgcgcaacgcgctgtacgcgacgacggccgtcggcgcgctgtgcttcttcacgtcgctgtacggcgacaagaccgtgtacctgtggctgctgaacacgtcggggatgacgggcttcatcgcgtggctcggcatcgcggtcagccactaccggttccgcaagggctacgtgaagcagggctactcgctcgaccagctgccgtaccagtcgaagtggttcccgttcggcccgctgttcgcgttcgtgctgtgtctcgtgatcgcgctcgggcaggactatcaggcattcctcgcgaaccggatcgactgggccggcgtggccgcgacctatgtcggcattccgctgttcctcgtcgtgtggctcggcttccggttcctgaagaagagccgcctggtgcgctacgaagacatggaaatcgcgccgtggatcgccgcgggccgcggtgcgcagcagcagccggtggcgaaccgcgaaaccgcgggctga

SEQ ID NO: 8407 - protein, 511 aa, Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 8408 - DNA, 1563 bp, Burkholderia thailandensis E264
  CDS (1)..(1563): transl_table=11
atgtcaccacacccgaattccgacaactcaaccgcacaatcgaatcctcctcagctgcgccgcagcctgaaagcccgtcacctgacgatgatcgcgatcggcggctcgatcggcacgggcctgttcgtcgcgtccggcgcgtccatctcgcaggcgggccccggcggcgcggtgctcgcctatctgctgatcggcctgatggtctactgcctgatgatgagtctcggcgagatggccgcgttcatgccggtgtcgggctcgttcgcgacgtacggcgcgaaatacgtcgaggaaggcttcggcttcgcgctcggctggaactactggtacaactgggcggtgacgatcgcggtcgagctcgtcgccgcgcagctcgtcatgcattactggtttcccgacgtgccgggcgtctggtggagcgccgcgttcctcggcgtgatgttcctcctcaacgtgctgaccgtgcgcggcttcggcgaggccgaatactggttcgcgctcatcaaggtcgtcaccgtgctcgcattcatcggcgtcggcctgctgatgatcttcggcatcctgaagggcggcccgagcaacggctggagcaacttcacgatcggcgacgcgccgttcgcgggcggcttgcccgcgatgatgggcgtcgcgatgatcgccggcttctcgttccagggcaccgagctgatcggcgtggccgccggcgaatcggaaaacccgcgcacgacgattccgcgcgcggtgcgtcaggtgttctggcgcatcctgctgttctacgtgctcgcgatcttcgtgatcggcgtgctggttccctacaccgatccgaacctgctgaagagcgacgtgaccgacgtcggcgtgagcccgtttacgctcgtgttccgacacgcgggcctcgcgttcgccgccggcgtgatgaacgcggtgattctgaccgccgtgctgtcggcgggcaactcggggatgtacgcgtcgacgcggatgctccacaacctcgcgaccgaaggccgcgcgccgaagctgttcgcgaagctctcggcgggcggcgtgccgcgcaacgcactgtacgcgacgaccgcggtcggcgcgctgtgcttcctgtcgtcgctatacggcgacaagacggtgtatctgtggctgctgaacacatcggggatgacgggcttcatcgcgtggctcggcatcgcgctcagccactaccgtttccgcaagggctacgtgcgccagggcttctcggtcgaccagctgccgtatcagtcgaatctgtacccgtacggcccgatcttcgcgttcgcgctgtgcatcgtgatcgcgctcggccaggactatcaggcgttcctcgcgaacaagatcgactgggtcggcgtgctcgcgacctacgtcggcattccgctcttcctcgtcgtgtggctcggctatcggctcgtccacaagacgcgcttcgtcggttacgaagacatggacatcgcgtcgtgggtggccgagcacgagcgcgcggcggcgcacgaagcacgcgaagcggcggccattcgcgtgccgtcgagccccgaagcggcttcataa

SEQ ID NO: 8409 - protein, 520 aa, Burkholderia thailandensis E264
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 8410 - DNA, 1455 bp, Francisella tularensis subsp. holarctica
  CDS (1)..(1455): transl_table=11
atgtcgcagaaacttaaacgtggcttacatactcgtcatatgtcaatgatagctctaggtggctgtattggtactggtttatttgtagcacttggtggagcaatcgctgatgcgggtcctggaggaactgtcttggcgtatgttattatagctataatggtttatttcttgatggcgagtcttggcgaaatggctgcgcatagccctgttagtggcacattttgtgaatatgctacgcgctatgttgattcagcgttaggctttagtaccggttggagttattggtttaattgggcaattacagttgctacagaggttattgccgcagcgttaattatgcagtattggtttccaggtagttcaattctgttgtggagtggatttttctttgtactagtttttgctttgaatatcttctcagtaaaaatatatggtgaagttgaatattggttatcttttataaaagtttctacagttattatatttataattgttggtttcttatcaatacttggtttagtaggtaatcaccaaagtgttggttttcagaactggcatatcggagatgctccttttcataatggttggtggggctttatatcagtattcatgattgctggattttctttccaaggtagtgagcttataggtgtaacagctggggaagcgaaagatccaaatacatctataccaaaagcaatcaaacaaacattttggcgtttatttatattttatatacttgctgtagtgattattagcttcttgattccatacaataatccatctttgataaaagttggagcaagtaatgatgtttcagttagtccatttacaatagtttttgaaaacgttggtttgaattcagcggcaactattatgaatgtaattatattaactgcgataatatctgcatgtaatgcaagtatgtatagtgcgacaagggtactatggcatttaggtaacattaagcaagccccgcagttttttgcaactactaattcaaaaggtacgccaatgattgctcttttggttacagcagttataggctcgtcattcttctttgtatcttttgttggtagtggatatatatttacatggttagtcaacgtttcaagtttagcgggatttattgcatggtttacaattgcacttagtcactatcgttttagaagagcatatataaagcagggtaaaagcttagaagatttaccatatgtagcaaagtttttcccatgggcgcctattattgctttaactatggtaagtatagtaatcgttggtcaaggtgttacaatgttgacaatggatggtagaacttggtttagtgtaataatagagtttttatcaacttatataggtttctttgcatttgtgatactatattttgtatataagtttattaaaaagacaaaattgataagactagaagattgtgatcttactagagaatcttag

SEQ ID NO: 8411 - protein, 484 aa, Francisella tularensis subsp. holarctica
MSQKLKRGLHTRHMSMIALGGCIGTGLFVALGGAIADAGPGGTVLAYVIIAIMVYFLMASLGEMAAHSPVSGTFCEYATRYVDSALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKVGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMDGRTWFSVIIEFLSTYIGFFAFVILYFVYKFIKKTKLIRLEDCDLTRES

SEQ ID NO: 8412 - DNA, 1482 bp, Ralstonia metallidurans CH34
  CDS (1)..(1482): transl_table=11
atgtcccatccacacccccatcaacacccggtcgtcgagcacgacgacctgcaccgcaagctcaaggcccgccacctgacgatgatcgccctgggtggtgccatcggcaccggactgtttgtcgcctcgggcgcatccatcgcacagtccggccccggcggcgccctgctggcctactgcctgatcggcctgatggtgtactgcctgatgaccagccttggcgagctcgcggtgcacatgcccgtggcaggatcattcgtaacctacagcgccctctacgtcgacgagggctttggcttcgcacttggctggaactactggttcagcctggccgtgacaattgccgtcgaactgaccgcagcccagttggtcatgcagtattggttcccggaggtaccgggcatctactggagcgcgggctttctggcactgatgttcgcgctcaatgcgttctcggtgaagggcttcggcgaggccgagtactggttcgccatgatcaaggttgtaaccgtcgtcgttttcctgtgcgtgggcgtgctgatgatcctcggcatcctcaagggtgggccacaatcgggctggcacaacttcacgaccggcgaagccccattcgtcggtggcctccccgggctgttcgcggtggcgatgattgccggcttctcatttcaaggaaccgagacggtcggcgtggcggctggtgaagccgcggaccccggacgcacgattccgcgcgcgatccgacagacgttctggcgcatcctgctgttctatgtcgttgccatcctgatcattggcgtgctcattccgtataccgacccgaacctgcttcgcaatgacgtgaccgacgttggcgtcagcccgtttgcactggtattccagcacgctggcctggcttttgccgcggcgctgatgaacgccgtggtgctgaccgcgctgctctcggcggggacatcgagcatgtatgtttcgactcggattctctatggcttggcggtcagccagcgcgccccaagggctctagccaagctcaccccgaacggcgtgccattcaacgcgctgctggtgaccacgggcatcggcgcgctgtgcttcttcagttcgctgttcggcgacaaggccgtgtacctgtggctgctcaacacatcggcaatgaccggcttcttcgcgtggctcggtatcgccgtcagccactatcgtttccgcaagggtctgctgtaccagggctacaaggtcagcgatcttgcctaccgctctccgctctatccgttcggcccgatcttcgctggcgtgctgtgtctcgtcatcgtgggcggccagaactatcaggcattcactgacatccccggccgttggcaagagatcgtctcgacctacattggcgtgccagtcttcctggcgctatggctcggctaccgcatcgtacgcggcacgcgcatgatcgactacgaagacatgccgtttgaactggtaaagaaggactga

SEQ ID NO: 8413 - protein, 493 aa, Ralstonia metallidurans CH34
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 8414 - DNA, 1533 bp, Ralstonia metallidurans CH34
  CDS (1)..(1533): transl_table=11
atgtccaataccaatacaacaccagccgtccccgttcccggcctgcgccgcgaactgcgcgcgcgccatctgaccatgatcgccatcggcgggtcgattggcaccggactcttcgtcgcctcaggcgccacgatcgcccaggccggccccggcggcgcgctggccgcctacatcctgatcggcgcgatggtctacttcctgatgaccagcctgggcgaactggccgcgtacatgcccgtgtccgggtcctttgccacctatggcgcgctgtacgtcgacgagggcttcggtttcgcgcttggctggaactactggtacaactgggccgtcacgatcgccgtggagctggccgcggcgcagctcgtcatgcagtactggttccccgacacgccaggcgtgctatggagcgccctgttccttggcctcatgttcgcgctcaacgcgatctccgtgcgcggtttcggcgaagcggaatactggtgcgcgctgatcaaggtcctcacggtgatcgccttcatcgtcatcggtaccttgatgatcttcggcatcatgcgcggtgatttctcccacgcaggcggactggccaacctcaccaccggcgatgcgccgttcgtcggcggcctgcccgccatgatcggggtggcgatgatcgcgggcttctcgttccagggcaccgaactgatcggcgtggccgccggggaatccgacgagccggccaagaacatcccgcgcgcggtgcgtcaggtgttctggcgcatcctgctgttctacgtgctggcgatcctgatcatcggcatcctgattccgtacaccgaccccagcctgctcaagaccgacgtggaaaccgtaggcgtaagcccgttcacgctggtgttccgccatgcgggtcttgcgtttgccgcgggcgtgatgaacgccgtgatcctgactgccgtgctctcggccggcaattccggcatgtacgcgtccacgcggatgctctacaacctggccaccgagggccgcgcgccgcgtatcttcgcgcaactcacccgcaacggcgtgcccctggtcgcgctgctggccaccaccgccgtcggcggcctgtgcttcctgacgtcgctgttcgaaagcaagtcggtctacctgtggctgctgaacctgtcgggcatgaccggcttcattgcgtggctgggcatcgcggtgagccactaccggtttcgccggggcttcatggcgcagagcctcgacctgaaccgcctgccctatcgctcaccgttctttccttacgggccgatcttcgcgttcgtgctgtgcatgatcgtcacactcggccagaactaccaggccttcagcgaaggcaagatcgactgggtggccgtgacggccacctatgtgggcattccgatcttcctgctgatctggctcggctaccggctcgtgcgcaagtcgcgcttcgtgccgtatgccgaaatgaaattcccggccctgcctgagatcgaaaaggacgattcacccgtgacgcggcctctggccccggcatcggccgaatag

SEQ ID NO: 8415 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 8416 - DNA, 1470 bp, Clostridium perfringens ATCC 13124
  CDS (1)..(1470): transl_table=11
atgagtcaagaacaaaatactaatctaaaaagaggcttgaaatcaagacatcttagtatgattgccatgggtggtgccataggaactggtattttcttagccatgggagatacacttcatcaagccggtgtaggaggagcttttgtagcttacggaattataggagtaatggtatatttcttgtgtacaagcttaggggagatggcaacatatatgccagaaacaggttcctttggagcttatgcaacaaaatttgttgatcctgctttaggatttgctttaggatggaattactggtataactgggctataacaatagcagcagaaatggttgcaggttctttattaatgaagttttggtttcctaatgttccagcaatagtttggagcgcattattcttagtaattatattaactcttaatttattatctgccaaagcttatggagaatcagagttttggtttgcagctgtaaaagttgctactgttataatattcttaatcgtaggagttcttatgatttttggaatattaggtggagataatgtaggattcaaaaacttctatgaaaatggaggcccgtttattggaggagcaaaatcaattttcatgattttcttaatagctggtttctcattccaaggaactgaattagtaggggttgctgctggagaaagtgaagatcctgaaaaaaatgtacctaaggctgttaatacaatattttggagaatattattgttttatttaggaacaattttagtaataggtgctttagtgccaaatgctcaagctggagtagaaacaagtgcctttacaatagtatttgagaaattaggattagctggagccgcttccattatgaatgccataatacttacatctgttttatcagctggtaattctggtatgtatgcatcaagtagaatgctttatgccatggctaaaagtggaatggcacctaagatttttgaaaaaactaattctaggggagtaccagttaatgctattataataacaacaataattgcaagtttatgtttcttaacaggtatttatgctgaaaatacagtttatgtatggcttgtagcagcatcaggattatcaggatttatagcttggcttggaatcgcaatatgtcattatagattcagaaaagcttatgtagctcaaggtaaagatatgaatagattagtttataaagctaaattattcccactagggcctataatagctttaatattatgtggaataatagttttaggtcaaggatatgcatacttagatgttagaaatggagtagactggggtggattaatttcatcttatattggattacctctattctttggattatttgcatattataaaattaaatataaaactaaaataatagacttaaaagatgttgacttaagtgtagagcatatagatactgatgagagtatagaagatgaagtattttcttactaa

SEQ ID NO: 8417 - protein, 489 aa, Clostridium perfringens ATCC 13124
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKSGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 8418 - DNA, 1464 bp, Pseudomonas aeruginosa UCBPP-PA14
  CDS (1)..(1464): transl_table=11
atgactgacctgaacaccagccagggccagcaactgcggcgggtgctcaagccgcgccacctgaacatgatcgccatcggcggctccatcggcaccgggctgttcgtcgcctccggggccaccgtggccaccgccgggcccggcggtgcgctgctttcctacgccctgatcgggctgatggtgtacttcctcatgaccagtctcggcgagatggccgcctacatgcccgtttccggctcgttctgcacctatggcagccggttcgtcgaagatggcttcggtttcgccctcggctggaactactggtacaactgggcggtgaccattgccgcggaactggtggcggcgcaactggtgatgagtttctggttccccgaggtgccgggcatctactggagcgcgatcttcctgggcatcatgttcggcctcaacgtgatttccgcgcgtggcttcggcgagagcgaattctggttcgccctgatcaaggtagtcacggtggtgatcttcatcggcgtcggcctggcgaccatcttcggcatcatgcatggcgtggagtcgcccggcttcagcaacttcaccatgggcgacgcgcccttcgtcggcggcttccaggcaatggtcggggtggcgatgatcgccggcttctcgttccagggcaccgagttgatcggcatcgccgccggtgaatcggaaaatccgcggaagaacatcccgatcgccattcgccaggtgttctggcgcatcctgatgttctacatcctggcgatcttcgtgatcggcatgctgattccctacaccgacccgaacctgctgaagaacgatgccagcgacatcagcgtgtcgcccttcaccctgctcttcgagcgcgccggcttcgccgcggcggccggagtgatgaacgcggtgatcctctcggcgatcctctccgccggcaactccggcatgtacgcctcgacccggatgctctacaacctcgccctcgagggcaaggcaccgcgcctgttctcccgtgtctcgcgcagcggcgtgccacgcaatgcgctgtacgccactaccctggtcggcgccctgtgcttcctcacttcggccttcggcgacagcaccgtctacacatggctgctgaacacctcgggcatgtgcggcttcatcgcctggctgggcatcgccatctcccactatcgcttccgcaagggctacctggcccagggcggccgcctggaagacctgccctaccgggccaagctgttccccttcggcccgctgttcgccttcgccctgtgcatggtcatcaccctcgggcagaactaccaggcgctggtgggcgaacgcatcgactggatcggcctcctcgccacctacatcagcctgccgctgttcctggcgatctggctgggataccgctggaagaagcgcgcgcgcttcgttcgctaccacgaaatggacgtcagcccgaccaatacctga

SEQ ID NO: 8419 - protein, 487 aa, Pseudomonas aeruginosa UCBPP-PA14
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 8420 - DNA, 1452 bp, Pediococcus pentosaceus ATCC 25745
  CDS (1)..(1452): transl_table=11
atggcagaacaaggtggtagtcaggttaagcgtgccttaaagacgcgacatatttcaatgatttcactgggtggaagtattggtacaggactattcgtagccagtggatcggcaatctccactgcaggtcccggtggtgcattattagcttacgttgggatgggggtcatggtctatttcctcatgactagtttaggagaaatggcgacttatatgccggtttcgggttcgttttcaacgtacgcaactaaatacgttgatccagcctttggctttgcaatgggatggaattactggtttaactgggctattacggttgcagttgatattagtaccattgccttgattatgaaattctggtttcctcacgctccggggtggatctggagcctgttggcactagtgctagttttcttggtaaatgctttgacggttaaagcttttggtgagactgaatattggattgctttaattaagttagtcacggttattatatttttggtcgtaggagttttaaccattgttggaattatgggaggtaaagccacatatttagaaaactttgtgtatcataaagccccgtttgtgggtgggatccctgctattcttagtgttttcgttgtggctggtttctcgtttcaaggtacagaattgattggaattacagctggcgaatctgaaacacctgaaactagtgttccgaaggccattagccaagtattttggcgaattttactattttacatcttagcaatttttgtgattgcttgtatcatcccttatacaagccctaatttattaggatcatcagcccgtgatgtttccattagtccatttacccttgtgttccgtcgggcaggactagcaggagcagctggggtaatgaatgcggttattttgacctcagtactatcctcagctaattcggggatgtatgcctcgactagaatgttatattcgctttcgaaacaaggatttgctgccaaaatttttggtaaaacttcgaagcgaggaatcccatacctggccttacttggtacaactatcgtaggattgctaacctttatttccagtattatgggacctaaaatttatatatggttagttgctgccagtggactgactggctttgtggcttgggtcggtattgcgattgctcattggcggttccgtcgggcttttattaaacaaggacatgacgtgtcagaacttagatatcgtgcaaaatggttcccatttggaccactctttgcctttgttctcagtattattgtgattgcgggacaagatattcattccattgctaatttcgattggcaagcaattgggattacgtacatggcaattccgctattcattgtgttgtatacctattataaaattagatataaaacgaagttaataccgctggaagaaatcgatttatcgcgtccagatatcacgaaagaataa

SEQ ID NO: 8421 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 8422 - DNA, 1440 bp, Leuconostoc mesenteroides subsp. mesenteroides ATCC 8293
  CDS (1)..(1440): transl_table=11
atgtctgaacataaagggcacatacagcgtaatttaaaaacgcgccatgtgtcaatgattgcattaggtggttcaattggaacgggcttattcgtagcttcgggagccactgttgcgcaagcaggtcctctgggtgctattgtcgcttatttagctattggtgtgatggtttatttcttaatgacttcgctgggtgaaatggctacttattcaccaacttcaggttcattttccgactatgctggtaaatatgttgacccagcattgggatttgccatgggatggaactactggtttaattgggctataacattagctgtcgacattgtggcagttggcttggtggctgaattttggtttccaaatacaccagggtggatattttccgcgattgctttattacttatcttcttaattaatattttttcagttggaacttttggagaagctgagttctggttgtcgatgattaaggtagtaactattattgccttcttgattgttggtctggctactatttttggtgtaattcattctgacatcaatgtcatgaaaaacttgtcggtcggtaatcacggatttgttggtggacctcaagctatcttatcagtattcgttgttgctggattttcttttcaaggaactgagttaattggtattactgctggagaagcagaggatcctgataagtcagttcccaaggcgataaatcaagtgttttggcgtatcttattgttttatattctggcaatttttgtcatttccgctctggtttactataaagatccgcgcttgttgagttcttccacacaaaacattgcggtctcaccatttacaatcgtatttaaaaacgcaggaattgcttttgcggctagtttaatgaatgcagttatcttaacatcaattgtttcgtcagcaaattcaggttcatatgcttctacacgtatgttgtatgctatggcgcgtaaaggggatgcccctaaaatttttgccaagctttcaactagaggggttccagttgcagccttagtattaactactgcgattgggttattagcatttattgctaacaccaaagggggatcagttgcttatacttggctggtcaatgcttctgggttaactggattcatcgcttgggtcggcattgctatctctcattatcgcttccgaagagcttatgtggcgcaaggaaagagtctgtctgatttgaaatacaaggctaagtggttcccattcggtccactatttgcgctagtgatttctattggtgttattattggtcaggatccggacagttttgcccatctaaattgggaaaaaatatttgtgacctacttatcagttcctttgtttgtaatcttatacttttggtacaaggtttctcacaaaacgaagctaattgctctaaaagatgttgatctaaaacaatataaataa

SEQ ID NO: 8423 - protein, 479 aa, Leuconostoc mesenteroides subsp. mesenteroides ATCC 8293
MSEHKGHIQRNLKTRHVSMIALGGSIGTGLFVASGATVAQAGPLGAIVAYLAIGVMVYFLMTSLGEMATYSPTSGSFSDYAGKYVDPALGFAMGWNYWFNWAITLAVDIVAVGLVAEFWFPNTPGWIFSAIALLLIFLINIFSVGTFGEAEFWLSMIKVVTIIAFLIVGLATIFGVIHSDINVMKNLSVGNHGFVGGPQAILSVFVVAGFSFQGTELIGITAGEAEDPDKSVPKAINQVFWRILLFYILAIFVISALVYYKDPRLLSSSTQNIAVSPFTIVFKNAGIAFAASLMNAVILTSIVSSANSGSYASTRMLYAMARKGDAPKIFAKLSTRGVPVAALVLTTAIGLLAFIANTKGGSVAYTWLVNASGLTGFIAWVGIAISHYRFRRAYVAQGKSLSDLKYKAKWFPFGPLFALVISIGVIIGQDPDSFAHLNWEKIFVTYLSVPLFVILYFWYKVSHKTKLIALKDVDLKQYK

SEQ ID NO: 8424 - DNA, 1575 bp, Bifidobacterium longum DJO10A
  CDS (1)..(1575): transl_table=11
atgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtgatcggcaccggcctgttcctgagctccggatacaccatccagcaggcgggccccatcggcacgatcctggcatacagcatcggcgcgctgatcgtctacctggtcatgctcacgctcggcgaactgtccgtggccatgccggtgaccggctccttccatgtgtatgccgagaagttcatcggccctggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccttaaacgccttgtcggtgcggctcttcgccgaagcggaattctggttcgcctcgatcaaggtgttcgccatctgcgcgttcatcgtcatcggatcgctcgccatcttcggcgtcatcccggtcgccggctaccaacatgccccgatgttcgtcaatctcatcaaggacggcgtcttccccaacggcttcatgccggtgttcgccacgattctgaccgtcaacttcgcgttctccggcaccgaactcatcggcgtgaccgccggtgagacgagggacccgcaaaccgccgtgccgaaagccatccacaccaccctgtggcgtctggtgctcttcttcatcggctcaatcaccgtgatgtgcgcgctgatcccgtggcgcaaggccggcgtgggcgaaagcccgttcgtgctcgtgttcaacggcataggcatcccctatgcgggagacatcatgaacttcgtggtgctcacggccgtgctctccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggctgccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactga

SEQ ID NO: 8425 - protein, 524 aa, Bifidobacterium longum DJO10A
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 8426 - DNA, 1467 bp, Bacillus cereus G9241
  CDS (1)..(1467): transl_table=11
atgaatagcgcaacgaatcaaactacctctcaaacagaaactacaaaaggaaaaggtgaattaagacgcggtctaaaatcaaggcaccttacgatgatttctctcggcggtacaattggtaccggactatttcttgccagcggtggtgtcatccattcagctggacctggcggtgcattaattgcatacgccgcaattggaattatggtttacttcttaatgacaagcttagctgaactcgcagcttacatgcctgttactggatcttttagcacgtacgcaacaaaatttgttgatccatcacttggctttgcacttggctggaactattggtataactgggccattacaattgctgctgaactagcggctgtaacattaattatgaaattttggttccctgataccccttctcttatttggagcggattatgtttagctattattttccttttaaactacttatctgttaaagggtttggtgaatctgaatattggttcgcacttattaaagtagttactattattatctttttaattgtcggtttcatgatgattttcggaattatgggcggcgaaactgttggcttcaaaaacttcactgttgcagatgcaccatttaacggtggtatcatggcaattatcggagtatttatggcagctggtttctccttccaaggaactgaattacttggggtagctgctggtgaaacttctgatccagagcgtaatattccgaaagcaattcgttcaattttctggcgtattcttttattctatatccttgccattctcgttatcggtttattaattccttatacaactgaaagccttgcagcaagtgatgtaacagtaagtccatttacacttatttttgaaaaagcgggcgttgccttcgctgcttctgttatgaacgctgttattttaacggcagtactgtctgctggtaactctggtatgtatgcatcaactcgtatgctttgggatttagctcgccaaggaaaagcaccaaaattcttaggaaaattagatagccgcggtgtacctgttaacgcgttaatcgtaacgtcaattgtgggtagtatcgcattcattgcttctttattcggtgacggtgttgtatacatttggttattaaatgcatcaggaatgtctggctttatcgcttgggttggaatcgcaattagtcattatcgtttccgtaaagcatatattgcacaaggaaaagatttaaatgacttaccatatagagcaaaatggttcccgttcggaccaattttcgcatttgcactttgtatcatcgtaattttaggacaaaactacggcgcatttatgggtgaatcaatcgattggaacggcgtactcgtttcttacatcggtttaccactcttcttagtactatggttaggatataaatttacgaaaaaaacgaaagtgattccgcttgataaatgtgaactaaaataa

SEQ ID NO: 8427 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 8428 - DNA, 1425 bp, Bacillus anthracis str. A2012
  CDS (1)..(1425): transl_table=11
  misc_feature (1236)..(1236): k is g or t
  misc_feature (1408)..(1408): w is a or t
atgctcccaagaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccactkgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaawttagcgagactatataa

SEQ ID NO: 8429 - protein, 474 aa, Bacillus anthracis str. A2012
  misc_feature (470)..(470): The Xaa at location 470 stands for Ile, or Phe.
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 8430 - DNA, 1632 bp, Exiguobacterium sibiricum 255-15
  CDS (1)..(1632)
atgacttgtggggagctatctttcacgacggtagaatggggcgcatccttttactatgttgcgttctcatcttccttctggaaggtgagggcgctttttgttttttcaaaaagtgtcctctcaaaaaatcttaacaagagagaagcgaatgagatgaatactttacaaccccaaagaaaactcgattcaaccgaagaaggactaaaacgcggtctgcaagcccgccacatgtcgatgatcgcgattggcggtgcgatcggaaccggcttattcattgcctccggtgcgtccgttgctgctgccggtcccggcggtgcattgttatcctatgccattgtcggactcatggtgtacttcctgatgaccagtcttggtgagatggcagcatatatgccggtcgccggttcattctcgacctacggcgcgaaattcgtcgacccgtcgtttggttttgcgttaggttggaactactggtacaactgggcggtcacgatcgctgtagaactcgttgcggcgcaaatcgtcatgagttactggttcccggatgttcccggattttacttcagtgctttgttcctgttattgatgatcggtttaaattacttctccgttaaaggtttcggggaagcggaatattggttcgcgatgatcaaagtagtcactgtcatcatcttcctgattgtcggtgtcgcgatgatcttcggtgtcttcacatctgaagcaccggtcggctttaaaaactttgcgttaggtgatgcgccgttcgtcggaggcatcccggccgtcatcggtatcatcctggttgccggtttcagtttccagggaacagaacttgtcggaatcgcagccggtgagtcggaagatccgaagaaaaacgttccgaaagccgtgaaacaagtcttttggcggattcttctgttttatgtgtttgcgattttcgtcatcggaatgttgattccgtacacaagcccgaacctcgtttcgaatgacattaccgatgtagcggtcagtccgtttacacttgtctttgaaaaagccggtcttgcgttctcggcagcattgatgaacgctgttatcctgacgtctgtcttatcggcaggaaactccggaatgtatgcgtcgacacggatgctgtatacgttggcacgccaaggtgatgcaccgaaattgttcgcacaagtctcaaaaaatggtgttccccgcaatgcgttgcttgcgaccggtgccatcggagcactttgcttcctgacatcgatgttcggcggtcaagtatatctgtggctgttgaatgcatcagggatgaccggtttcatcgcatggctcggtatcgcgatcagccactaccgtttccgcaaaggattccttgcgcaaggtcattcgctcagtgatttgccgtacgtggcacctgctttcccgtttggaccactctttgcgttcggactttgttttctcgtcatcgtcggtcaaaactacgccgcgttcctcgcggatcaaattgactgggtgggaattgccgcaacctatgtcggtatcccgttattccttgccttttggttaggtcataaatttaaaaaccggacatcggtcgttccttatgaagaaatggaattcccggagcatccgcgtccgtaa

SEQ ID NO: 8431 - protein, 543 aa, Exiguobacterium sibiricum 255-15
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 8432 - DNA, 2033 bp, Pichia stipitis
  CDS (154)..(1953)
atttggacctcaacggaactatatagtttagctagttttcgttgcaggtttgttttgtatatcactcataggaatagcactcttatccatacattagtcatattagccagactcagctccatcattttgcatacccgttaatctactttcataatggacggttccagttacgaagacaagcagtcccagactggagaaaactcccacttagcctctacggctgtctccagttcaccttacgaacaaagtcaggagcaaaccactacccaagccagatggcactcttttgtagactccttcaagccagctatagaaaccgaggtattgtcgaagaataagcgctacaatgataatgaagacgaagaagctgacatctcggatatccagagaatcaacatcaacacctccaaatctcatttgaagagaaagttgaagaacagacacttgcaaatgattgcaattgcttctgctattggcctgggtttgctcattggtactggttccgccttgagcactggtggacctgctggtatcttgattgcctgggcattgaccggtgcctctattctctgcactatccaagccatggccgaattggctgtgactttccctatcagtggctcattcaacgtctatgccagcagattcatcgaccccagtgtaggcttctctgtcgcctggaactacttcttccagttcttagtattgcttcctttggaattggttgctggttccatcaccatgaattactggaacacctccatcaatcctgacgtatgggttcttatcttctacattgtcgtatcttcaatcaacttttttggtgtcagagcctacggtgaagctgaatttgtgttttctaccttgaaagttctagccgttattggctttataattgtgtctatcgtcttggctgctggaggtggtccgaatggccagtatcatggctctctttactggcacaacccaggtccatttgccaatggtttcaagggtgtagtcagtgtcttcatcactgctgctttcagttttggtggaacagagttggtgggtcttactgctgctgaagcagaccagcctagaaaatctcttccaaaggctaccaagcaggtcttctggagaatcctaatgttctacatggtgtcgttgactttgatcactttccttgttccatatacttccgacagattgttgggagcatcttctgttgatgtcactgcttcacctttcgttattgctatccagaacggaggaatcaagggcttaccatcagtgatgaatgctgttatccttatctctgtcatttcagttggttcatcttctgtttatgccacctctagaacattgactgccttggctgaacaaggtttggctccaaagatttgtggatatgttgatagagcaggtagacctttggtggccatcattattaccaacatctttgggttgctcagtttcattgctgccagtggtaagcaagccgaagtgttcacctggctcttatctatctcagctatgagttccatcttcacctggttatccatctgtcttgcacatatcagattcagaagagcattggcttcccaaggtaggacgactgatgagttgtccttcacctcccaaactggtgttattggttcatggtttggagttgttttgaacacccttgtgattatagccgagttctggttgtccctttttcctttgggcgaatcacccaacgctgagggcttctttcagacttatcttggttttgtgatcttgattgttttctatgtgggccacaagatctggagaaagaactggattttgtttatcagggccaaggatattgacgtagactcgggaagaagagaagctgatattgaagctttgaaggaagagttggctgaagaaagagctattttgagatccaagcctttttactacagagtgtaccacttctggtgttgaaatttcgcagccattaaattttcaacttataaaggcaattgtattatagtgtaccatagacaataaaagtactttcaatg

SEQ ID NO: 8433 - protein, 599 aa, Pichia stipitis
MDGSSYEDKQSQTGENSHLASTAVSSSPYEQSQEQTTTQARWHSFVDSFKPAIETEVLSKNKRYNDNEDEEADISDIQRININTSKSHLKRKLKNRHLQMIAIASAIGLGLLIGTGSALSTGGPAGILIAWALTGASILCTIQAMAELAVTFPISGSFNVYASRFIDPSVGFSVAWNYFFQFLVLLPLELVAGSITMNYWNTSINPDVWVLIFYIVVSSINFFGVRAYGEAEFVFSTLKVLAVIGFIIVSIVLAAGGGPNGQYHGSLYWHNPGPFANGFKGVVSVFITAAFSFGGTELVGLTAAEADQPRKSLPKATKQVFWRILMFYMVSLTLITFLVPYTSDRLLGASSVDVTASPFVIAIQNGGIKGLPSVMNAVILISVISVGSSSVYATSRTLTALAEQGLAPKICGYVDRAGRPLVAIIITNIFGLLSFIAASGKQAEVFTWLLSISAMSSIFTWLSICLAHIRFRRALASQGRTTDELSFTSQTGVIGSWFGVVLNTLVIIAEFWLSLFPLGESPNAEGFFQTYLGFVILIVFYVGHKIWRKNWILFIRAKDIDVDSGRREADIEALKEELAEERAILRSKPFYYRVYHFWC

SEQ ID NO: 8434 - DNA, 1617 bp, Amanita muscaria
  CDS (1)..(1617)
atggccagtgaagaacttgagaagcaatcaccagtgtatgataagcctggtccagaagcagaatctttgcaaggcgttgccaacgatggactctcgcgacagctgaaaaatcgccacatcgctatgattagtattggcggtgttatcggtaccggtcttttcctcggaactgccactgccttaagaaatggaggaccagttggaatgctattggggtacgccctaatgggattaatatgcttctgtgtgatgatatcactcggcgagatggttgcattcctaccaattccaggcggtcatattaaacttgccgagcgttttgtggacccggcattttcgtttacgatgggttggaattactggtataactggtctatcgttctacccgcagaattgagtgcctcttctgtaattgttggcttctggaatcacaacatcaacccggctgtatgggttatcatttgcttggtggtcgttgttaccatcaatatgttaggcgctggtgtatacggcgaagcagaattttggtttgcttctatcaaagttattactatcacaggccttattatcttgggtatcgtccttgaccttggtggcggaccaaaccacgacaggttgggcttccggtactggaagaatccaggcccattcgtccaattcggtggaatatcaggcactacagggcaattcctcggcttttgggccgtcctgactcaggccgctttctcttacatcgggacggagattgttgctatcgctgctggggagacgaagaaccccagacgcaaccttcctcgggctattaaaagggtttatatccgtattcttttgtcctatatctgtggtaccttaatcattggactacttgttccctccaatgacagcggtcttaatctgggggatggaactgcggcttcatccccattcgtcatcgctatcgaacgcgcaggaattaactcattgccacacatcatcaacgcttgtctccttacgtctgcgtggtcggcagcatccagtgatctctacacgagttctcgggctctgttcggtttggctgtgtccggaaacgcgcccaaaatcttcctcacaacgacatcatctggcttgccctatgtttcaatcgcgttcgagtgcatgctcttgcgcctcctggcattcatggccactagtagtggggcgggtaaggtgtttggatggttcgcaaacatgacagccattgctggtttgatgacgtggttcggaatttgcgtctcttatatccgtttctacaacgccttgaaagtccagggctatgaccgcaagaccttgcccttttcatcaaggctgcaaccttttgccgcttactttgctgcaggattcattctagtcgcgtgcttcttcagcggatttgccgttttcctcaagggcaaatgggctacagataccttcgtgacaaattatttgccatttgtgctgttccctatcatgtatggccttgcgcgactctactacaaacaaggcccaaaaccgtacgatgaaattgatctggtgactggattgaaggaaatcgaacaacaaacatacgatgaaccacccccaaataacttccttgaacgggtctggcagtgggtgatgtga

SEQ ID NO: 8435 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 8436 - DNA, 1719 bp, Neurospora crassa
  CDS (1)..(1719)
atgtccgacatagaaaaagggtcagcgggctcccacgacaaggagacccgcgtcgacgcggccactcttcccgcctatgaggccggcagcgtcgccgaggcgcaacaggaggacttcatgacgcgcaacggtctcaacctcgcctccttcaagccccgccggttccacacgggcgacggcaccgagatcgagcgcaccatgaagtcccgccacctgcacatgatcgccattggcggctccatcggcgccggtttctttgtcgggtccggcaaggcgctgcacaacggcgggccggcgtcgctgctgattgatttcgccatcatcggcgtcatgatgttcaacgtcgtgtacgccctgggtgagctggctgtcatgtttcctgttaccggtggcttctacacctactcgactcgctttatcgatccgtcttggggtttcgccatgggttggaattatgttttccagtgggcgatggtcttgcctctggaacttaccgtttgcgggtttacggtcgggtactggaatcaggacataaccgtctggatcaccaccttcctcgtcgccatcatcatcatcaacgtcttcggcaccctcggctacgccgaagaggaattctgggcttcggcattcaagctcggcgcaaccattgtcttcctcatcatctgcctcgtcatggtcctcggcggcggtcccaaaggcagccgctacgaccactacaccggtgccgccctgtggtactcccccggcgccttcgccaacggctttagggggttctgctcctgcttcgtcactgcggcttttgccttttcgggcaccgaactcgtcggtctcgctgctgccgaggacaaaaaccccgtcaagtcccttcccggcgccatcaagcaagtcttttggcgcatcaccctcttttacatcctcggtctcttcttcgtcggcttgctcatcccctatgacgacgagaacctgttgggcgctaacccgttcatcaacgtcaacgcttccccctttgtgctggtgggcaagtacgcgaacctgacgggcttcgactcgttcatgaatgtggttattctggtgtcggtcctctcgctcggtgtctcgtgcgtctatggtggctcgcgcaccttgactgccctcgctcagcaggggtacgcgcccaagatctttacgtacgttgatcgttccaaccgcccgctgttctcggtcctgctcattattgcgtttggccccctggcgtatgtcaacttggcggctgctggtccgaccgtgttcgattggttgctttcgctttccgggctggcggcgctgttcacgtggggatcgatttgcttgagccatattcgctttcgcaaggcgtgggcgctcaagggacatagtgtggaggagatcccgttccgggctgcgggcggtgtgtggggatcgtggctggggttggtgttggttgttttggtgttgattgctcagttctacgtagccatctgcccacccggcggcggcttcaacacggtcgagggcttcttcgtgcagtacctcgccttgcccgtcgtcatcgtcttctggatcggtggattcatctggaagcgcacgagctggctccgcgttgatcagatcgatgttgacacgggccgtcgcgaacatgattgggagtcgattaatgcgtaccaagctgagttggctgctatgcctgcttggaagaggtggttccataagttgtttgtctga

SEQ ID NO: 8437 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 8438 - DNA, 1776 bp, Phaeosphaeria nodorum
  CDS (1)..(1776)
atgactttcgacgacgacatgtacgggaccgagaagagttttgggaggggctcgcaggcctcggattattatggcgaatcttcggtccatcgagacggcattgggaggagagtcatcgagagcttcaagcgggatcccaacttcatgatgacgcccaagggagctctgggtgccgatggaaaggtctttgatgtcgaaactgcagcccaaaatacggccaactcaccacttgcccgcaaactcaaaggccgacatctgcagatgatagccatcggtggttccatagggactggtctgttcgttggttccggacaagcgctagccaacggtggtccagcagcgctggtcatcgcgtactgcatggtcggtctcatgctgtactgcaccgtccacgccttgggtgagatggctgtactgtttcctgttgctggttccttctcggcctattctactcggttcctcgacccggcatggggcttcgctatgggctggaactatgctctgcagtggcttgtagtgttgccgctggaaatcgttgctgctacctttactatcgaatactggaataccaagacggtgaacaacaacgcctgggtggccatattcctggtcttcatcgtggcgatcaatctcttcggtgtcaaaggatatggtgaagcagagttcatattcgccattatcaagattgccgccgtcattggattcatcatcctaggtattatcatcaacattggaggcggcccagaaggcagctacattggtggaaagttctggcgtgatcctggccctttcaatcacggcttcaaaggactgtgtagtgtcttcgttaacgcagcctttgctttctccggaaccgagctcgttggacttgcagcagctgaaaccgctaatccccgaaagtcactacctactgctgtcaagcaggtcttctggcgcatcaccctcttttacatcgtttcactcaccatcgtcggcctcatcgttccgtacaacgatccacgcctcctccaggacagcaacagcgctgatatcgtcgcatccccttttgttattgcaatccaaaatgctggaatcgatggactcccctccgtttttaacgccgttattatgatagccgtgctttccgtcggcaactcttctatctatggctcgtcacgtactcttgctgccctcgcagagcaacaccaagctcccaggattttcgcctacatcgatcgccagggtcgccctctcgtttctatcgcctttgcctcatcccttggtctcttggccttccttgctggtgcagaccgcaaacttcaagagaacgccttcaactggcttcttgcgctctctgctctttctgccgtcttcacgtggctctcgatctgcgtggcccacatccgcttccgccagggctggaaagtacaagggcatcagctctccgaacttgccttcaggtcgcagcccggtgtcatcggctcctggatcggcgccatcctcaacatgctcgtcctaatcgcacaattctacgtctccaccgcgccgttcgactatcaaaagatgaacacttccggccgcctacagcatttcttcagcgtgtacctcgcactccccgtcacaatagcgttctacatcccctacaaactctactaccgcacctccatcgtgcgatcacacaacatggatctgcacacgggcatccgggagctcaatatcgcggagctaatagaagaagagcgcgaagaacgcaagcggtggccgcggtggaagaaggtgtacaaattcctttgttag

SEQ ID NO: 8439 - protein, 591 aa, Phaeosphaeria nodorum
MTFDDDMYGTEKSFGRGSQASDYYGESSVHRDGIGRRVIESFKRDPNFMMTPKGALGADGKVFDVETAAQNTANSPLARKLKGRHLQMIAIGGSIGTGLFVGSGQALANGGPAALVIAYCMVGLMLYCTVHALGEMAVLFPVAGSFSAYSTRFLDPAWGFAMGWNYALQWLVVLPLEIVAATFTIEYWNTKTVNNNAWVAIFLVFIVAINLFGVKGYGEAEFIFAIIKIAAVIGFIILGIIINIGGGPEGSYIGGKFWRDPGPFNHGFKGLCSVFVNAAFAFSGTELVGLAAAETANPRKSLPTAVKQVFWRITLFYIVSLTIVGLIVPYNDPRLLQDSNSADIVASPFVIAIQNAGIDGLPSVFNAVIMIAVLSVGNSSIYGSSRTLAALAEQHQAPRIFAYIDRQGRPLVSIAFASSLGLLAFLAGADRKLQENAFNWLLALSALSAVFTWLSICVAHIRFRQGWKVQGHQLSELAFRSQPGVIGSWIGAILNMLVLIAQFYVSTAPFDYQKMNTSGRLQHFFSVYLALPVTIAFYIPYKLYYRTSIVRSHNMDLHTGIRELNIAELIEEEREERKRWPRWKKVYKFLC

SEQ ID NO: 8440 - DNA, 1614 bp, Phaeosphaeria nodorum
  CDS (1)..(1614)
atggcgctcttcgacaacaagaaccccggcgaggccgcttcgcccacggccagctaccgcgatgaagacttctcgcgcatcgatccagactcgggtgtcaagcgaggtctgaaaacccgccatttgtccatgatggcgctggctggtatcatcggccctggcatcctcgttggaactggaggcgccctggcaaacggtggtcctgcagccctacttatcggatttggtttcatcggcatcgtcgcatggagcattactcaatcactaggcgaaatgacgactctgtaccccacaggaggtgcttttgtcactctctctgatcgattcgtcgacaaagcgttcggtgtggccgtcggatggcaatattggctcgtgtgggcttgcgttctggccaacgagtacaacgtcatatcatccctcatggtcttctggagcgacaaagtaccatcgtggggatactttttaatattctggttcgccttcctgggattccaaatgatcggtgtcgaatcttttggcgaggctgaattctggctggctttggtcaagctagttggactctgcacgtacttcctcttcagcatcatctacgtctccggaggcttgataggccaaactgaagccataggattccgctactggaacgatcccggcgcattcaccaacgggtttcgtggtgttgcgcaggtgtttgtcttcgcgtctacgttctatgctggtgtcgaggctgtggctgtggcagctacggagactcggaatcctagtgtagctgtcccgctcgctatacgtcaagtcatatggcgtatcctgttcgtatacatgggtgttgcattctttttcggccttacctgtccggccgacgcggacggccttattaacggcgaaagtcgtgcgctgaagagtccgatgactatcgcaatccaaaatgctggctgggaggggggcgtacatctgataaatgccttcatcttcatcaccgtcgtatcagccgccaacagttctatctatattgggtcaagaaccattctatttatggcgcaggagcgcatggcgccacgattcctaggcaagaccaactcgcgcggcgtgccgtaccccgccatcatcttcacgaacctgtttggtttcatttctttgatgaatttgagtacaggaggcggcaaagcatacggatatatcatcaatttgagcggtgtatcgacgttcatcgtctggggcgcaatctccttcacgcacatccgctttcgacaagcttgggcagctcaaggacgagctcccgaacaactgcctttcaggtcctttggctacccatggaactcgtactttggactcggcgccaacattttccttgctcttgtacagggctggacgacattcagtcctttcgatgcaggaacatttgtcgatgcgtatatcctgcttccgctgttcggcatcatttatttcggatacaagttcatcttcaagacgcgatattggcgcgctcacgagatcgatttggatgctggaatgaggaaggacctggatacgaaggaagaggtgctgcatggtgagcctgatgcgggtggacacaagaagaagggcattgtgaggagattgttaagtaagatctga
